United States Patent 6,812,339 (POLYMORPHISMS IN KNOWN GENES ASSOCIATED WITH HUMAN DISEASE, METHODS OF DETECTION AND USES THEREOF) - sequence listing, part 18

SEQ ID NO: 12419 - DNA, 60095 bp, Human
ctgtaatcctagcactttggcggctgaagcaggaggatcacttgagcccaggagtttgaaaccagcctgggcaacatagtgagattttacagaaaataaaaaaattagctgggcgtggtggtgcatgcttttagtcccagctacaccggagtctgaggtgggaggattgtttcagcctgggagatacaggttgcagtgagccacgatcatgccactgcactccagcatgggcaacagagcaagacctcatctccaaataaataaataaataaaataaaaacaacaaaaggcaaaaatgaatccatttgcagatgagcagaaactgagaggatttgcaccaacgaagctacaaaaaaataaaatttaaaggatttacctcaggcaaaaggagagtgatcctgttggtgaaagctgagatgcaagaagaaaaggtggataaaaatggtaattgtgtggctgaatctaaactaatgttgactgaataaaacaatttagtaatgtctcttggggttacagtggcaaaggttaaacttaacatacactacattaaggtgtataatttagaggatgggtgattaaagtactccaaagtctttatattttaaggaaacagggtaaagacatttttacaaatatttaaagatattggactttcacaaggtaagtatgcatgcccaaaagtttgaagtaaccactaaaacttagaaatagagtatacaggtgaagaaaatcagaatgagaataaaaataaaccctaaagaagaaaggaaaggggaaaaaaaccaggcaggacaaatagaaataacaaaatacaatggtagaaataattccagatatatcagtaaatataataaatgtaaatggactaaatgctccagttaaaatacaaagactattcttttaaaaaacctttttatcatgaaaaatttcaagtatacagcaaagtgggagaaacagtacaagaaaaccatatacctgcgatgtagagtcagccattgctagcaatttgccacatttgtctcacctatatgggtatgtataggagactattaagaacacctatttaacttccatagtaaacataatataatgaaatacaatttaaacggtaatcatgatgtagagtatccacttttgaggtcaagcagatctggattctccagcaatttttaattatttaacttacgtgtgtggttatttattcaaaagatgtctcttcactaggctatagtaaaaggattggaatcaggttcgcttttctgatcattgtatttctaaatatttgttgcataaacaaatagaatttactagtaaagaattcagcacagtgccagttgcatagtaaacatttaacgtagagtagcttgtatttattgtagttgctgttgttattggaagcattcagtagagtgatacaaaataaataagcaataattggtagtttattatatttataattattatttacaagacgtcacagtgcctagcccatatcactcacccataaacattatacttatactaagtactttcactattattcaaagtctctaacagtgcctggcactacataagcaagagaaaagtggaagtttattctaattgttattattgaataaagcacttaacacgaagctggcccccagcgggcccttaatagtttccgcggtggctgtcgtagctggactacagaccccgcctcctgagcggcccgaagccccgccccttactgccccgcagtcccgcccccgtggcttgtgccgcgcctgcgcactgtcccggaaggggctctacgcgcgcagctttagtccccgcccctggagccggcggcgcagggcgcagcttcccgccgccagagcgggccagcctgctgcgtgcgtgcgtgtgtacgactctgcgtgcgtgcgtgcgtgcgtgcgtgccgtcagctcgccgggcaccgcggcctcgccctcgccctccgcccctgcgcctgcaccgcgtagaccgacccccccccagcgcgcccacccggtagaggacccccgcccgtgccccgaccggtccccgcctttttgtaaaacttaaagcgggcgcagcattaacgcttcccgccccggtgacctctcaggggtctccccgccaaaggtgctccgccgctaaggaacatggcgaaggtggagcaggtcctgagcctcgagccgcagcacgagctcaaattccgaggtaagccccagaggccgccaccttcctgcccgcggcctccgccccagtgctggaaggacggagcccggcgcggcgggtgacgtcggccctcgtccccaccccgacggcgctgtcgcggggggcggcgaggccgggccgggccttggcgctcgccgcgctccccagaactgcccggagtggccgggacccgagagggctggtgcgggagccggggcctgcgcctcctccccgacccccagcctcctgggacttgccttcgaggcacttgtcactttgtaacttaccagtttgtgatcctctctagtgtgagcctccgccgctgcctttgcctagaagtttcttcccctgctccgtgacagtgttgacctcagggcttagttgaggtgtcagctgctcagagaggcctgctgtgaccacccagccaccgtgcacacctgctgtcattccctattccgtcactgtttcgtggtcagcacggcacttttcatacccaaaatcactgtttcaatactagaagggaaactgcatgaggacaggctcttgtcagttcgctgctgtgtacccagcacacattatacgcctagtaaataaatacctgttgaaccaacagatgaacatgttgaaccaacaaatgaacctcctcaggacttctgatgggattgggcccattttcctttcactgcgtccctcatgctgtctcctggttgcggtgcaaggaggctgccacggtgctgggatcctttttctccgcagagctgtctggagcaacacctgcggcgatgggaagccatgaccctggtttctcccagatactattacctctgtaatttgtgcctttatgttttctatgttgttacttttgttttttttttttttttcctaccttcaccagggccacgaggtaaaagttcttgtctgacatgctcattctttctttttgcgtgtatccagtgatgtgggaggctctggggaggtgatggatgcacaagacagataaggcctctgctctcacagagcttaccttccgacgaggacagacaaaccaacacacaagatcattgcagatagtgctaagtgctgtgtaggaaatggaacagtctgactccatggaagcgtactttagattggaaggccgggtctccactatatcgctagcaccggactcacagtagatgctcagttggtatttatgaatgaatgaatggccagaggctctccagtttatatgtcctattgggaagtagtgtagggtaacttacccaaagttacccagttggcaaatggtacatttgaacccagacttcagagttcacgctcttaaccgttttgctgtctgatcgctgggaaatactccagaacggtggctgtcactttgccttccaagttaacaatgtgaaataactctgaatttacagagaaccaaaggctttccaattaaaatgaaaaaaccgaaaaaccccaccaaacctaccgtggattgtaattccaggatagtacttgagctttcatgatgttctcatggccttctggggatgccagattgggaaagaagtccaggtagctaaagtgaaaatagtgagccttagtttccacttgagttgtctgaagttctttctctatctgggaggcctggcttggcttctcctgataattggtgggttcattcggttagtccacaaacatttactgagtacctgatctgtgtgtcagatacccagagaagccaagttatatcagctgtactctcctattttccctcaacctcctcccagtactttagggaagggggcagatgagaataacagccaggacaggacaatgatgtagggtagtccagagtgctccaggagcattgaggaggtcaactcctgaaagaggtgtcatttgagctcagttataaaggtcgagtagaagaaggctcaaagaaggaaagggtggggaacatttcagacagaggaaattgcatgcacagaggcacaaacactgagatgactgggctcctttgggatgccactagtagtttttttttttttgagatagagttctcactctgtcacccaggctggagtgcagaggcgccatctcactgcagcctctgcctcccaggttcaagtgattctcctgcctcagcctcttgagtagctgggattacatacaggcatgtgccactacgcctggctaaattttgtatttttagtagagacggtgtttcactatgttggccaggctggtctcaaactccggacctcaagtgatccgccctccttggcctctcaaagtgctgggattacaggcgtgagcccggccaccactagtggttctgaatgacagcaacaaagaacatttgttgtggttgcctggcaagatgggagacaaggctggtgagtagacaagagtcagatctcagtccctttatgcatagatgcagccagtgtccaagttaaaattgtgttgcttctccttgagcagtccttccttgcattaactttctgaaaacccccaaatcccagtacaaactctgttgtctaatatgttatggaaagaggcactcatttgagaaaatttaagattttgttcaattgttttactgaaagatgtgtgaccttaggccacttcactcctcaaagcctggggtggttattcggtcaatggggatgatgctcgtgtccacgttgcctcttgtagaacgtgtttagaaggaatgacatggctgttagtggctttgtaagtgcatagtactatacagagattagacaaccacttaactacttaagtggtttcatcacttctgtacctgaaaggtgtggcagagaatagcgatcattctggccctggattggccaaagtaattatgccaaagtcactggatatttttgctagggaagtggtccaagagaagtggtaccaaattgttgaaggcctctggctcataactttagaagagacatctgtgtgtgttcttaaatgacgtcatgaggtgtgttgtttgtttgttttaaactgaatgctaagacagtacaattaatagagactgaataccctgacttagagataattcatttcaggatgagaaatggcacatttaactggtttcttccaggttactcagggtgacgactctgatttctggtcgttcacctagatgaacctctgagctaactttacttgagaaggtaataactaaaatgcccattcaaaggaaaaattatcttttaaatgcagcctaagttgatcgtatgggattgtatattgtcagactctttaatcttgggaattttgtgtggtatgttaaatttaaggatgttacagaagaaaaagaatgcaaatttatatgactttatgcagttttataggaagtactatgctgcatcataaatatcaaaaggagaaagcctggtggcttcctgaaagaagcatgacacaggaggatttgcctagacttaaggttgactttcatgagatatttttagtaagtgaacattaagctctttcagactaggggtatctttctgagagagtaaatgtttttgttttttggcagggtcttgctctgtcacccaggctggagggcagtggtgccatcatagctcactgtagcctcaaactcctgggctcaagagatcctcctgctttaggttccctggtagctaggactacagatgccaccattcctggctaatttttaaatttttttgtaaagatagagtcttgccatgttgcccaggctggtcttgaattcctggcctcaagcagtcctcccgcctcagccttccaaagtgctgggattacaggcatgagccactgcatgcagcctaagtgtgtgttttcttttatatttctttttgtctttttcactaagtcataggagttttttaaaattgtcactctttctgttgatctcagttcttccaagtcctaatcgtttccttgccatctcctcactctgagatcccacttgttgtccagctcaaagagagctttccgaatgagtcactttcaaggcattatatagcactcttctttcattcccttctccctccccttccatgagagtccatctgtggtaaatagtatgtcatatattttttggtcgttcaggactctagatcattccttacatcctagcccattcccccagcaatgatactgtcacatggaaatggtctgttgaacatccatcctcactaggttaaggtttgttttgttttgttttgttttgttttgttttttttgagatggagtttggctcttgttgctcaggctggagtgcaatggcgcgatcttggctcaccgcaacctccgcctcccgggttcaagcacttctcctgcctcagcctcccgagtagctgggattacaggcatgcgccaccatgcccggctaattttgtactttcaatagagacagggtttctccctgttggtcaggctggtctcgaactcccgacctcaggtgatccacccacctcggcctcccaaagtgctgggatgataggtgtgcgccactgcacccagccggttaaggtttaaacataactgtggatgcatttacttttgctttattgcttgactgaaccaatgaccttcaagaagtcttagatagtcctgccattagtagggatctcagatgggagggcaccaatgaatcagtgtagttgagtaccacttttgggagaaaatagaaacttggacactctaaatgatagtttaaggacgttgtttgttttgttttgttttttgtatgggaaaagttggcttagactctttagttcagcccttcaagttgatgtgtaatttaagattgtttaggaagttaaaaaatctaaagccctgtggatatagttcattcagtgcagtaattatctttcagatgccaagtacagcattaattctttagctttagcatggcactgattttcttaacacttcatgatcacgtggagcagactgtgctttacagcacaacagagcgtcagccatgtgctgaagattcttcgtggtagtggtttagatccaccctgaatagattatcttcatttatttaattattaagtagcttgcttatcaaaagcggcattaaacttactaaacttgagtcaaacgtaaatcttcatagatagtaccatttacttctgaaatcttgttcctgggagaaaaatgtggactggaagttaactttcttttatccacctattcactcctttttcttcacagttaactccttaggggaaaaaatgtatagttcttgaccatgtgcttatgtttgtaaagcaatgatgtttccttaacgtgagtggttgtgacatagatcactgttatcttcataattacctgggagcttttcatccaagtgtggatttactaaaataattagtctgaattgatgcttattaaagagctgaactcttaaacgttaacactatcttgtatttattaaaattgtatgcatgtttccttcaaatgctgaaggcagaatactgagaactttgaccctgtgttattatcgctaagtagttgaaaattaggggaggagtcaagggagtatattatattggttatcactcaaatactacccctaggcatgatttttagaaccgaaacttgaatttttacataaagaattatctccaaaagtgtcttttttttttttttttttgagatggagtcttgctctgttgccaggctggagtgcaatggcactatctcggctcactgcaacctccgcctcctgggttcaaacgattctcctgcctcagcctcccgagtagctgggactacaggcacatgccaccatgcctagctaatttttgtatttttaatagagacggggtttcaccatgttggccagatggtctcgatctcttgacctcgtgatccgcccacctcggcctcccaaagtgctgggattacagacatgagcctctgcgccaggccaagagtgtcttatatatccccacttttttgaaaaatttgctgtctaaaggatgatcatgatttgggacgaatgagcacagctttcaactagatgacaagaaagatgaatacaaagagtgctgagttccattagtcaagacaaggttgccatagaatgtctttaataaaataaaacaaaagccttttgcgttattttgcaccgaggattgtgttaaaaacaaagttgcattatggtttccagattggcatccttgtttttttctatcattttaggcccctttcaggctgttatcagcatagcatatccaggattgctttggccttgctcagtgggtatgtgcgttctttgaagttcttacctgacagatgtgggcagctggctttacacaaggaagagttgtttaaagagctttggtatggaaacaaagttactaaacttgacagtcacttgaggattatttaaaaaacaaacaaaataactgaatgtggtaaaatactatctctagaatatttttcaaactgttaaatgcatccttttaacagaagctgttgatgtctacaaacactgtctttgtagacaaagacaaaccccccttgcatgggggtttgggggttgggaagcagttgagaaaatggcatagtcccgtgagaaaaccttggaatactttcttttaataacatttttttattgcatagaactgtaaagctacagaaatgctttcttggagttttccttcatcctttcagaagggctaatattgacctttggttagcatgttagtattttcacctgtgtcaagtgatgtcttcacgcttttggggggtgtgtgtgtgcatgcccacctcgtgttgtgtagggcacattggccgatacctataatgtgtttcaattactacattgttggcatttcagtaggctccttcagcctttgcccatctgggaagtggagactagggcaataaatgttttaggggtagattgagactgcagtgtttttcatcttttagcttgtactttaagacaatgggatgtacccctagaccatttacctagatttaaattacttccttgtgatgtggtttagagctctaagttccttgagttgtcttgaaaggctgaagggtgctcagagaatggaggggaattgaaaatggaacctaaggatctgggagtggtcatatgtgtgagtggtgaaatgtgccccccaacaccccgttgggtcgggtctggagttaaaagcagtggctgacatacattttgcaatataagggtaaagaaaggtaaagaaggaacaaacatttctagaggataaatgctttaattccagaagataggccacacagtttaggaactgtggtaagaggtgctttgccatatttatgttactgtttaatctgtgtaacaatcgtatgagatgacttagtcagtggctaggtaactttctgctggatgaggctgcactagtaaatggtggcacaggcaaagccttgtactttccctcataccagtatcagctcattagagttaactcataaaggggtttgttcttgagagagggaggcagagaatttaaaaccattaatgaagtattaatagctgtcaggacaatttcttaagaacatcaattcattaagagttattctctgaattttttaggagggatttcttgccctacttttgaaaaagttcagacagatgactccaaagaatgtttgatttctcttgtgaatattcacttttatatcagattctgatggtttcttgattctatatatttagaaagcattcggccgggcatggtggctcatgcctgtaatcccagcacgttgggaggctgaggcaggcagatcaactgaggtcaggagttcgagaccagcctgaccaacatggagaaaccccatctctactaaaaatacaaaattagccgggcatggtagcgcatgcctgtaatcccagctacttgggaggctgaggcaggagaatcgcttgaacctggaagacggaggttgcggtgagccgagatcccgccatcgcactccagcctgggcaacaagagcaaaactctgtctcaaaaaaaaaaaaaaacaaaacacattaacttgtgggtaatttgtccttctgctatccagtctttggaaggcagggcaaagcttgtgtgtggtagagatttcataggcttgcaggtttgtagagtgggaattcaagaagttgtaaagggcacttattaagataggaatgtctaaaataaatgatctttagcagtgccaccttaaactttgtaagtgttgctacaaaacctttagttctgcatgctcctgaccagccattgccttggacagagaaacaaataagggtgagttaataaactagagacttgtctcaattgttcaaagaggtaaacttaaggtgattaaaaagtgctgttttattctgtatgagatacactttgggaagtcgtcattttccaagacgatgatacgccaggcatacgaattggatcagaaaggatttagagacatgcatggatataatgatctcttacagatgttcctcaccttacagcggagttacatcctcagaaacccattgtcagttgaaaatattataagttgaaaacatattagatacagcttaacctacccaacatcatagccttgtctaccttaaacatactcagaacccttaagttagcctccagttgcacaaagtcatctagcacaaagcctattgtatgataaagtattgaatatctcatgtactgcatattactagcctgggaagagatcaaaattcaaaatatgtcaaaattatgatggcttcacaccattgtaaaattgaaaaatcgcaagtcaaaccaatcggggattgtctgtacataagagatgattgtccaaattagagctgttttgggtttctgccctttgcagatcctttgaggttttctttatagacagatgactccttctgggggaattgagcgtgactctgattgagatttggttcagttaccacatactgaaagcttcctgtgggccaggcactaggttgcactggggacctgggaggaaggcctagcccttaaagtttccagcctctaggtattgggagacgagggaaaatggggacaagatatttatggcctgtccttattgagagcttagaaaaagctgtgttaattctgctttgggtgttcgatctcacagggaagatggcatttgagatatgtgacttggcgagcttacactgtgcgcttgccatttttctaagcgttcatttatttaattcttaatgcaagcctaggaagtgggtacagttatgatcctgaagttattaacccaagttatgaacctgactgagggttggagctgggatttgaatcaagatctgtctgattgcaaaggctatggctttttttttttttgtcgtcatgctggctgtgtttcttcccttaaaagataagtgggagtgtgcccttggctttcttatttattatgttaggaagatgagaggaggagtgagactagagaaagaggcttgaaagagaaatgggatagaaaaataaaggaaaaggctgggcacagtggctcacacctgtaatcccagcactttgggagtctgaggtgggtggatcacctgaggtcaggagttcgagaccagcgtgaccaacatagtgaaaccccatctctactaaaaatacaaaagttagccgggcgtggtggtgcatgcctgtaatccaggtactggggaggctgaggcaggagaaccgcttcagctggggaggtggaggttgcagtgagccgagatcgtgccattgtactccagcctgggcaacaagagcaaaactccgtctcaaaaaaaaaaaagagagaaaaagaaagaaaaagtgccttattataattgtagtcttgtaattgtctcgttggcacctcttacataaagtgcagttgctctgggacattagaatgactgtgactgacttttaatctttgccagccatggtggctcacgcctgtaattccagctttgggaggctggggtgggtggatcgcttgagctcaggagtttgacaccagcctggtcaacatggtgaaacccctctttactaaaaatacaaaagttaaccaggcttggtggtgtatgcctgtaatcccagctaatccggaggctgaggggcaggaatcgcttgaacccaggagggcagaggttgcagctagctgagattgtgcctctgcactccagcctgggctgagagtgagaccgtctcaaaaaaaaaaaaaaaaaaatccttctatgaattctgtgtttccccctaagaacttctgtcctaacttgatcacttcttattgtgagctatttgtttattagtgttgaaaattctgtgctaatactatcaactgtaccttcccttccaccaccccactctctgctccaagtctttcatgtcctcaatacctgtcgtgcaaactatgcatttctgggttaactgggtactattttagtcttttagttccatcactcagcatttacaatatagtagaaaaatggaagaaatggaaaggtacgtactcgagaaatcagtgttatggccatctccattttagagatgagaggcctttgcagaaggcctttgcgaagactttacagaatgtgaatttgtacccgggtcttacagcctcccaagcctgtgtgctttgcattacaaagcgaatctgtggttcctagcattgctgtcacctagaggcacttgggctaacctccttagctttggtttcctcctctgcgatgtaaggaggcttgaactcagtacctctaggtggtccttccagctctaagcttgagaacttaagtttattttagctgaagaagagagatagaaagccccttgaggacaggaaccagcttgtatttcccacagcacctactggtactttgttcctatgggctcctgaatatttaattaatgaaacctcttgttactgtttgaaagctcactacttgtattaacctttcctgagtattcttggactctgatccagttttttctatatcacctcttattgtacgaattgtatgtcactttcacgttttgttttattctttatgtgcttcatttacttatttattgcttggctttcactgctagaatgtaagctcctataggtttttgttttagtatttctgagtagactacatagactacattctcttcttcttcttgttttcttttccgagtaccccaaagaaggatacaaccctggatttggtcatcttttcagtgtttgctatgatcatttgaaacagaagcatacacaagaataaaaagagaaatttgctgaaaaaccagaggtttgtccttgtggaggcttatttgaattctcaatctgttggttgaattgatttgttggcatgtaaatatatcctgatggactcctctgaaaatctaaatttgtgcttctgacctttgtaaagtcaggcagtgctttactaattggatgaaggagagccatggcttactcttgagagaatgtgcagatgcacacaatcaaaacttttcatgtaatttgcgggcaggaggatcccatcttagtgcatagttcacctctaacctcgctcagagaaaaggtggaagaagcatgagcagtcatctagagaaatccagagaccacttggtcggctcatttgtatctttttatttattattatttttaaaatgaatgcttttgttgcctttctcttccaaagcaagattgtttctttttctttctttacatacctagcactcactgagaatagtgcttggccattagtcattttcattaaacatttgagtattgtcccttccacctttaaagaagaaaaactgtgttgtcagtcctttttaccctgtctagctactcctttcactttccttcttatcatggtaagcttctggaaaacatagtttcctgtcttttttctttctgttcttcacttctagtcactgcccgggagctcaatcattgcttcatcactacatctcccattgcatgttcagtcttcactaccatttgacccctgttgtcatcctgctcattgacactcttctcttgacctctctcattgctctctctgcttttcttccgcccatgtggccagttttgcccactcatcatgcagtccggttggtaatgctcagggttacaggttcaccttctccccctcttctcctttccctgtttctctcagatttgctctctctgtgtcttcccttctcccctttgcggaactcttttaccagtacccttcgcttctaacgtcacttatgtatgaacccaggcctgacccaagcccatataaaaggctgcaatacgttaaatgcagcatgacccaagctgaactctataccaccttttcattttttcctccaaacctccccttcttactgtctcattggatggtacctacattcatgcatttgaccaactcagagagtctatgactcagttctgtcccttcttccccattccctctatggctgccccattttctcccgcaactgtaatagcctcttaactggtcttcttgtccgagtcttctctttctttccaccctgatgtggttttcaaagatggtttgcaaagatgcaaatctgagcatatctcttgcttgcttacaatcattaaatgtcttcctgttgccaaaaataaagtttaaattctttaacaaaacctggaaaattatcgatacttgttgcactccccccacattgccctgcccatctttccagcatcgtctttcctcatgcttgtgtttcagccttttagttctccttggccatggggctttggcatactatgtatcatgacttaccctgtatgtagtcataaagtaacagtttttagctgtttccaccactaaaaattagttgattccttttcctcttgtttgtttcactgcgtccccctgcttacctttgaggctcagcacaggcttcacttcttcaaggtaactgtcctgacattcttcactcacattgtatctgttcctctggctcccacacatgtcacagcatgttgtcattggcaacgtgatacgtgactccctttcgctgttagtcagcaagcccccccaccttttttttttttttttttttagattgtgtctcttctccccacatcccagtgcctagcacagcacagtgcatggtgcatggcagtttctcagggagttcatggtctctgggtctaaggcataggcgaggaagggttggtgtttaggagaaagctgagaaagatgccaggcgcaatggctcacacctgtaatccaaggattttgggactccgaggcaagcgaatcagttgaggccaggaatttgagatgagcctgggcaatatggcgaaaccccatctctactaaaaatacagaaattaacctggtgtggtggtgcatgcccataatcccagctactcgggaggctgaggcatgagaatcacttgaactcaggaggtggaagctgcagtgagtcaaaattatgccactgcactccactctgggtgacagagcaagactgtatctcaaaaacaaaaacaaagctgagaaaggagagaggggggaagaaagaagactttcagtggtgaagagtaatgaagcctgtcggcagggcccgttatgtacagccgatcgatgtagacacagtgcattttgctcagaaaatatttgaagattttccactaaatgctggttgcttttctctcttgtggaaacttatgtttttacttctcctcctcttctatttcagagagtcaggactacctcttaggtgtgtgttcttttaccccattcctttcccatcacttaacagtattttgcatcgttagcctattactgctgtctcacttttctcttgtacttgattccttccttgtgcctacaaacatgcttaagttgccccttcctaaaaagaaatcttgttttctagatcttccccgcttaagcaaatgcccagtcttctatcacagctaattttggggaagcggtgaatctcagtttctggtatctttactcttctttcatcagacctcaccccttcactcaaacccttcttagttcccccaggtttctctctgtgatacttgtctttgacttttctgatgaactgtccacctctttatcatctcttttactggatgttgaggtttctcaggttctggcttcagtcttctcaatttaacaattctctgtatgttgtctcattaataatgccttcatcttccacttctgcacagaaaacttccaaatctctatctccaagcaaatcttttgatctgtcagcctgctggacatccctgtctatctggttgtcatgagaacacctcaaactcagcatgttccacactgtatttaccgtttaccttctcatccccactgactgtggcttctggatcttgggaatggcccttgcaccaagttggcaagctggaaatcctaaacttgtctttcactccccattttccgtaacctttcacatctactcagtccatttaaatcagcagcatctcctatgcccttttgcttcttagtattctatcgtatcctaagtataggtcctttcccttccagactattgtagtagcaccgtgtctcaactttctgtctctattttttctgcctgcttctctcaccctttggactatactttatacagtttccagagatatttttctaaaaattgaaatttgatatcatttcttggtttaaaaacattcattggctctctagatcttacggataggttcgtggcccaaattcttaggccagcagcaaaactcttcagagtcaggccacaccgcatctttccagcctcagcttctttcacccctctcgtaccccttcctcttcagccatttgatgcccccagaagccccttatagctttatcacactgtactttcacccaagttccctacagctcaaagtgtactttgcgttatctgcttttcagactccagggcttgcctcagtgatcagttccctgtgctcctcaccctccccttttgataggatgctttatagattacctttcatacagtgttcgatgcagttagaggtagtatactgcccaggagttaagagtgtgaaccctagatttgccatctgaaagtcatgtgtccttcagtgatgcatttaacctctctgtgcctcaaatttctccctctggggtatgttaggagtatacaaattaacacatgtaaagtgcttagaatagattggtactgttaaatatgagctaacgtcacatttgatatttttttaaaaagaaaaaatcattatggagtctcagtcctagagattctgattcattaattctggatgggccccaagattgttctgtgtattctgggtgggagctgcagtgccctgtttctctctctagcttgagagcctagcacagcacctgaaccattctcttcatgggttacttattgagtacctgtagtgtgccaagcattgctgagaggccgagatgagaaaacttttaccttgtggagctcatcttctagtggagaaggtgtacattaaataaaaacagaaaatatatatgatgtggtgtcaggcagtaggtgataaatgggaaaaaaacaactaaaaacaatgcaagataaagggatttgggaatggattcaattttaagtagggtaattagggaaggtcatttaagtagggtgattagggaaggtcatttacctgaggaggtgatatttgaactgagacctatataaaatgagtgtatgaactgtggagacatttgggaagagcattacagacagatggaagggcaggtgcaaggtgatgatgagcttggtgtgttcaaggagcagcaaggtatgcctgtgctagagtggtggaggggcctgcggggagatgagctcaaagaagagggcaggagccttgccggtaggcaggccacaggagggactttggattttgttgtgagatgggaagccacagaggaatctgagcaggagtttatttttatttttatttttatttttggagacagagtcttgctctgtcgcccaggctggagtgtagtggcgcgatctcggttcactgcaacctctgtctcccgggttcaagcaattctcttgcctcagcctcctgagtagctgggattatgcccagctaatttttttatttttagtagacagggtttcaccatgttgcccaggctggtcttgaactcctaaactcctgagctcaggcctcccaaaatgctaggattacaggtgtgagccatcacgcctggccaggagcctttttttttttttttttttttttttttgagacggagactggctctgttgcccaggctggagtgcagtggtgcgatctcactcggctcactgtaacctccccctcccagttcaagcaattctcctgcctcagcttcccaagtagctgggactacaggcatgtgccaccacgcctaagtaatttttgtatctttagtggagacagggtttctagattaaatgtagaggaatatagaggaatgtagattaaatgtagaggaagagagactgcttttggcctaagcagttgggtgagtggtggtttctttactgagatgagaagcattgagtttgagggaggagagtgggactcaagagtgccgtttggacatgagaaacttgagatgctcagtacacttgcaacgagagatgttaaataggtagttgagtctggagctcaggggagagggccaggctgcagatataaatttggcagtcagcttattgttgtgacatagaacagtaaggagtaatttcttctgattaaagagatttggtaaacctttccaaaagagaagacgtttgagcaaaactttgaagaatgagcataatttccaaaggcagagtaagggaaaaatagaaaatatttttcatccaagtctcacagcctttcccctggcctcttcttgagtttaagaagctgctgacctggttgataatctcttatcactggtatagccacttaggttctttattgaaaaggaaccagaacagattacacactaactgataaaccacgttctactgtttctcatcgttcacagattgaaaattccagttggatcatcaaggtgcagaatgctaaacttgttcttctcccctgttctgtatctggtgtgaattggatgtgttgattttcgtatggaggctttttcacatgctgtcatctccactaaagatggaacactttggagaagttttacttctgttgttaatgactttttgcacttgaactgttaaaacaactacaaccatgagaaattgggaccccatgctattttatcactcatacccctaacttgagcatattatctgtcttgactcatcctgctttgtgtaaaatgtgaatcatgttttgtcactcttctatttagatagaattttatttgcagtagaatattgcttatctttttgtttatttttgtgattactgtaatcagaaattttggtctttcaagtagagaataattactagatgttcgttagtcaatgggataaagaatgcattgaaaaaattcagtttattaaatcgtctaagatccttttagaactgatgtaaaattcatctgtgaataatcttctactgcacgataatattagtgctggatatagatagaatgtatgaagcctcagctcttatatactccttttagccatttttctattacgaaaaaaaatctagtgtattaaaggaaagtagtgacagtatttatctttagatggtttctagtatttgaagttcatacagaagcttttgtcagaattgtacacatgggtctttgtcttgagttaatgagaccactgcaactttaaacatgttttgagtgataaccttgatttttataaattatacaagcatgactatcaaggctggtttatcagttttcaacaactttacaagtctgaacaagtagaaaattatttcaaaagaaccttgtttggatctcacataaactacaggtagctttctgtatatgaaaaaatttttaagtacagaaaaatacagataatataaataccccagtatggagtaactaaatgttaataatttgttagaagactcgttttaaatctttctttaataaaacaagtaaaacttcactaataatttatggcatgtctgtactccatatctgctgattcatacgccctccttttttttttgttttttttttaactccccggaggaatttaatgtgaactatttccgtttttttctagatcacttaatgtagtgtcatggtgtatggatgacttaacatgtttttgagacctatcaactgttgaaatacagatctagttcattcttttaaagagttgtatagtattccttcatgagattttagaatttttattgtaagtaagagaattctttatatattttcaattctggccattcatctgttatataaactgcaaatatcttagttttccaggctgttccttactaactttgtattttttttcaggtagctttcctgagtttgatcttaggaattcttaaaatacagtagcatgtcttccagtttagttttcccacccatggaggtggtggcaggctgagttttgtttctttctgctctgaaagacctaggaaactagtgaattgagtaagcaccctgcaagtctggtatagtctatttcaatcaagttggcttctggtgtgcctttgatggcatcatcagtgagagttcttggtgttgatttctcttgctgcaataacaggtgtgatgtttctcagtagctggctggctcccgaggataccaggagaatactttattaatttaaaacactgcattctaagagttcttcaggaaagttatgtgtctatgggtagggttgtttttatgtggttatttcaaaataagagctatacaatcaggctttctgctggaatattggaatataatgtctgccatttaaacacattggttgcaaagctttaaagctttatttttgtttctaaagcattgatttaatgtgtgagctaacaattcgatcaagaaaatagatttttaagaaaacttctccagtgtccttattcttgagttcatggttatttaacagctcactctcttcgaatatctgttagtatggtatctttcattttttagggagggggcaactttaaaaaaaaacaccatagaataattatgatgaaagcattattgacacagtgagcatttttaataccttcaacctgtatataagcagcacaaatttagagtgatttcagatccgggttttgaagtaggtgtctgtttacaggaaatgcagcagaatcagagtacaatgacctctgaggaagtctcgtattcatgcagcatacatttttactatgtttgtggcactgttctagtttggaggatctggtgatgaataggacagacaccccccccccccaccccgccccccactccatgtggaaacaggaaaggaacaaacaaaatatgtcctatgcagaagatgaaaagggtgtaatgctggaacaggagcagcagtagtctcagtatttattcacccagagcctggatgtgcttacagagggtgcatagaggaagaatacagccattgtgtgaagtagatggaagcatggcatggctatttgttcattcagcaaatatattattgagcatctgttctatgcctgcaagtgctctaggtgctgatgatcagtaatgaacaagagggacaaaaaagtctgtgttgatggagtttccattctagaaggggaagatttacataaacaagaaaagaaataatgtggggattggtgcactgcagatgggtatggaacgcagaaagcaataggatactttttaatgtaaatagactgtcaaagggtaaaatttaaaaatattaataagatatccaacagattttgctttagaatgtccgtgtccctccattttagtgtatttttcccacatagagagtctactgtattgaaacctcaagcacacttttattgtcttaacaaaatccatcaaaagtcataggcttctggagacagattattaccttcccagaaggtaatctttttagagttgaagtgaaatatggtaatttgttttttggagaggctgtgaaaaggagagatactgtacctaatttgtgtttgcaagagtataaaataatatagctttttttatgcagagtggaaaaaactgttgtgaagctaataactttaaacttgtatctggaaagctgagacctgatagattatatatcaaattggtatacaacttatttggtaacatatataggttgagtttcaaagtattgtagctacatcagaagataaataacaaaggaaggatatgtatttgtgaaaccagaatttcatgaactctagaaaaggaagaggagcaatcactttgcacaacaaagaatctttattcatatacacacacacacacacacacacacacacacaatacagatagatattttcaaaatctcaataatatttaatattagaaatgttaagggggatactaccgaaagtgaattaatataaaagaccaaatgctttttccccttcctttttttaaaaaaaatatagtttagaacagttttaggttcacacaaaaactgagcagaaagtatgcacagagttctcttgtaactcctaccccacacatgcatcataaccccctccactgccaacatcctacactgagaggtacattggttaccattggtgaacctacattgacatgtcattgttagccagagtccgtagtctgcgttagtattcatttctagtgttgtacattctgtgagtttttacaaatgtataatgacatgtatccaccattataatatcagagtagtttcagttttactgtcctaaaactgctctatgctccttgtgttctttcctcccttaaattctatcaacaccgtatttatttatttatttatttattttgataacagagtcttgctccatcacacaggctggagtgcagtggagcgatcttcgctcactgtaaccttcgcctcctgggttcaaactgttctcctgcctcagccccccgagttgctgggattacaggtgtgtgcccccacacctagccaatttttgtagttttattagagatgtggtttcaccatactggccaggctggtctcgaactcctgatgtcaagtgatccgcccccccgccccactcagcctcccaaagtgctggattataggcgtgagccaccatgcctggccaacaccttatctttttattgtctctgtagttttgccttttccagaatgtcatagagtaaaatcatacagtatgctaccttttcatactgactgctttcactcaggaatatgcatttaaggctcctccgtgtcttttcatggctttatagctcatttctttttagcactgagcactatttcagtgtctggatataccacagtttattttatccactcacaaaatgcttctgcattttggcagttatgaataaagctgctataaacatccatgtgcaggtgtttgtgtggatataagttttcaacttacttgggtaaataccaaggagggtgattgctggattgtatggtaagaatatgtttagttttgtaagaaactgctaaatggtctttcaaagtgtctgtgcaccgtttttcattcccaccagcagtgaatgagagttcctgttgttccacatcctcaccaacacttggtattggtagtattttagaatttggccattctaaaactcaacaataagaaaatgaacaaatgtgtaatagtatctcattggacatcttttctatttttgtttttctgagatggagtcttactctgtcgcccaggctgaagtgcagtggcacagtcttggctcactgcaacctctgcctcccgggttcaagtgatcctcctgcctcagcctccccagtagctgggactacaggcatgggccaccacacctggctactttttgtattttcagtagagacagggtttcaccatgttggccaagctggtctcgaattcctgacctcagctgatccacccgccttggcctcctgattacaggcgtgagccaccgcacccggccagacatcttttcgtatgtttatttgctttctgtacgtttttggtgaggtggctgttcagatcttttgcccattttaaaattaggttgttcattttattttattttatttttattattttttgagacggagtctctttcgctctgtcacccagactggagtgcagtggcacgatctcagcacattggaagctccgcctccctggttcaggccattcccctgcctcagcctccagagtagctgggactacaggtgcccaccaccacgcccggctaatttttttgtatttttagtagagacggggtttcaccgtgttagccaggatggtctcgatctcctgacgttgtgatccacccgccacagcctcccaaagtgctgggattacaggcatgagccactgtgcccagccttcattttcatattattgagttttaagagttctttgtatagtttggttgacagtattttattcaggtatgtttttagcaaatattttctcctggcttgtggcttgtcttctgcagaacagatgtttttatttttaatgaagtctagctaatcagttatttttttcatggattttgttttggtgttgtaagtagtcatctccaaatccaaggccatctagattttattctgtcatcctgtaggagttttatagtttggggtctaaatatactttagcctttatttttctggtagaattgctaagttaaaagtaaaattatggctgggcgtggaggctcacacctctaatcccagcactttgggatgccaaggtgggtggatcatttgaggtcaggagtttgagaccaccctagccaatgtagtaaaaccctgtctctattaaaaatacaaaaattagccaggtgtggcatatgcctgtggtcctagctacttgggaggttggggcatgagaatcgcttgaacctgggaggtggaggttgcagtgagccaagatcgtgccactgcactccagcctgggtgacagagtgagactctgtctcaaaaaaaaaaaaaaggtaaaattatatatttactccttaaaaacttctatcttgccatttagtagataggatgttatgctatgcttgaggtaatacagataggtaaggcctagattgagttttcagttcactggaaattttcattattactttttataatttgatgggacatgaacttttaaattattcttttgtaaagatagtatttacatttcctgaagggaagcgttttaatttttcttccatggctcttgaatgaataattacagaaaagcatttaaatcatatgtagatcaggagactgtttaaagatttaatggaatacttttcccataaaatgctcttaggtttcctgacaagtttattcagccatttttttatgacattttcaacacctggaacctgacctcttcatgttgtgctggattgtgacggtctttgaccttcaaaccagaactttatacatcttaaggcccaatttttgtaattaagagtaaaaagcaactatttcttctttcacttttaatggtatgcaagtttttgctggtattgtatttgccttctttttttttttttttttaatttattttttattgataattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtacttgagattagggactggtgatgactcttaacgagcatgctgccttcaagcatctgtttaacaaagcacatcttgcaccgcccttaatccatttaaccctgagtggacacagcacatgtttcagagagcacagggttgggggtaaggtcaccgatcaacaggatcccaaggcagaagttttcttagtacagaacaaaatgaaaagtctcccatgtctacttctttctacacagacatggcaaccatccgatttctcaatcttttccccacctttcccgcctttctattccacaaagccgccattgtcatcctggcccgttctcaatgagctgttgggcacacctcccagacggggtggtggccaggcagaggggctcctcacttcccagtaggggcggccgggcagaggcgcccgtcacctcccgggtggggccgctggccgggcggggggctgacctccccacctccctcccggacggggcagctggccgggcggggggctgaccccgccacctccctcccagatagggcggctggcctggcagaggggctcctcacttcccagtaggggcggccgggcagaggcgcccctcacctcccggatggggcggctggccgggtggggggctgacctccccacctccctcccggacggggcagctggccgggcggggggctgaccccgccacctccctcccagatagggcggctggcctggcagaggggctcctcacttcccagtaggggcggccaggcagaggcgcccctcacctcccggacggggcggctggccgggcgggaggctgacgccccgacctccctcccggacggggcggctggccgggcggggggctgaccccccacctccctccctgacggggcggctggccgggcggggggctgaccccccaacctccctcctggacggggcggctggcggggcgtggggctgacccccccacctccctcccggatggggctgctggcctggcggggggctgaccccccccacctccctcccggacggggcggccgccgggcggagacgccccccacctcccagacggggtggccgccgggcggagaggctccccacccctcagacggggcagccgccgggcggagggtctccccactcctcagacggggcggttgccgggcagagggtctcctcacctctcagacggggcggtggggcagagatgctcctcacctcccagacggggtcgtggccgggcagaggcgctcctcacatcccagacggggcggcggggcagaggcgctccccacatctcagacgatgggcggccgggcagagacgctcctcacttcctagatgtgatggcggccggaaagaggcgctcctcacctcctagatgggatggcggccggtcggagacgctcctcacctcccagactgggcagccaggcagaggggctccccacatcccagacgatgggtggccaggcagagacgctccccacttcccagacggggtggcggccgggcagaggctgcaatctcagcactctgggaggccaaggcaggcggctgggaggtggaggttgtagcgagccgagatcacgccactgcactccagcctgggcaccaccgagcactgagtgaacgagactccgcctgcaatcccggcacgtcgggaggccgaggccggcggatcacttgcggttaggggctggagaccggcctggccaacacagcgaaaccccgtctccaccaaaaccagtcaggcgtggcggcgcgagcctgcagtcgcaggcactctgtatttgccttgtaaaacagatcaattctagcccctcttactgtcttactcttacctcttattgccttaaacacaatttaaaatgacaaaaatccaagcacagtgggtcctgggggaaggtagaggaaataaattatactgtgtttagctttatctaaataccttttacagcatgtcaaggaattcattttcagttcattagtgctgtttcataagcatcttcagcaaactcacacaaatgttcacagatgagtatatgcataatctaggacataaagggcattgtttacattattaaaaagagtaacagtttcaaagagtattgccagtttctcccaaattcatgttttttcacttttttaacctcccatttcacattttagatgcttagttcctggttttgttacagacattatctgaaataaggaatagaagattaaaaatgatttgaagtgtatgctgtggttctagagacacatcatttttttttatctctaaaaaggaaaaattctaagtttagaaggagatttcatttgtaaaattgactgtactttataagcagtgtttaaattcattggtggtaaatatgcatgttggtatagtaaaatcccattttttacataatgctttaatggaaatggcagttttatgaaatgaaagtgactagtaaaagtctgaatgatgctcataagcttttacatcatttttattgaaggttttgtgtatgctaatccattaatacaggggaaaaggagaacactaacatggtttattttctataattactcaaatagaatataatttattttcaataaaattcttggagcaaattgcccagagtagggagaggaaggttggcctgttcttacaaatatcttgatttttacccacgggactttgttattttaccagtgatgttgtttcattgcatatattttcagtatagttccctccagatttttacaaataaaagcctgtgaaaggccaagaaatcccaagcatgtaaagacccaggattgtggagggagaaatctgggatgtttattttatcctgtttattattacaaatattgcttgtcttttaatagtttagacttccttttatgtggtttatataagttgaagcaccattaagattgctgtgtaatagcaattaactgtgatgtaatagattaacctggggaaattttcaaaaacagttaagtgtttacatttaaatttggcttatttttgtagagtaccttgaagaagaggtcagtgtaaggaataaacaaatacttaaatttgggatcctcacaccacaacttcataagggggagagggtgaactgaggtatcccgtaggtggttgaggtgtgtgtgcttgtgagttttctgtatttctttgcagttgggttcagcgaggagcagttttctgtgttcaccagtgttgatagcagacaaaatcacacagaaacaaatacgaaaattgttttatgtccagaatgtccctctaatatgcacatgagtaacgttggatcaaatttatgttttcaaaataagtctcatagcagaactagctgtcgtttgattttgggattgagtcccatttccttccttccttatcaccattttgatttcttaatttgtattaaggtaagcccatatcagattgattttttttttttccatgcccggagcacctcaagagtagagacaccagcctgaggatcttaattttgctggagataatccacacacaggtagttttcttcttggtgaatatgtagattgagatctttattctatgccagccacagtgctggggctacagagatggataaggtataatccttgtctcaggagcttagagtctcattgaaaagtttttcaaaacacacatttgaatgattttgttgagtcaacattacgtatttgtttgtgaacacataagcgcacaccctttccccaccttcacttcctgtttccttgcaaatgcaaagacaagagtaaaggacttgcctagaggaaacacagaaatactgatttacaggtgaaaaatatgtaaatttgaaaaggtgttgaaaaggacctaagtttttgtagccacctgactaataaacacagagatcacatgtccaccatagatgggtaaatgaaaaaaagcaagtttcaggttaataggaatagtattatttcattatttgttagcccctatcccttgcacatgtgtgtatgtattgtttgtgtaaacatagatgatgtggaaagatctcccatattgttaatattagttatctcaggggacaaaggaaagcttattcctgtttatacatcttttattgtttggtttaagaagcatgttttacttttttaattaaaaaatctaataaagtaggaagtgaataaataatagtaataaaaagtatcttcaggccactgagcctgttgcagtcttcccagtagcgtgagtaattagtaccgtctgtaatgcttcaggtgtggactgcccagcaggactctgaacttcttgctacagcctaaggtgatactaagttttctgtagcaacactataatgttgagagttactgtgtttatagaccattaacacctcaaagtctttcttccatctgctcctcttggcacactgctctagataatcattttggaatgagtttagtcctttacgctctccctgttagatttcatattgttactgtggaaatcagtatttagcatgggtaagaactggccttagatgcaagccatctggttacagatcctcactaccactatcatgaaaacttggacaagtaacttgtctccccaagcctcagttttctcatctgcaaaacagcaataatcataaagttgtgaggtttcaatgagatgccatatgttagaacacttacactaggtacctggtgaaatagtgggaacatggtaaatattagacgttactgctagtgcattaacctcagctcatctctttcatccattggcatgttaatgagataatcgtggatctcaaatcttcccttaactatatttacagctctcttttccacaaaccttctaaactttcctcatgagacccccaatcagtctctgtctcattctacaggtcccttcaccgatgttgtcaccaccaacctaaagcttggcaacccgacagaccgaaatgtgtgttttaaggtgaagactacagcaccacgtaggtactgtgtgaggcccaacagcggaatcatcgatgcaggggcctcaattaatgtatctggtaagtcctgagactggaggcctagagggtgggctcagaaggcccctggacagtaggttttcttaaagtttgtatttgcagtgtagcagaagaagatgatagaattctctccaccccacccccaccccaccccaccccaccccacaaccctccaccccgtgatcagaaagctgggtcccagtcgcctgtttttttcataattaatgcctccttgtttcaaagcttacagcccctttgcacctcaatagttagagcaaaactgaagtgataactttagactttacttcagaatgagttttgttttcactcccttgaaattaaatctgccctttggcaataaataaaaaagggctaaacaaacttaattttactttgtgggagaaagctaaatggagttattttcttatttaagctaaatgatttctgacattaagctcataccatttccagtgattggccactgcactttactgattgtgaaacgccaagagagatgagggctgagcaaattggaatatactcaagggtgtcagtttggtgcatgtctgatggttttctcttctgtctgggagtgcatgtattttccaaaatccaccttttgaaaaatactggtaaagtgcccaaattgagaattggatttcagaattaaggagatgtcagtgatgggttggagtttaaatgtattttagaaatggaataaacttttagctcattagaacttctccatccaagaaggagctgtgggggagtgtgtatttatcttgtaaatatcaagtgactcagtgtcacagaggcttctgcatcaatagaagctactgctcatttgaaatgagtatctctctggctttttccatgatagattttgattgtgatacacttggctattcatttgacacctaaaagaaaatgattcacctctttggaaagatataaggtgtttcattatctgatcgtttctgcaaactcttattccctgcatctcgtctctctcattatggtgcacccatgccagctctccccctgtgcttctcttgagtctgcaagacctgatcttcgaatcaagttattatcttgaagtcaggagggtcgaagccagcattgattgaggggcttctatgtgctggacctgcacatgtactatctcatgtcatttctcttacctgccctgtaagggatgcattgtcacctccattttactaagaagtagactggtggtcatagcatcgtgaaactagcaaataacagagccaagatgtggatcattctgactggctctgaagcccatgctctttgaactgcagcactctggagaaaggaaggaactgggattttggcatttctgtatcctctggatatgtatggtttaaatttttctgttgacatcaagggcagctgaaatcttttgttcccctcttctatctactttccccccctcgatttccatgcctgtatcaaatttgagcaagtttgtcagtagatgaaaattaccaatttttataggaagaatagggaatgcagcatggttttctgaataaaagaatctcagtaggtggttgtacaatgttagtgtgttttctgatataaaatataaatatgtatgggtgggtgtatgtgtatgtctctatctctctcttttttttttgagacagtctcactttgtcgcccaggctggagtgcagtggcgcgatctctgctcactgcaacctccacctcccagattcaagcaattctcttgcctcagcctcccgagtagctaggattacaggtgcgtgccaccacacctggtaatttttgtatttttagtagagacagggtttcaccatgttggctaggctggtctcaaactcctgacctcaagtgatccgcctgcctcggcctcccaaagtgctgggattacaggcatgagccaccgcgccaggcatctccgtctctctttcaggaagatccattgtttccccatcataggaatttttaaaaagtaaaagcgaactctgcctttgttctgatttatgattgcttactcaaggaagaccaagactttgtggttgtggccttcctttggcagataaagtaaggcacagagtgtggcacagtcatcaagggtcacttggatggtcatggcagcactgctatttgaagctagtggcttggctcctgatccagtgctctttctgtcatactaaactgcctcagtagtgttagaggatgaccccacttatgaatgaatgtaaaaagtaccatcattctcaaagtttaatgtatttgggggaaaaagtagttgaataataaaatgtccatgtgtctgtagactttcttcctagatgagacaagatcatatctgcaccttagaaagagctcctttgttattatttggtatttagctcagtgcttggggggaaccaaggtgaaaccagatgtcattgcatttctaggacagccttgcaagtcagcaaaggaggccagccccatttgctgcagttgtatgtgctgagggaccactgcatcatttattagacatgcatagcttgggataaaaagcactgcctttttccaggagtcctcttggtattaatacagctacatgatgacatcttggtgagtcactagagtcctcaggaggaggaggataccagtcgacaggcagtgcagattatccaaaagccagcctccccttctccccagatatgcacatggccaagcttggttttacccactctcttcaaagattagtggatttgaggtcgggaaacctgaacaggaagaccagttgtgctgtttaaccagtcagctgaattttgaccaacctattaacctttctaggttcttgttttctcacttgtaaggtagggagaatagtgtctaccttacagaatatatacaaatactgcagaatcaacagcatggtacaagagtggtacatttgtacgttcgttgttcttccactagctttgacaaaaaccggctagtttttgaagaaggtggattgcataatacttgaattgactgtttagaaataaattacccctatattttatttatttatggacctttgctaattttgagaagaaatttgtgttttctcttccttgtgtaatattcatttgttttatagtgaaaagttgccagtacattttcaggtataatctttaaaaaggtggccaccacatcagcttaaaatactgctagcattgccctgcccaccacccaaagtgtcactacatacctgagaaggacatgaccagtgcatttttcccatttctgaaaacccttggaatgcactagctattcgggaaggctgtaaatcattattttaaagagaggagggagggagggggaaggaaagaaagagaggagggaagcaggaaggtgggaagagagggagggttgatggtaatgatgtctgcccatggagctggcacctgtgctggccagagggatcaaggttttgaaggcacacaggttcagattgtgacatggaaagccagatgtctttcagagaaaccctgtgaagctctttttaccttttcacattaccctgatattcaagggaccttacattgtgcttcaaaagttcaggctctgacctatcatgctattttcttcagaacacggcagatcacttattgggtccttaaaaaaactcccttttataaacttaggtggtaaagtaacagttggacacaggcataacctaaactttttgtgtcagtggattataatatgtgggctttcccaaagagttgctttaggccctggccccttggacctgtgatttgaatccttttctttgtcctttacatgggtgctcgtctcatctcatttttattgtagccccttctgaggtttgtgctttttggatgaggtcacatggtagatagggggtgcagggggctttctgtttgcattcactggcccagaatactgtggttttggcccgttgctccatgatacatactatcaactagagatggttttgaattatttaatctggacctcagcaaaataggtacacttaaatagagattgaagaaagggaggttggaattttttcctcctgagatttcaaatgtaaggaataaagaactttttgaattaacgaattgttttgaggcagtggggatcttcccatttgttctagctttacaaaattaaatctattttctgaactgtacggtgggaaaatatttttaaggtacataatttctgaaaatgtctttgtggtaagctgttagtggttgtggatttttttttttttttagtgcttcagttaataatgagggagttttccattaatattccaaaccatgtttgccagcggatacagcaggtgaagtggtaaaattatgggcccatcaaaaatacttatgcttcctgtaatatgatattaagtttaatatttttataaccttcactgaattctaatttcactaaagtagcaagcatgcgtccatttgcagttcagttatgcacattggttgcctgtgtcccaagcaaattagaaatgcaaaatatctgtgtgtggaggggggcattggaaagagtcattaaagataccgatatttagttacagatacactttactaagtgtaccttgggaattgaaaatggattaaagacaaacacaaaactcccagtgtctgaatctgtattttaaattagaattcaaaggattaaggagcagtattcattcctgacatacagcccttttcagcactcttttcaatcacatttaaagcataaagtttttccagtaaaatcctcaggacagccaggtgcagtggcttatgcctgtaatcccagcactttgggaggccgaggcaggcggatcacctgaggttgggaattcgagaccatcctgaccaacatggagaaaccccgtctctactaaacatacaaaattagccgggcatgctggcacatgcctgtaatcccagctactcatgaaggctgaggcaggagaatcacttgagcctgggaggcggaggttgcagtgagccaagatcgcgccattgcactccagcctgggcaacaagagagaaactccatctcacaaaaaaaaaaaaaaaaaaaaaaaaaaaaaaaaaaagaaaagaaaaatcctcagagcatgaacatcagcagctcttcttggatgaaaacattgatcagttaatttaaatggatagtattgtgattaataatccttttaagatttccctgactcagtttaatgtagctgtttggtggccctggagcagtcaaccaggagtgcacctttcaggtgcactagggtataaacgcacagagcccttagacaaagaagccaaacatttatccatcaagcactgatagtgggagctgcatttggggagtttgagcttcttaacagcaacattcttctttgtttgattgtttgctttggaagtctctgataagcgaaacttttttataagtggtttccatgaaccaggcttattactctcagataagaacaactcacattcatactttaaaagatgtctttaatctttttcagcagatgagagattctgcttaaacaaaaagtagaaaaaagaaaattaccaacaaaaattcagcttaattacgcttttaagggtttttacaagtttactgtaatacttaggtttttaaggaagaattgttactttttttgtgactatgacacagtttattctttacatttttaaatatcaagatcaagaggacttacacattttgtctacctcagttagctgaaggtaacttcaactctgtacagcataactgagaagcaaaaaataagcaaagttttaagaagccaaaagtgattttcttttcactcattatgggtccttgcatacttacacacttgagggctctccagtcttgaatcttgtcttgtttattcttaccttagacttactgttaaccctgtcctggttgccagctcatcacagatgagaataaagggaaaggggtacagaggtggccacgttgaaagcggcccatgtgacagtgcatagcagacagtggacgggctgggcaagaacaccaccgagagcaagtgcagggagcattcagaaataacagtggggagctggaattccttaagcctcggggaattgttctccatgttttaggtgatcagccccaagagacacagcttgcaggtttcattaagatggtatataatgggggttcatgtcacaacataagagtaatcagaaaaggggtatgttgtattccattataaatgttagaggagattgaaaagtatgttggatttttgaaaaagatttacattttaaaagatatttataaaaaagagtgaataagccttgttatttggccagtgcctgtatatagcagtcctcatcttccattgatactggagaaaggagacctcactgtcagcacatttgtactagtctcagcacaaacaaattaatcagactgtgaggagtttgttttctaagacagaatacacgaactggaaaatcctgtagagaacacaaagacacttcagtgttaactgatttataaataaatgcaattcattatttatttgctagactcagagttccatccatgggcccctgaataggcagaggtccaccaaggtggtcatgatctcaacgtgttctggaccctaaaggatataataaatttgctcacagtctaactaaaatgtccagcttctttgctttaggctagaattatatcaccttgtttaggtaatgctggttatctccagcttatcaggagctctgcttggcatttatgtatctgtgtctttgattagtctcaaaaaagtggatcagtgacttcattccgaccctgtaagcaccatatggtagaggacagtctttctctatgcaggctttgtgagaggacggggagtgcgagactgagggcactgccatgagaaactggaagccctgtcttgccctcttggaagggagggagtgactctgggaagtgggacagaagaaaagccagctggtgggggtaaagaagggtttcctctttgggcttctccaaggatatttctagggagagcatgattcaggaacgctttgaatgttggaagagaagaaggtgcaaacctgttagctaacgcaaaaaatgcaaattagcacccagaatgtgagctattaaaacattaagttctggtctcagtctcattggggagaaaaagcaaacatgtcagaaggagcttaggagtcttggagttgacagtctcccaataaagtaaggtgcccacagtaggaactgtggtatgaaatggtgtttcagcaggaactgcagtgttaggaggtatagtacagcacagattttccaggtgtgtaccctgggccagcagcagcagcagctcacttggggacctgttagaaattggagtgctcattctcactgcagccctgctaacacaaaaattccggaggtggggtccagcagtctgtgttgtagcaaacattcgtggtgactctgatactcactgaagtttgagaacttttccctccagaattcttatttaaattttattatatttatatatttatttatttttgacaaagtctctctctgtcacccaggctggagtgcagtggtgccattttagctcactgcaacctccacctcctgggttcaaatgattcttgtgcctcagcttccccagtagctgggattacaggtgtgtgccaccatgcccagctaaattttttgtatttttagttagggatgggatttcacaatgttggccaggctggcctcaaactcctggcctcaagtgatctgcctacctcggcctcccaaagtgctgggattacaggtgtgagccactgcacctggccttgtttgtttagttatttatggagttggggtcttgctgtgctgtctagcctggagtgcatgccgctctcatagctcactgtagcctcaaatttctgggctcaagcagtcttcttgcctcagcctcccaagtagctgggactacagacatgcaccaccatgcctggctattccttacagagttctgttagtggattcagtcctggaagatggggtatattgacatgtgagtagggtaagggagaatcaagagaaacgtgtcaggcagggccgacatgataagggagactttgatgatgataggagagcatcactgggtgtaaggacataggggcatgatgtgtggcctgagtgatgcgcacacctgttggagcagaagggaggcctgccaataagagaccaagaaatccaagaagggccagattgtgaaaagctgaactgattgccttttacttaggaaatagttactcttataggaggtttttgatctgaggaattaccatgatacaagtagggtattaaggtacgattaaatttgtggagtttgtaggggctaggcagggtgatttggatgggaaagaaactagaagaaacttggaaaaatctagaaggatctgtgggcctcagctgagattgtgggcacgtaaaatgtggagagagagatttcgaagataagattgtgagattaaaaaaaagtgaagcatgtgctgtagtacttgttagactttatttgctctgttaccgttataatgcagacgaaagtgatctgtgatctgttaccattatgatgcaggcgaaagtgatctgtgatcttttaccattatgatgcaggcgaaagtgacctgtgatctgttaccattatgatgcagacgaaagtgatccgtgatctgttaccgttatgatgcaggcgaaagtgatctgtgatctgttaccattatgatgcaggtccatgatctgttaccattatgatgcagacgaaagtgatctgtgatctgttaccattatgatgcaggcgaaagtgatccgtgatctgttacaattatgatgcaggcgaaagtgatccgtgatctgttaccattatgatgcaggcgaaagtgatctgtgatctgtgatctgttaccattatgatgcaggcgaaagtgatccgtgatctgttaccattatgatgcaggtgaaggtggtccgtgatctgttaccattatgatgcaggtccatgatctgttaccattatgatgcagacgaaagtgattcgtgatctgttaccattatgatgcaggtgaaagtgatccgtgatctgttaccattatgatgcaggcaaaagtgatttgtgatctcgtagcattatgatgcaggcaaaagtgatctgtgatctgttaccattatgtatgcaggcaaaagtgatctgtgatctgttaccattatgatgcagtatgaaagtgatctgtgatctgttaccattatgatgcaggcgaaagtgatctgtgatctgttaccattatgatgctggtgaaagtgatctgtgatctgttaccattatgatgcaggcgaaagtgatctgtgatctgttaccattatgatgcaggggaaagtgatctgtgatctgttaccattatgatgcaggcgaaagtgatctgtgatctgttaccattatgatgcaggcgaaagtgatctgtgatctgttaccattatgatgcaggcgaaagtgatctgtgatttgcttgggttctcagaagcagcatttaactgcatttaatcaagtcatcattactccaaggggtgtgtgtgtatgttttaagtagcgtatcttctgtgtttcttctctgttcaggcaactctgatcttaatgatccaatgttttatgaccccaaaggccctttcttaacaggatcccagtttgcaatctgtaatacaacaggcattgtatcacaaagcattaatgtagatgagtagtgacctggcttccaggctgtcttctggtaacaggcttctgtttagtgtagtatcagcagatacattttaaaagtaggatagatggttcatttaagagggctttatcatcagtattcacttgaataccagagatactggtgaataccatttggtgtagcgtaacagtgcttaaactttttggtctcaggacccctttaaattcttaaaaatgaagatgcagctgggcacagtggcaggcacctatagtcctagctactcaggaggctaaggcgggaggatcacttgagcccaggagttggaggccagtctggacaacatagcaagaccccatctcttgaaaaaaagtgaaagtgaaataaatttaagttaatggcaaactcttttatagtctgccatggtaaaaagtacataatttctgtcacaatttgcacatatggagctgaaagaactaatgattagcaacattctgtcatgtttttataaagttcccactaacaggatagagcaaattgaatttgacatgagatgatagtagctgagaaatacaaactctttgatgtgagttaggggccatgttatgcaggatgtggatactgagatactccagaagtttatgaagtttcacagaatctgggtgtcccaagtcctcactgtggctggctgatgtaggagcccacaagccaaggagagctggtgatgaaaaacacccccatttgctgttccaggctggtagaaatctagaagtgagtctttggggcctgagctgagattgtaggcgtgtaaatgcgaagagatttcaaagatgagattctgagatttaaaaaatgaagcatatgccatggtgcttgttagacttttttttttttttccaaagcagaaaacttttctcagatcaaaaacctcccataactacccaccttatacccagaacttcctgaaagttgacatgccggtagggcacagtttttattcccaattgaaaagtttccattcaccaatgcatgtaggcatctgtgtatatatctcctcagtcctccgcttttgcagaagggctgttggacctgctacctcaggctgtcgccggtgctctgttaaagtgattgcttacacccactgccttgtgtgcttgcatgcctgtttatgtcttctcctctgcccatgaaatggtccttccatgtctacactgtggtgacttggtaggtaggatgttctaggcctggagctgtgctggtgacatctgtaaggtctgcagtaagggggcagtatatctcagacagtgcccttttgtggaggtagagcaagcagttgcaaaggcctttgattagaggagcatagggaacgcccattccttccgtaagggatgtgtgtgcatgcatatgtgcctctattttcacctgagggccaggtacgtcccgaaaactcaagacctggtttgtgtaaatctcctttctctttttaaactgcagattctcccaagaggggtactacacagagccaccagtgtgttattacttggccgcattgacttatttaactatatttttacctcctggagggcctgtgagaccatttggtgtagcataacagtgctcaaactttttggtctcaggacccctttacattcttaaaaatgaagacgcagctgggcacagtgacaggcacctatagtcctagctactcaggaggcaaggcaggaggatcacttgagcccaggagttgtaggccagcctggacaacatagcaagacctcatctcttaaaaaaaaaaaaagtaagacccaaaaagcttttggtttgtggggtatatcaatatttattatattaaaaattaaactgaaaattcatataattatttaagaataacataattacatgttaacagagtaacatttttaatgaaaagtaacttttcaaaaaaattaggagactgatacttgacattttttcattttttgccaatttttctttttttttttgaggtggagtctctgtcgctcaggctgtaatgcagtggcacaatcttgccactgcactccagcatgagggacagagtgagactccatcctcccaggttcaagtgattctcatgcctcagcctcccgaatagctgggattacaggtgcccaccaccgtgcctggctaatttttgtattttcagtagagacaggttttgcctcttggccaggctggtcacagactcctggcctcaggtgatccacccaccttggcctcccaaagttctgggattacagccatgagctgctgtgcctggcctgcaaatttcatttttctttttttttttgttttgagacagagtctcactcttgtcgcccaggctggagtgcagtggcgccgtcttggctcactgcaatctccacctcgcaggtttaagcgattctcctgcctcagcctcctgagtagctgggattacaggcatgcaccaccacacccagataatttttgtatttttagtaaagaaagggtttcaccatgttggcgaggctggtctggaactcttgacctcaggtgatccacccgcctcggcctcccaaagtgctgggattacaggcgtgagccactgcgccctgctgcacatttctttagtgtctgtttcaatagaagacaggctggatgctcatatctgcttctgcatttagtctgttaggatgtgttcttttggtgaatgcatatgaagaaaaactgctgtcaccacagatatgtagttggaaaaggggagagtatgtttaattgctttttcagataaatctgaacattcttcgatactacaccaaaacttgacaagtgttactttcttcaaggttattagtatgatgtggaatctgaagccatgtctgtgactttttgaacattgtttcactaaaacacatcagtctctgttgtactttgaatggattttgtgatatcatgcatggattgtttggaaaccatttgctgagtgttgcagagcttccaaatgttggcatattgcattgtacactcacaaaaaaatcacattcatttcttttcctgatgatctcattggaaaagtctgtaagtatttgcagaaccatgaagctctggttggcagatgaaagtattccacaattataatttttacctaaaagcctgtattttatcattgacagtaactactgtaaattgtttttctctagagtcaaagccaggtttgagccctggcactcttgtttaatacgctggccatgggacccaggtgagcccacttagcgcctttctgagcccttatcttgtttgtttttttttttgttttttctttttttttaagagactgggtcttgctctgtcacccaggctggagttcagtggtgctatcatagctctctgcagcctccatctcccaggcctaagcagtccttccacctcaatctcagcctctcaagtagctgggactataggctaccatgcccagctaatttttttgtggtagagatggggtcttgctttgtcgcccaggttggtcttgaactcaagtgatcctcccgccttggcctcccaaagtgctggtgttacagttgtgagccaccatgcctggcagcccttatctttttatcttgaaaaaggagacgtgctgcttggatggattgttgtgagtagtaaatgggagcactaaggagaatttgccttctatggtacctattacacaggaggcatgagtaaagattcttttcctttctttccttcttgggccatcatgaaagtattggggatgaagaagctgagggatgatggagaaatggaaaggaaggacctgttttcccttggggcattcttagaacccaggcagagctctggacacagtgctcttggctgtacttttttactcccactgcctctaggaaggtgatgaatgggaaggggcaggcagagcttcctggggctgttttttgggggtgtgttctgttctctggacccattggtttttgtatttcatctaaatagcttctctaaaaattagcattttccttggattgctgtcatgtgagcatcagggatctttacaaataaaccttgttcctcctcagagctctccagagtggtagacttgggagtggtgcaatagctgttcacagctgggagaacagagtctcaagggtaagacggtgtttactactagatctgtgccctgccaaaaatctaagagtagttcaggtcaaagttctcttctttcctaaactgaaaaataccagagcatgattttgtcacagccaaggaagacctgaaattcttaaaactgaattcactttaattttagaaagggaacattaatctaacagtgaatcccagctccaaagaaggttgacagtccctgtccaggaaggttcacagagcatgtaaagacattggctctttactttaaaatgtgtgttttcgttattgcaatcttaggggcaggaaaaaaacacattgggaatttggctttcagaaaaagcattgacctgccagtctggtcatttgtccctgaggttaagtgtcaagcccaggtcggtaaatgttccaggtctgtctgtaggaaaggtcagctcttgccagctcagtgatgccagagaaagagttatgttgataaaaggtttactctctgacagttattgaattttgtcctgaagaagtctcccagcaaggcttccttgtagctcagggccttcaggtgggtcttgtgggcagtgaagctgtctgggtgactagggacaccagtgcatttaagtccaatgcatggttaggtctcagtggactttctctgttcccatggtgaagagtgctactgcatccctaagatggatgggggaggttggtatttctatcctgttttgtgaatggttccattagctttgtcgtggggcctgggtgccagatataaatctagctcatattggagtgactagtgtggtgaaaggggtgctagactgcacttgtagtcaagtcttggctctttgtcccagtgttgccacttcttaacattgtgactttgagggagccacttcactttgtggaatcccagattcttcatttgtagaccacggctatcctgctttctatctgctgctggctgtggttgattgtgtggctctagaggaagcacctgggaagtcctaagttggggtttcaaggcaagagaatgctgatgagggcccagcagaaaggtggtagaagccctgctggtgagaagcataagacttgtactgtcagaggacaaggcaccagtcctttgtggtggctgtgaacttaggtccccacaccaactgcctgggtttgagtctgcactccaccaaggtgtaaccttgggcaaattcacctctctgtgttcattcttttcatgtgaaaagtagacaccagaatagcccctctcccccaacaatagtacctactttttaaggattaaatgagatgatggtaaacctaagggacagagcccagtttctggcacatggagatactcagtccatgcccactgttgtggtcaaggccacagtaggctttccctgcatgtgaagttgtctcagggaacttaactagatgtgtgggttagccaaagccttgtagcaaagtaacatattttaaagcagccatcatttgataggagtaggcccagctgtactctaggaagtaggctgaagggagccacttggggtaggaaggcacctccctccatgcagtgggtgtgactcatccacaggatcctctgtgtgagatttctctaggttcttagggaaaaaaaagggggagtataagctgataccgttttccctgctgtgtgagtgtcctgattgtaaaaattttctagctttatgttggcaaaattgtatttcaaggattaccttgattagctatatgagaaatgggttggagagaagctacaacagttccttaaatgttcttaaacatcttagattattctatttaattcctgaagagatcatttggatatgttttcttgagcaaaacaggcagatggtgttgctacccagtttcccaattctgtaaggcctgtagcagacatttacggtaggcttgcagtagtgaaagatccatggactaggaatcagaagactgggtcctcggccttattcccagctctgtcatgcgtgattttgtggctcttaggttggtgacctgcaaaatggagatgttggtcatccttgcttacttcaccaggggcgtccatcctaagacataagagaatgccggtaaattgctttacaaccaaagtacaagtattagcataataaatggcactgacaaccaagctctgaccctcctaatgaaatattttctttctcagtgatgttacagcctttcgattatgatcccaatgagaaaagtaaacacaagtttatggttcagtctatgtttgctccaactgacacttcagatatggaagcagtagtaagtactgaatgcttcttatttttttcagtaacaataatttaaaaaaccaattagatatggaattgtgggtgcatgcatttcaaaatatgtcaaaattatttaaaagggaatagttttttttcaaggaggtttgtactttatctacctttatggtttttctaaaactttgaggaataattttaacattttttgtgactttctagaaggctgttcttttctgactttcctgagctcagtgtgcttcagcagctccttgcactggtggatggtgtcttgcatggttagggattgccttctttcgcctctcctttctgccccgacagaaaaggatacttttcattgtcccgcctttttcttacttgtcttctcatcccccacaaactcaagagccatgtgagagtgtcagtgctgaatgtcctcacccatttagacatacatgtttgtggctttgttctagtaaatatgcttatttattttcccccctgcttaaatctatgtttaacttttctctaattttgataaaattaagatgacttcatttttataaaagaaataagtgatgttagtgatggttttggaaaaaaaaaaaagagtataatggacattccctccaaaacgagctttttatacatttgaataagtccattggcattctggggctgggagttgaattgaaatctacaatacaacccacagccccagcagggacagatgcgcttgtccttacagttcaggaaagcaggacagggttgcctcataccacttgcattgctctccagttttggcccgcccaaaggggagccccgagtcatccacggcaggtctgcccacctgagtccgctgttcatcacaccatactgcagttctcctctgtctgagtttcataccaagggcaactcaggccaagaccaccccatgccctatgtcaccacatagccttttgtttaagttctggagaagcatctccgctgatgtttcacttgtaggcagaaaatgaaggaggaggccagatatttttgacttttagagagatcagtgataataggctgtcttcttttcataagaacaattcttatgaaaactttctctgattttctgcaacatgatgtgttacttcatgttaatttgtgtgatcaaagaaacatggcagatagaaaataatggaagatccaagggtgtgttctgtttggcttctgctgcatggcatagtgaaaagagcatgggcttgggtgttttcgagctgagttcttccttttactgacgttgtggctgggagcaggttttattaactctgttgaggttttgatcatttgtaaaatagggataaaaatgcagctcacacagtggtgagtatgaagtgtgcctgtgtaagtgcctggtgggtccagtgtctgacacttgcttatcagagtgtgtaataggccagtcactgcatatctagtaaagggtcattttagttccttgtatgatgatataagtttaaattttttttatataaaatgtacattgtgggaaattttggaaatacacaaatgaaaaaaatttaaagtgacccatagttcttttctactaggcctaaccatcattaatgagaaatgagagctttgtgtttttcttcctttttttttttttttttttttttggagacatgattttactgtgtcacctaggctggaatgcagtggagtgatctcagctcgctgcagcctccacctcctgggctcaagtgatcctcccacctcagcctcccaagtagctgggaccacaggagcgcaccaccatgcctggctaatttttttgtagagacaggttttctccatgttgcccaagctggtctcaaactcctggactcaagcgatctgcccacctcagcctcccaaagtggtaggattacaggcatgagccactgccccagcctgctttttctttattttaaaatgtttttctttttattgtgatatacagaaagttgaaaaaatagcatggtgaccactcatataacttttacctagatttacatttgttaacatgttgtgacatttgcttcctttctgtcacaaactttcttatttgcttgagatgcaaatttatgacacttcacccctaaatgcttcagagcaaggacagtctcttatatagtcatgatactattaatcatagctgaaaaaagtaacttcaattcagtattattatgtgataaattcatattcattatttcctagttgttccaaaagtgacctttagtagaggacacccaaacctttttgtttttcaaactttgaactttttttttttttttttttttttttgagacaaagtcttgctttgtcaccaaggctgaagtgcagtggtgcagtcatggcttgacctccacctcagctgttcgagtaactaaaactacaggcatgccaccatgccggctatttttttatttttttatagagttggggtctcactatgttgcccaggctggtcttgaacttctgggctcaagtgatcctcctgcctctgcctctcgaagtgctgggattacaggtgtgagccactgcaccctgcccaaactttgaacttctttttttttttaagagtccaggccagttgacttacagaatgtcctgtattctggatttatttgattatttcctcatgattaaattcaagttaaatgtgttttggcaagaatattccatagttggtatttcataccaggttgttccgctgttggtgatgctgtttgatcacttggttaagatggtgactgccagctctctccactgtcatagcacaaagcacatttgcccctgtggttaataggtaatctgtgatactctgagtcatctgatactttgagaccatgtgaatatcctgctcgccagcagtctttcacctggtgcttttagcattcagtgatgatccttgcttgatattttttttgacttatgtggtaggcacacgtgtacaggtgtgtgtgtgcagaggagcagacttcagtattctttgcgattttttcacttaacattctggacattttctccatctaactgagtgctcttcagcatcatttgagtggcagcatgctgttccgtttagtggatctgccataatttttgtggcagtcccctagggtcagatgtatagattgcttcccacttttggttcttggtacctgtgttacagtagctgcctcttgcatggttttgggaagggttgagggcatggagggtgggggtgccttctttttctatatcataaccttgctgctatcctggtctgtaatcctagaataccctggaattcccatcttctgctgccaaaaggagaagtaatcaggagcgtatcctcttaggacatgggatttagctaggaaggtgctctcactacagcctggagggatggagatgggtcttggggtagacacagcccacacactgccacagtgacagaggagggatttggtaatgaatgtgttccgttggtagttggcagagtggttctgaaactagtcccagatagtatgcgcttatactttctagatatgcctttaaaataagtttcattttctcattttaatttaatttattatttttgagacagagtctctcagtgtcccccagcctggagtacagtggcatgatcatggctcactgcagcctccacctcctgggcccaagtgatcctccctcctcagcctcctgagtagctgggaccacaggcatgtgcctccatgcttagctaattttttaatttttttgtagagatgacgtctccttacgttgtgcagactggtctcaaactgctgggctcaaccagtccctccacctcagcctcccaaagtgctgggattacaggcataagccaccatgcccagctgaaaacaagttttattttcataaggagagccaaggttacctggtcatccagacattgtttagaggattcctttttgttcagtggtgggcctgtcccacagagtagcaacatggggagcattggttgactttgaggagtcaggcagcaagacttcagggtttatgaagtgtaatattttgagaaagtgagtgtatttaatcttgtcatgttacaaatattgaaatctcagcagacttcagttctttatttgatatacatcagggctttctcattaagagtatttttctgaaattgtcagttataggaagaaagttattcttccagcaggtttataatatcttgattattaaatttaaattgttttagtggaaggaggcaaaaccggaagaccttatggattcaaaacttagatgtgtgtttgaattgccagcagagaatgataaaccagtaagtatatttatagttaacaataattgaatgttgtaagctgatacttatttgcataccatttcctgcaaaaccaagatttaagttggcaaattattttcctttatctgatgtctgaagaaaaaaaataagctgaagtcagcaaataagtgggcctttatgaaatcagcctttgaaaaactcacggaaagacaactgattgacagtgtttccccttgaaaagtgcagcccgatggccattgagatgtcataaatcctgaagagcttctgtggcctggcaaaggtataggttgctgttaaacagtgggtgagagtgaaagagggaacaatttgccctttatcatggtggttgatggacgtgtgggaagctttcaagttctcttgttttacaaagtgccctgtcagcctccctaccccttttaccctatctacctcttcaatcaaaggctgcttttagatgaggatttctcagcctcaacactgttgatatttggggcaaatccttggtggtggtggaggttgccctgtgtactgtagggtgttttattaatagcatccctggcttctgccctcttgatactggtagtacttcccagttgtgacaactaaaaatgtctccagatattgccacatgtgtcctggagggcaatatcaacccccattgagagtgatcccattccggtgttgcctgtggggagaaggaaggagccccatcctctaggctgtccactgtgagcgctttacctttcatgatcctcacttgtgaccagttgaagaaaggagactgtatctgaaatgctaatttggacttcccttcaacctagtcgaaaacattttaatttttataaaaacaccaaaactgtgaaagcatgcagcatgtgaaactatcctagccattaatagctggagttgggaaacagaagtaccctgaaatgttgtgttaacagtatctatgttggtctgcgcgagtgctgttgatttgtgtcaaaactacctgagattttatttctgctgaatcatttaccactatcattaccctgtttctttaagtggatagtggtcattttttccctcttcccagtgtacatcctgtcacaggaaggtcagtttggaagctgtgaaagcagtattctggcctcagctctgtgataggttgacttggtagcctggggccttgcttcacagggcctactcttctcatctggaaaatgatgggtagagctagattccaggccaatgatcgtcagttactctttccctgacaagctgcgtgcttccatgccctccctccactgactggctctcatcccctgtaaatctcaagaggggatcatagctgaatcttggcaggggaaataaggggagtatgtaacttcccaagattgaaacattgcagacactgagtttgtttcaccttcatcccagcttccaaatgctaagttggtaaagtaattcgccctctgtctaatgctctcccaagcctcctaaccccactaaggcaatcctagggatgttcacatctttgtggtgacagtaatttgtggctaataattcctgagcttgcacaattacagtatgctgatttttccgtggcaggaatttgatagtgcaatatacacagccctttttctctttctttgaagtattagtctcagccgaacttcattatttgcccttatccataatttctagggccctgttgctttagattattaagatatcagataaagtaatccatttttaaaataaatgtgacattttacagtgtggatgaaatgctaccacgtttggtgtttgctgagaactactttactttgcataaaaaagtccattattacatggtcggtgacacttaggctttcatttgtttttgaacagcatgatgtagaaataaataaaattatatccacaactgcatcaaagacagaaacaccaatagtgtctaagtctctgagttcttctttggatgacaccgaagttaagaaggttatggaagaatgtaagaggctgcaaggtgaagttcagaggctacgggaggagaacaagcagttcaaggtaatagtttattttctggtaatctacagaaaacaagggcgttttcactagcttcttgggtggggaagttgatgagccagtgaatatatagatttctttttgcttttggtatttggctatttttttctccccagggagaaatttccatggctttcatgagagtctcaaaagggtccttggatctgcctaaattaagaaccactgtcccttgatcagaaatttctcaactgttgaagctcttgtccccttaaaaaaaaaaacaaaaacaaaaaacttggccgggtgcggtggctcacgcctgtaatcccagcactttgggaggccaaggcgggccgatcacaaggtcaagcgttcaagaccagcctggccaacaaagtgaaaccccgtctctaataaaaaatacaaaaaattagttgggtgtggtggcaggtgcctgtaattccagccactcgggaggctgaggcaggagaatcgcttgaacccaggaggcggaggttgcagtgagctgagatcgtgccactgccctccagcctgggtgacagagctagacttcgtctcaaaaacaaaataaacaaaaccccaaacaactcaaactctccattattgtaaattgaaaataaatgttgagaccaaaatagtttttattttgaatatgcatttttaaaccacttgggtgagaatcttttttcagagagtgaatactgacctatactctgttttaatgcaagtatagttctgattttagaagactctaaataggtctgggcagttgtggctcatcaaactattgatgtggtgatgagcttggaggtggggtgcctcacagtgggtaggaggtggagattatggaaggaaaatctgagcttctagcttctggatgaggcagttggcattggcaatggaaggttgtattgtactgagtgatgaagtggggaggcagggggtgcttcttttggcttgtggtggtgtggaagttgctcccatccaatatgaaacagctctgaatctgtgctggtcacagcatctcttaggcctctgtttgctaaacacctctaaggccccttccagctttaaaagtatgagttttcttctcttttactctgacagtgaggtagatataggagaactgacagcatttgggaaatggcatcatcttcttcctttgcagtgattttgatttgcctcagtcagtaatttctttagtgtgtagtaaattgtgaagctgacactactttttggctaaaaatctaagctatgcctgaagcttctcgagtgtatttctcttctgaaacagagttctgtgctatttaaagtggtaaataggtagaaatagcttctatataacctaataaaataaatggtttagtttgccgggtttttttttaagccagtcggacaccaccagttgtttatcactgtgcagtgatacgggccatgccccatgagcagaatatccttaaaatatgatcagaccaatctcaacattagaagattctttatcctgccaaacactgccttcttgttttgtgttggtttattctgtcatctggccaacaaatttactgagggtctaatatgtgcccggcactgtggattcaaacacgaacagcccctgcccttgaggagctctctgttgttgggatagcagggagagacatagacagaagtgattacaagccagtgtgatcaatgtcccacagagatagcaacaaattgcagggagagtcagctccatgggactcatctgcctgtggtccccaggacctactaggtactcgggcggatgggagcgaatggaaggaaacgaagaaaagaaagtacagctggtgtgtggggtttaaggatgaggagatgaggtaattagcaagagatctatcagcaaagatgagtctgtgccagaatagaatggcttgatgcatgtccctcttcagggatgtgggcttggctttgagagcatggaaatggcatcatagatctacatagtaacttgcagattcttaggaaagtgcaaggcagttgtggcagtggaggtgaaggaagaaaaaatttttcatttcttacatttccatgtagtttggggacaaggggagggtggggaatatggtcaaatatctttatatgtatgaaaaagaatgttgcttcttcaatgagaaatctatgcattaagtagaaaatatttgagatgagtgtatgaaggccagtcacattttaatattccaaatatcatttgatccagcagtctggatgtaactcattaagtaccagctatctacagagctctgcatttgaaagcttccagatgtcccacttttaggtttttttttttttttttttttaatatggagtctcactctgtcaccccaggctaatttttgtaattttagtagagacgaggttttaccatgttgaccaaggggtagtcttgaactcctgagctcaggtgatccacccgcctcagcctcccaaagtacagggattacaagcatgagccaccgtgcccagttgactttgtagattcttttatttatatatttatgtcttgggaaatgcctgtgattttaaaaatcgatgatttgatcaaggaaggctattcattagaggcaggaaggacagagaggttggggttgaagagaagcatccggaagacatggccatagaggtgggtggggccgagggtgcaaagggcccagttgacccttttaagtgcttttttctgtaaatcacgggaaaccaaggagcaccctgtttagatgtctgttgtaactagcagcagcaagtggaatggatgaaagaaaagaggggactgttttctcagtggcttcaggctagccctttcccctctgtagcctgcagtttctccgtttgcaaaatgcggttggaccatatcatgtcatccaacactgggcataaacagcccatcccgttaagctgtacagttgactcccctttctggtgccttggcttgtctttgaaatgtgcgtttgctcccgtaggaagaagatggactgcggatgaggaagacagtgcagagcaacagccccatttcagcattagccccaactgggaaggaagaaggccttagcacccggctcttggctctggtggttttgttctttatcgttggtgtaattattgggaagattgccttgtagaggtagcatgcacaggatggtaaattggattggtggatccaccatatcatgggatttaaatttatcataaccatgtgtaaaaagaaattaatgtatgatgacatctcacaggtcttgcctttaaattacccctccctgcacacacatacacagatacacacacacaaatataatgtaacgatcttttagaaagttaaaaatgtatagtaactgattgagggggaaaagaatgatctttattaatgacaagggaaaccatgagtaatgccacaatggcatattgtaaatgtcattttaaacattggtaggccttggtacatgatgctggattacctctcttaaaatgacacccttcctcgcctgttggtgctggcccttggggagctggagcccagcatgctggggagtgcggtcagctccacacagtagtccccacgtggcccactcccggcccaggctgctttccgtgtcttcagttctgtccaagccatcagctccttgggactgatgaacagagtcagaagcccaaaggaattgcactgtggcagcatcagacgtactcgtcataagtgagaggcgtgtgttgactgattgacccagcgctttggaaataaatggcagtgctttgttcacttaaagggaccaagctaaatttgtattggttcatgtagtgaagtcaaactgttattcagagatgtttaatgcatatttaacttatttaatgtatttcatctcatgttttcttattgtcacaagagtacagttaatgctgcgtgctgctgaactctgttgggtgaactggtattgctgctggagggctgtgggctcctctgtctctggagagtctggtcatgtggaggtggggtttattgggatgctggagaagagctgccaggaagtgttttttctgggtcagtaaataacaactgtcatagggagggaaattctcagtagtgacagtcaactctaggttaccttttttaatgaagagtagtcagtcttctagattgttcttataccacctctcaaccattactcacacttccagcgcccaggtccaagtctgagcctgacctccccttggggacctagcctggagtcaggacaaatggatcgggctgcagagggttagaagcgagggcaccagcagttgtgggtggggagcaagggaagagagaaactcttcagcgaatccttctagtactagttgagagtttgactgtgaattaattttatgccataaaagaccaacccagttctgtttgactatgtagcatcttgaaaagaaaaattataataaagccccaaaattaagaattcttttgtcattttgtcacatttgctctatggggggaattattattttatcatttttattattttgccattggaaggttaactttaaaatgagccctatcactgagaaatacgtgtttcatgatttaactctgtgtgtgtgtgtgtgtgtgtgtgtgtgtgtgtgtattttttttttggttgtcttcagctgacagtatgaaaaatgaaactgctgaaaaagctgagcacctggtcacccttggccttccattgctttggccttcagtaaaaagcagcctcccttctaggtcagggaaccatgccattgagactagtaacgggcgttctgggcacagtcccactgtgcacaggtttgagaggacaagttcatcagaaggaaggcagtccttagaagtcacatacgttgagccacgttgctcctaagcctggctctgtcaagctgggtcaggggccttgaaactggagaagtggaagtctatggttggtctgagtaagtaacttcctgtcttcatgaaaaaagttgactttgaatcccaggtactcacagaaatggtgaacagacttagttgttacccaggcacccatggattgtgttgagtgtgcagacagggaggccaccccaataggaattcgtctccaggatttttcccatgtgtcccccagtacttataaaagggagtgaaaagaccgagctgtaaggcatgtgccttctgccacctgactttccgtgaggggactaaaatttactaattgtagttgctgcagccagttaagtcctgtagcttccaggccctcatgtctttgataggagagtgcttaggtggtccccaacagtgcctaggggtacagtacagtcccattacactagagcagggctctatttatttttaaaggatatggccgtgtgttttgataaaactttattcacaaaaacagccgggtcatgggatttggcttgtgagtctgtaacagttcttaaaaagaatatctgagaaactactctgttttagacctttgaaggtgatttagagttttgtgtacatctaggagaaggtgttcagcttctcagaggatgtggacattttggttgcagctaaaaatcagtctctgaagtctctctcccttctagaggttaggacttggtgaacatgtttgtgggccttttgactgagtggcagaaggaaactgctcaggaagagaaacaggtgactgatgggaaggttgattattttctcagtcatcctggcagccaaaaatgtgccaggaaaagaaagaatgtggagcacgcgtggctcctggaggacttggagatgcatgcacatttagggtgttttccctagaattacataatgaaaaaaagaataaggcaaagaggaggtgaatatggggcctgtcacaacggcctgccctgccccaagagggttaagagtcagataatcgggacgaaactggcatggaaagagcgagcctagggaggatgccgctgggcagtgtgcatgggggagctgctgccaggctgccctccagtctgctcctgtggttactggctccacagcacctcagagagggcggccctggcttcagaaatgccagccatagtgctcacaaatgcagaagagatggaagcggtgacagaatcctgaaagtttttattgattgaagttttaaattggtaacttaagcttccttggcacgatacaaaatacctcttaaagacagcaggcttttttatttgtaggtgtgaggaactggctttaacttttttctcctcctagtttgcatgttttccttctctcgtcttctgaactgctggcaccagcagtaatacatactgataaaatcaaaattgatttttaccagtggccagtttatggctagagagacgacttatacctccataacacagaagggggaaaaatgaagaacctccagtgatccgtgaaaacctaaacgctttcaaacaaatcccaggaacagaattgctatcgaaagatat

SEQ ID NO: 12420 - DNA, 112507 bp, Human
  misc_feature (1)...(112507): n = A,T,C or G
atctgtgattagcagtaataccagtatccctccctctccaaatctattcagttggtgagttcagctaagaggtctagagtgctgatagtaagaattaacatgccatctgaatcgcttttcttctggagttctggtctttgagcaagagctgaggtggtctgggacttgcatactgataagggaagaaagccagctcgaagataccttgaaccttctggtgagtctggggttagaagtgaagtagggagtgaaacagaggatggcaaatactgggggagaggctcagtgctccattagcccatgtgacagatggtttgagaagatttgccaggtcaatgtggggtcaattctaaaagtgtcctaagtctaggccaagaggaacaaaatgcagctgggtctctgacctcacacgccgaagcccaaggacacgttagggccaaaatgtgactctctaaggtcacctgtaaaactggacaatctggtaaagtcagtgaaggttaagatcatgaatccagccaggcgtggtggctcacgcctgtaattccagtactttgggaggccaaggaaggagaccaaagagaaaggatcacttgagcctaggagttcgagaccagcctgggcaacctagcaacctccgtctctacaaaaaatacaaaaattaaccaggtatggtggccggtgcctgcagtctcagctactcaggaggctgaggtgggagaactgcttgagcctgggaagcagaggttgcagggagtcatgatggtgccaccgtactctagcctgagcaacacagcgagtgagactctgtctcaaaatgaataaataaataaaagaaaaagaaaaatagtaaaactcaggacaggtgggcccacaaggaaagagttctgtggcttttactcccgttttttggttggtccaaaaaattcccagcagtccagggatctctgtggagttctcagtgagtgttctgtgtagggtgcaggagccacaagtgactgcagggggaaaggggggttctggtgctggcattctgcagcagtgggattgtcctctgtcataaagaaagagaaggccgagcgcggtggctcatacctgtaatcccagcactttgggaggccgaggcaggcggattatttgaggtcaggagttcgagaccagcctggccaacatggcgaaaccccgtctctactaaaaatacaattagtcgggcctggtggcacatgcctgtaatcacagctactcaggaggctgaggcaggacaatcgcttgaacccgggaggcggaggtttcagtgagccgagatcgggccactgcactccagcctgggcaacaagagcgaaactcgtctccaataaataaataaaatccaaaacgctgggacttgaagtgccctcctttcaatcttgacccaggtaaaactcaggacaaataaaaagaagtagaagcagtaaacttaggacatacagcatgtaaaggttctgaacgcaggagtaaatgacttcaaatagcttttgtggcctttcgccaaggaccgggccctccctggcaagctggggccgggtctgaccttccaggttggcgtcagcaaggaccaccctgcccttcagtggccggacacgaccttgggctttcgtgcagtagcctggctgcaggccaggtcgagtccgccaccccggggacttgcaccgcccttcagaaaccgaaacctgctcggccccaggaggcggaccgggagaaggggggggggtgtgtgtgtctcgggacgggggcgtggtctagaggcgggggcaggggaggagcctcgggtggacgcgcgtgcgcaggccggagcctcgggaggaggccgggtacccggggtgcggcgcgcgcgggaggaaggcggggcctcgggcgaggggcggggcctcgggccgggggcagggggcgggcgcaggcgcaggcgcgggcgggcggggcgcggggcgcggggcgccgggggcggggctccgagccgggctgaggcgagcgggggcgcgggtggcgcggcgggacgcgagcggcgagccggagcgcggagcccggctcccgcaccatggaggaggacgacagctacggtcagtgcgccccggcggcggacgcttccccctcgctgtcccccagtcccctccgggcccggccgtccggcagcgcttgcggcggctggcgtttcccggggacactggtgcgggacgcggagcccggggcgaccggcgggcgagcggtgcgcggggccctcgcggggcgggggtcgcagggggttttgagggatgagggtcgccggggccggggtcgctggcggcgctgagggatgtgggtggctggggcgggggtcacaggccgggctcgcggtctcgcggggccaggggtcgccgcgagctctgaggaatgagggtcgttggggtcgcggggcaggatctcaggggctctgagggatgagagtcgttggggtcgctggggtccccggggcaggggtcgcagtccgggtcccggggggccgaggggtggaggtcgctggccctgccgcccctctgcggggctcggggcggacgcgcggatggccgggcccgcgttccccgcagtttccggccgctctcggcgtcagcgagttgtgcccggtccacgtctttgttcagaaatgagaacggggagcggcgccgccggcgaggcgcgggctccgggacggccctgcccgcgggagtctgggcccggtagccgccggtccggtgcgtcgccgcctgccgagacgcgggtgtggagcccgaggggcaccgcggtggggacgccgctcctcccctgactggggacttggcaagcggagccgctgtcccgctcccttcgctcccgcgcgttgaggctgctggcccaggccaggggtgcctccctccaagagtttgaaattgcaagggttgcaaaaggttgtttgacatgctgtagttaatttattaagtttgttcatgaggaattaaaaggaagaatggcaaatagaacaagtggtgaacttttgtggtttggtagcaaagtacaaataaagcagaactctgtggccaaatggaacccaattctagtttaataactaatgggacatttttcttttttttttttttttaagagacgagatctcgctctgtcacccaggctggagcacagtggcgtgatcgtagctcacgtcagcctcttgagtggctggaaccatacgcacgccaccatgcccggctaattttttattttattttattttattattttattttattttattttatttttgaaacggagtctcactctgtcgcccaggctgtagtgcagtggcgccatctcggctcactgcaacctcggcctcctgggtgagctgagcgattctcctgcctcaggctcctgagtagctgggactacaggcgcgtgccaccacgcctgtctaattgttgtatttttagtagagacagggttttgccatgttggccaggctggtcttgaacttctgacctcaggtgatccacccgcctcggcctcccaaagtgctgggattacaggcatgagccaccgcgcccagccctaattttttacttttttaaaagatggggtcttgccatgttacccaggctggtcttgaactcctagacccaagcagtcctcccacctctgcctcgcacagtgttgggattacaggcctgagccaccacacccagcccacttgttaccttataagtaaacaagtaaaagcagcttgtgcatttttttgttgtttgttttgttgtgtttttgagacagggtctagctctcttgcgcaggctggagtgcaggggcgctctcatagctcactgcacgctctgcttccttggctcaagcaatcctctcacctctcttctcagcccctcctgtaacctggactacaggcctgggctaccacgccctgctaattatttttatttctttttgtagagagggaggtctccctatgttgcctaggctggtgtgaactccagttcctatcttggcctcccaaagtgttgggattacaggcatgagccactgctcccagcctccttttgtgattaaaagaaaaatcacccactggctggccccaaaagattgttcagcccctccagatttcactcctgcccactgctgagaagccgacagcagttttgcctgctgctcttttctctgcctcctcttgccatttaatttccctcagatcccagtgtcctgcctaccaggcttttgtggcctctcttgtgttcttgcctgctgccgtgggcaggaagctattggtctggttgcttttaatacagtgactgctttgccaccaggcatgacatgaacttgtacttgaaagaggtaagtggaagcagggcgtgttagtttcctatacctgttatattaccacaagcctggtggctcaaaacaacataacatttgttttagggttctgctgtcagaagtccaaaataggtctcactgggctaaagccaaggtgtcggacaggctggttctttctggaggctcaggggagaacccatttccttaccttttccagcttctagaggccacctgtgttccatggttcatagtcccctttccatcttcaaagccagcaggtagcatcttctcatttctctcgacctcctacctccctcttattaagatccttgtgattatagtgggacccacctggataatcaaggataaggattagcaaccttaattccatctgttaccttaattccccttctgccatgtaaggtaacctattcacaagttctggggattagtacccggacatctttaggggctgttattctgtctgccacacacgaagatgagaaagtttgtaagtttattcttcccctttcttttttttttttttttttttttgagatggagtttcactcttgttgcccaggctggagtgcaatggcgcaatctcggctcactgcaacctctgcctcccagcttcaagcgattctcctgcctcagcctcctgagtagctgggattacaggcatgcgccaccacgcctggctaattttgtatttttagtagagacagggtttctctgtgttgtccaggctggtctcaaactcttgacctcaggtgatctgcctgcctaagcctcccaaagtgctgggattacaggcatgaaccaccccgcctggcctgttcccctttctacagttttaaatatcatccttttattttggaggaactaaaaagattgaagattccccacccagagggtcaccacacaaaaagtacctgatggtgtaagatgatcatatgaagaataagactcccaagttctttaaggtttgtgttagtctccagaactgtccatttccctcataggtttcacagagaatttaccttgaccagatcccacattgtaaaaggaaatgtgtgtgatggattcataaagcatataacatgacgtgttcagacgtcacctcagaacttccattgttttcttttaaacaaactttttattattattattttttaaatagttgcagagtctcactatgttgcgcaggctggtctaaaaccatcctcccgccttggcctctgaaagtgttgggttgagtcactgtgccaggcctaattaaactttttctttcttttttttttttttttttttttttgagatggagtctcactgtgttgcccaggctggaatgcagtgacgcaatcttggttcactgcaacctctgcctgctgggttcaagtgattcttctgcctcagcctcccaagtagctgggattacaggcacctgccaccacacccggctgatttttgtgtttttagtagaaatggggtttcaccatattggccaggctggtcttaaactcctgacctcaagtgatccacctgccttggcctcccaaagtgctgggattacaggcgtgagccaccacgcccggccctaaataaactttttaaaccttaattttttttccttttttttttttttttttttttttgagacagtcttgttctgtcacccaggctggagtgtggtggcacagtcttagctccctgcagcttccacctcctgggttcatgcgattctccctcagctttctgagtaggggttactacaggcacatgctatcatgtctggctaatttttgtatttttagtaaagatggggtttccccatgttggccaggctggtcttgaactcctgacctcaattgatctgcctgcttcagcctctcaaagtgctaggattacaggcctgagccaccaagcccagcctaaaccttaatatttgattttcagaataatgagaaacatttcttgtggtgttaactttgtgtgtgcgctgttttcaacagtgcttcctctgtccctgtccctgtccctgctgcgtaagttggtaacgttttgtgaatcagcctaggacaggtaccactgtttttagaattctttctttttttttttttttgtatttttaatagagatggggtttcaccatgttagctaggatggtctcgatctcctgacctcgtgatctgcccgcctcagcctcccaaagtgctgggattacaggtgtgagccaccgcgcccggctttagaattctttctggagggaaatgcattgtaatttcctggctaccttttagtattaaaaaacttttggaacatagctcattgataatatgctatagaaagagagtcttagagtttctctgtccaattaaagacaatttcaaaaaccaacaaaaaggctttctcagttccagtactcttttgtattcattagatagggacagtttggttcagactacacctgtgtgggatatatctttactggtttgtttatttatttaatttatttatttttatttatttatttttgagacggagtcttgctctgttgcccaggctagagtgcagtggcgcaatctcggctcactgccagctctgcctcctgggttcacaccatctcctgcctcagcctcctgagtagctgggactacaggcacccgccaccacacccggctaaatttttgtatttttagtagagacggcgtttcaccatgttagccaggatggtctcgatctcctgacctcgtgatccatccgcctcccaaagtgctgggattacaggcgtgagccaccgcgcccggccttatttttttttttttgtgagacagagtttcactcttgttgcccaggctagagtgcaatggggcgatctcggctcaccgcaacctccgcctcccagattcaagcaattctcctgcctcagcctcccaagtagctgggattacaggcatgcgtcaccacgcctggctaattttgtatttttactggagacagggtttctccatgttggtcaggctggtctcgaactcccgacctcaggtgatccccctgcctaggcctcccaaagtgctgggattacaggtgtgagccactgcacctggcctattggtttctttttttaaaaaaaaaaaaactgtttatggcactgtggagtcccaccagacaaaccattaacttaagaaaatactattctgctcaggaaaaagaaaaaaatcgtaaaaattaaattttgcatacattttctttataacatgcatactgtgtgtacttttttttttttttttttttgagacagagtctcgctctgttgtccagcctggagtccagtggcacgatcttggcttactgcaccctctgcctcccgggttcaagcgattctcgtgcctcagcctcctgagtagctgggacaacaggcgtgtgctaccacgctcagctaattgttttgtatttttagtagagatggggtttcatcatgttggccaggctggtctcgaactcctgacctcaaatgatctgcccgcctcagcctcccaaagtgccgggattacaggtgtgagccattgcgcctggcttgtgtgtactgttgccagtatatatttctgtgtaataatgttcagggttgtaaacagaaaaccacatataatgcactttaagggagtatttgcgggattttccagagagtatgttcatcctgttgctctgtaatggtcatcattttggggctaatgactgcagttgccgtgattcaattatgaacttcctttttaagcataatttcttttttttgttgttgagacagagttttactctgtttcccaggctgaagtgcagtggcgtgatcttagctcactgcaacttctgcctcctgggttcaagtgattctcctgtctcagcttcccaagtagctgggattacaggcatgtgccaccacacccggctgatttttgtatttttagtagagacgaggtttcaccatgttggccaggctgatctcaaactcctgacctcaggtgatttgcccacttcagcctcccaaagtgctgggattacaggtatgagccaccgtgcctggcctttaagcataatttctatataaacatttaaaatgaaagttgctggagtctatcatgttcattatagcaaatgcatgtcttatttttgttcctttcaagaagttagcttcaattagggaagttgtcaacagagaattttaaaataatttttaggtgagttttcaaatgaaaaggaagagacgtctgcaaatgtcctttacttattcagcttctgaaataccttactttttatttgcctttgatgtaatttttacattgagttcccagattgattatctaaagcaggaaaggtagaactaattcattatctaaaacaagaaagaacaaatttcaagttaaaatagcagtgttttcagcaagaattaaaaaaacgaggtttcactttctctgtagaggaagagtggtggggtaagacattcaagaaagttgttcattcgcatatttcgagaagcattgaggtccaattgcataaaaacgtatctgctgtctctagctttggcctttgagggaaggatataagggaatactcaggacaggggtaaaaagaaaaaagacccttagcacccgaggctttcaagatcactcttaattagtaacttccttccatctctcctcttcccctaacccccagcggcccccccaatcttcatgggccacaggagactgtcagggtgttcagcctggtttctgtgccgggttaggtgtggtgtcataacacacagagggacctcaggaggactaaccctgtggtctgtggatggtgtgatgcctcgggagctggggtgactgcaggggtgggtgcctagtggcacagagggaaagcaggcagcaagtccagggccgttatgccagccacaggtggtgggctgtctgagggagcagtgccttgcggcagttctaacccgatttcccatgccgaatgccctggtgggtacttcgggggtttgataagaaaagagagtagtttcttctgtgttttcatggaaaggagttttctcacaggcataatcttgagtgtctactcaagatttgggaacatttcacatgtatgtattacggtttgtgaccaaagactctggataaaaggaggatttatatcagaattataggaagagctgtcatgctgtaccatggagacctgtgtgtgggtggtgagaagattcaacaagaaaaataaggtctgggcactggcatgtctgggtgctgctgcgggctggggagaggagcctgttgcatttaagaaagatttgccttttcatcaccatgtctccagaataggcatggtgcctggggccctacagaggcagctcagcaactgtggagggaataatggattgaaccaagttccatcttgtaaaaagttaatatgtggtgagtttgagtttttttcctcaactctccatttcaaacagaaaccagaacacttctgtgcatgtttgaccccatgcagaacccgttttctttgtttttctatgatatggatgacttccattattctcaaacttagttactaacttactgatttgcctttattgaaaagaacacaattatttacagtgaacaccttcttagaaaatctggaacataaggttgccataattatacacactttgtggtctttaagatatattctcagggtgacatgaacatgtcagagtataaacatttttagaattcttgatgtctggtgccaactttttccaaaagggctgcaccaatttactcttttcttagcaatgtatcagtacacgtacctgtaatagtgcaaatgtgccctcagtgaggatcaacattttaaaagtttttttttaaaacaaacaagcaaacaaactgaatttggtggttacaaaatggtgacttattaaatctactgatcactagctggattgaaaaaaatttttattttgcatatttgtgtattatgaactggctacatcataagaaatgatggtttatttacttaacttaggttaactcttttctatcaaataaagtgatttacaggtttttgtcactgttttaagcatggggaaaatgtgtatcagttttgactggggtttaggttagattttggctaattgtaacagtcgtttacctttcttttaatttttcttttaaagatgaaagatctctcaacccatatattgtcttctggccaactacaaaatgtttccttacgagaagaaattgtgaattaaatagatttttagaaaatttaatttaatttaattttttttttttttttgagatggagtcttgctctgtcgcccaggctgcagtgcagtggcacaatctcggctcactgcaacatctgcctcccgggttcaagcaattcttgtgcctcagcctcctgagtagcggaattacaggcgcacgccaccatgccctgctgatttttgtatttttagtagagatggggtttcaccatgttggtaaggctggcctcaaactcctgacctcaggtgatccgtccgcctcggcctcccaaagtgctgggattacaggcgtgagccaccgctcccggccagtagattttttttttgaaactataatttttcttttaattaaatagagcagggtctcactgtgttacccaggctggtcttgaactcctggcctcaagtgattctcctgccttggcttcctaaagtactaggattacaggcatgagccaccacaccttcctgtgaattaaacagattgtattggtctgggttataatgataaactgttcagtttcaggctgggcatggtggctcatgcttgtaatcccagcactttgggaggtcgaggtgggcagatcgcttaagctcaggagtacaagagcagcttgggcaacatggtgaaaacccatctctactaaaatacaaaaaaaaattagccgggtgtggtggtgcctgcctgtgatcccagctactcaagaggctgagtcactagaatcgcttgaacctgggaggcggaggttgcagtgagctgagatcgtgccactgtactcctgcctgggcaacagagtgagaccatgtctcaaaaacaaaacaggccaggtgtggtggctcacgcctgtaatcccaacactttgggaggccaaggtggccggatcatgaggtcaagagatcgagaccatcctggccaacattgtgaaactctgtctctaataaaaataaaaaaatcagctgggtgtggtggtgcacgcctgtagtctcagctattcaggaggctaaggcaggagaattgcttgaacctgggaggcggaggttgcagtgagccgagatcgcgccactgcactccagcctggcgacagagtgagactccatctcaaaaaacaaaaacaaaaacgaaacaaaacaaaacacttcagtttctggaatcttatggctcatacctgctcctttctaaatgttccatgtgttaatcaaaagagattatgtcaaacagattttttcttcagtatttcttgcattcacgatcagttaggacacttattctatagtaagaattagaagattgccttcttatttcaagtatggggggcacacatcataggtcatttggaacaggagagatgaaagggatgaaacatctctgtgtattgtgctggaccggtggaagacttcaacttgagagccgtgtcgagtctggtcgagtctgctttcctgttattgttccacacctttcctgctctcctctccaagatgaaagtcttcagagtgggcttctaaagaaaagaactttgcctgaacctgtccatttgctccgttgccacactacttgattgtctctaattattgttgcaatttagtttcagttgcaatcatagaggcatggaggaggtggaaaattatttagaaatgatcaagaagtgaatcccacatcctctgaaactgctggtaatgttgttttgcttctctgtttgcattaacttcagaaaaacacaaaagcagtgaagggtatgtaggggatttctatgactcctcattatccaggatagcgtgacattgtatatttctgcttttatggtagtgagatggttattagctgctttctttagtgactgaattttatagtaagggccaggataataccttccttatccaagtctttatattttccaccttttcttttctttctttttttttttttttttaagatggaatctcgctctgtcaccaggctggagtgcaatggcgcaatctcagctcactacaacctccaactccctggttcaagcaaatctcctgcctcagcctcccaagtagctgggattacaggtgcatgccaccatgcccagctaatttttgtatttttgttagagacagggtttcaccgtgttggccaggatggtgtctatctcctgaccttgtgatctgcctgcctcggcctcccaaagtgctgggattacaggtgtgagccaccgcacctggccttcttttttctttgagacagtcttgctgtgtcgtccaggttggagggcagtggcgtgatcttggctcactgcaacctctgcctcctgggttcaggcatttctcatgcttcatccacctgagtagctgggattataggcatgtgccactgtacctggcttatttttacatttttattttattttatttttcagacagggtcttgctctattgcccaggctggcatgcaatggcataatctcagctctcttaacctctgcctcccaggttcaggcagtttacctgcctcagcctcctgagtagctgggattacaggcgggcaccaccatgcctggctaatttttgtatttttagtagagatgggattttgccatgttgggcaggctggtcccaaactcctggcctcatgtgatctgtccacctcggcctcccaaagtgctgggattaccgatgtgagctactgcgcctggccagtttttgtatttttaggagagacggtgtttcaccatgttggccatgctggtcttgaacccctgagctcaaggaatatgcctgccttggcctcccaaactgctgggattacaggtatgagctcccgcacttggccattttctaccttttcttgagtcttcaaggcttctatttcagaagcgtgcccttacctggcattgttaaatctatgttgtaattagtagtgttaggtatgaatgatggaattggctaaggctattaaaaaaacctattttcagtcgggctctgtggctcacacctgtaatcccaggccgaggcaggcggatcacaaagtcaagagatcgagaccatcctggccaacatggtgaaaccccatctctactaaaaatataaaaattagccaggcgtgatggcgcacgcctgtagtcccagctacttgggaggctgaacaaggagaatcgcttgaacccgggaagtggagattgcagtgagccgaggtcacaccactgcactcccgcctgggtgacagagtgaggctccgtctcaaacaaaacaaaacaaaacaaaacaaaaaaaacccgcctattttgtagtaatatcacagatttctttgttttttttttttcttttcttttcttttcttttttttttttttggagatgggaattttgctcttgttgcccaggctggagtgcagtggcacaatttcgactcactgcatcctccacctcccgggtcaagcaattattctgcctcagcctcccaagtagctgggattacagacacccgccaccatgcctggctaatttttgtatttttcttttttttttttgagacgaagtcttgctgtgtcgtcaggctggagtgcagtggtgcgatctcggctcactgcaacctctgactccctggcttaggtgattctcctgcctcagcttcccgagtaactaggattacaggtacacgccaccatgcccagctcagttttgtatgtttagtacagacggggtttcaccatgttggccaggatggcgtctatctcctgacctcgtgatccacccacctcggcctcccaaagtgctgggattacaggcatgagccactgtgcctggccaatttttgtatttttagtagagacggagtttcactatgttggccaggctggtttagaactccgaacctcaggggatccacctgcctcggcctcccaaagtgtcagaattacaggtgtgagccactgcatccggctcgcagattggtttctatgagtagtttgtaatggtttattcagtcaacaagcatgagtgatcatttcataccatgtagtccctgttgtcaccgatgctttgagtctagaaggaggagacaaacatggcagcaagctgtgaaggagcgtgtcacagtagatgtggcaggtgtgtgcatgaaaaatgtaggtaaaccaaggagagcagtgccagttccactggcgctgggatggcactggattggccaggggagagtttgtagaggagctggcccttgggctggattgtgaaagatgagttagtgccaagtaggagaacattgcaaagaagtatatatcaaagcaaagagaatgagaggacaggaggtgtgaagcagtttcgccacttggggagctacaaatggttctttgtgcctggagagtaggctgtgagcagagggaggaggccagaggcagggttagagaaatgggggacagttatggggggcttcagtatgtgttgttacacaggacttattctgtgggacacggagctatgagagggtttaaaccagggatattttatgctgattattttgctttttttttttttgagacatagtcttgctctgttgcctaggctggagtgcagtggcgtgatgtcagctcactgcaacttctgcctcctgggttcaagtgattctcgtgcctcagcctcctgagtagctgtgattacaggcatgtgccaccacacctggctagtttttgtatttttagtagagactgggttttgccatgttggccaggctggtcttgatctcctggcctcaagtgatttgccaacctccatctcccaaggtgctggtgtgaggcactgcgcccgttcttttttttatttttattttttatttttgccaagagggggaagggagagagaaaggaagcaggtggaggcaaggagagggagaagcagagcattctgttgcattttagaaagattcttctgacttagtgtggctcagattggcagtggagagacccttaaggaatttttggagataggtgagctaggtgatgagggcttgaattcaggctgtgggagtaggaggtaggagagaaaaaatacaggaccagtgaaggacatgaaattgatggatttggttgccagtgtttgggagggacatagcattgaaaggagatgaaagagacagggtgacgaaggtgagcaccaggtttctgtctttggatgactgcttggagagtttccatactgagaataggacttcggttttggacgtaatctctggagttttgtggtacttgtacagtgtccactttgagagacccatttaaatagttgaatttgaacctgcaactccagagatgatcaacgcaggagtgggagtggaacccagggagtgggtgatgccacgggctgattgaggagtccaaggatgtcgtcttggaataccaccactgaagggctgggtagaggaagagatctgaaagggaaactttgaaggcaaatgtatataactcttcaggtaactagatggtaaatggaaagagagagagggcaggagctggaagttgcagagtggagagctttttgtatttttctgggggatattaagagtatttatagactcctttttatacctttggacaatgattccgagccagtcttgaatgaaaacattcatatgtgatgtgttgtaaacctccaggacgatcggtctcacatttcattttgtctgttctggcttctgtacacagcagctgcagactatatgtgtttttgaaacctgtttaacttcctttcttttgtgttctctaattctctgaaatattatttccaacagccctaagattgaaattaagagaacgtttgaatcttagctgcattctggcattttcaagtgcttcctgcacatttccccttggatatcccatcattgtccaagattcagcatgtccgagacttgctcctggccctttcattctggtgttacctctagacctctctaatttttaaacttttatcaccattcacttatcactgcaatcattatggcttgaaaaaaacactggattctttttcttgccatttaaattgtttcccatctatccaaccatccgtttgttcatctattcaaccatccgtttattcatctattcaaccatccatttgttcatctattcatccatttgttcatctattcatccgtttgttcagactttttaaattctttgtgtcagggtatttgctttatgctcaggctgtgaagaattttaagatataggccctgctttccagaagctcacagtgtagggcggttcacgtggaaatttgctatggtggaaataccaacaaatgctatgggagcctggggactttcagctttcactgtgttctgagtgagatgtactttaaaaaaaatggttttaaaaaatttagacatggggattcactatgttgatcaggctggtcttgaattcctggcctcaagcagtcttcccatctcggactcccaaagtgctgggattacaggcgtgagacaccatgcccggctgagacgtacttttgagcaaacccaacaggcagttacctactgggatgaagtgagatgggaacatgccagagtaggtgtcactgctctagctgttcccacactagcagttaactgcttgctgcacatgaagttcattgctgaacatttttcgtaagttctcattgaaccctcacagttaccctgtgggtggcaacaaatactgtactgattttataggtgaggaaatggagaagtagagagattctaaagggacatagctgctgagtggttgagctggcaccacaagctagatttctcaggctccatgcacaggccatgctttgaatgggctttttctatactggctgctcattcacacccccctcttcatttttatgtcttgtacttttacataccttatatgctatttatgtcttttcattgttttttctttttctcagacctctcagagatgaatttatgtactttctaaacgttctttcttctgggagtggatacagagttttgtatcttgatatagtttggacagagttttggttaaacctgtgttgctggttattaaacacatttacattgaaagagccattgttaatcttagggttgaaatttgaggagtttgtaggatcatgcagtaaaggcagtatctttttccttaatcccccgggtagcatttagtttaggggctgctgtttccttccagggactctggtaaactgggtttgatgttgtggcaacaagaattactcagcctggcctttgatgattccctggagccagaacatgttttgtggttgggccactagaatttatgagaaatccaggtaaccaggtaaaggttaacgaatcttactgagcttgtctctcagccattttcaggggtcttttcatggcttctcttagcctttttgccctttatgactaaataaaaaggctgctgaaagaactcatttaacagtgagacaggagaacactagcagaataatgtttcttccagggagttacagagcagctcccagagtcttcctgcccgaagtcctgacttggaagctttgtctcctgctagaggaggggctggcttttttttttttttttttttttctgtagagatgggatctcactatgttgccctggctggtctcaaactcctgggctcagacgatcctcccacccccaaagtgctgggattacaggtttgagccaccgtgcacagcctaaggctggtttttgacagggcctcattggaatgtgagtactgtggtagggtcaccaaggatctcaagacaagaccctctagctttgcaggttcaaaaatagactttaggacttggatttgtgccactttattcatgctattgcaggatttaaaaaaaatcaagttgtgatcatttgcctgctctcagctcagctgtggactctggttcttggggagcacatccagggagccctggaaacaccactgtcttgtgctgtggcacctcttggtgtttgtcttctgggggaccatctgggggaccatcctgactaaaccttctgtttagtcaggacagcaaactgacaataaaatagagtcagatacagcttttgagggcttgccatttgttttgcttggcattgaaaccctcttggacttctgaatagcccacttcaggcttgtctcctctactccacactggcttttactgatttattgaagacggagacttcttcaacttgttctctaactttgacaaagacttctgcgatttctctgtgtccagactgcagtgacaaagcatggaggaaattaaattctaaaaagatttttagaattataattgaaatatttattttatgggtttatgatatcccaaaagaaatagggattccaacctagactttggggtctacctttagaaggagccccgttttctgggtgtgttccatggtccactgaggaaggcttctctttgagtctactgatgcctcagggagggcctcccggtgatcctgctcctgttccttgggacccatcagggatacccatgcccctctgctcatgcactcagcaaactccttgcggtgcttggtacacaccaggcacgctccccagctcgggcctttctccagctattcactgtgctagggatgcttttcctccaaataacctcatgctcagttcccgcactctctcgacaagacttcccctgtttgcttgagcagccagtgcccccctcctctctgcttgccacccttaccctgcttgactcccaataatgctcatcccccgggaacctactcattatgtttattacgcatggtcagtcttctccagctgaagtggaaactccacaaggcaggaatcttcatcccttttgttactctcccctatcccatgtgcatgccagaaacagggcctggcacattgtaggctctcagagcttgttgactgaatcattaaatccatgctcccccactccctctgcttttgatatagaaacaaaggtcactgaaattgctcatggaaacttgggagttgcagttaaaatagatccctcttacctcgtgcatacatctaatttcattcttccattattttggggtttatatataagcctggttcttgctgaaactgcttatgttgataaccagttagtgagttcctcactgttgacttgctgggaagtttatagagacattttttatgcattcagagatttcagtacaaatcttgaaaaagggacatttaggccgggcgcggtggctcacatctgtaaccctagcactctgggaggctgaggtgggtggatcatgaagtcaagagatagagaccatcctggcaaaaattagctgggcgtggtggggtgcgcccgtagtcccagctactcaggaggctgaggcaggagaattgcttgaacccaggaggcggaggtttcattgagccgagatagtgccactgcactccagcctggacaacagagcaagactgtgtcttaaaaaaaaaaaaaaaagacatttagatggaaatattattttatggtattagttgtgagcttataaaaagaagaaaatgattattctatgttttgttttttctttgagacagactctcgctctgtcacccaggctggagtgcagtgatgggatcttggctcactgcaacctctgcctcccgggttcaagcgattctcctgcctgagcctcccgagtagctgggactgcaggcgcacaccactgtgcctggctaatttttttatttttggtagagacagggtttggccatgttggccagactggtctcaaactcctgacctcaagtgatgtgcctatctcagccttccaaagtgttgggattacaggcgtgagccactgcgcctggcctattctatgtttgaaagatgagtgtagcaaataaattctttaagaggaggctagcatactttcccccttatccatggtttcaccttccatggtttcaattatctgcagttagctgtggtttgaaaatatgtgagtatagtacaaggaaatattttgagagactacattcacgtaactcttattacagcatattttatagaacaacttattgttctttattatttattataatgttctttattattagtttattattaatctctgcctactttataaattttatcataggtatgtatgtataggaacaaacatgttgtatatagggttcactactatttgtggtctaggcatccgtggggggtcttggaaagtatcccctgtggataaggagggactactctataacctacagtaaggtgatttgtggtgtgaatccactttattctaggaagtattaaggtgtttgacaaatgtgtatataaatgtgtgtatcttgagagggattaaaagtcttttttttttttttggcacggcctcggctcactgcaacctctgcctcctaggtttaagcgattctcctgcctcagcctcccaagtagctgggactacaggcatatgccaccactcctggctaattttgtatttttagtagagacagggttttaccacgttggccaggctggtctcgaacccctgacctcaggtgatccacatacctcttcctcccaaagtgctgggattacaggcgtgagccaccgtgcctggccaaaagtctttttttgagattaaaaacatccagaaagcagccggacggacatttccattgtattagtttcctgttgctgccataacaaattatcacaaatttagtggcttaagacaatatacattattatcttacagtttggaggccagaagtctggaatgggtctcactgggccaaaatgtatttcagcagggttgtgtttctttctggaggctctagggaaagatctacttccttacctttccagcttctaaaggctgcccacactccttggctcttagctccttcctgcatcttcaaagccagcagtggctgattgagtctcacctctcatcactctgacactgattgtcctgcctccctcttccatttggaagaatccgtgtgcccacttggatactctaggataatctccctcttctaaagttggctgattaggagatgtaattccatctgcaatcttaatccccttttgccatggaatttaacatgttcacaggttccagtgattaggacatgtatatctttgggaccattatcctgccgactacatctatacatctaccttagtgcctttgcccatggaatgtttcttgtgagaatgggcagtttaatccttcctgcatatcattttcttcttatggaagtgtgcctcatgggtattaagtattgcagtactttgtagactttgtctgacttcgtgaagcatttctagttttagaagagtgctcctaattcaaaggtaggggaaggcatgtgcaaaaaagccgccctttccactctatattctgctgatcagcaacactatttgtcatcaaattaccggaacagagactatcttgagtcagaaggttatgttgttgctctctgttcttaggaatgtttttgtactctgagagtaaagataatttttcctgttgtcaggtaatggaaatgtccctgaacaatggaccttgataggaaaaagaagtttattattctagaagatgttggcacaacattatttggtaattatttttccagaaatctgctgttttcccccatgtcacatgatggacacctcattgtatggaggaagcaggccagatgctgttactctttcaaacgtttatgttaaaggctcatttggtttaatttccactcagaatagatgttaaggatacaaaaccaaatgtctagctgactactactgttctttccctttcctgctcttgctttggactactgttttctcaaacgtataaatgtgtgtgtatagcattctaataagaggaatttaagctttaaaaagtttttaaaaataacactcttttttttttgtttttgagacggagtctcgctctgtcccccaggctggagtgcagtggcgtgatctcgtctcactgcaagctccgcctcccgggttcacgtcattctcctgcctcagcctcccgagtagctgggactacaggtgcccgccaccacgcccggctgattttttgtatttttagtagagacggggtttcaccgtgttagccaggctggtctggatctcctgatctcgtgatccgcccgcctcggcctcccaaagtgttgggattacaggcgtgagccaccgcgcctggcccctgcctcttgatttttaaagaggttttaataagctttgagtagtgtgagtgcttttagttccctgtattatcacgttcccaaggtcaattgattttaacacaaaaataggttacacatcaccccattccagcctagagcaggactagaaaaagcagttcctgtgagaattagttccccttggagatctgaaacttgaaatctgaaaacaagaacctcttgagttgggactcagaaggtggggaactgctgttgtgtaccagaatgtgtgcacaaggnnnnnnnnnnnnnnnnnnnnacttgtaaatctcgaggctgggcgcggtggctcacacctgtaatccagcactttgggaggccgaggtgggtggatcacaaggtcgggagttcgagaccagcctgaccaacatgttgaaactctgtctctacaaaaaatacaaaaattagccgggtgtggtggtgcatgcctgtagtcccagctactcaggaggctgaggcaggagaatcacttgaacccgggaggtgggtatcccatttatcaagaaaatatatagagactgtctctgacttatggttgactttacgatgggtttattgggaagtaaccccattgtaagttgaggagcatctgggatatattttgattttgagaagtgatgtcatcagacttacttgatacctgtaacttttagaaagataagtatatgatgctttttgtgtaaaattactttttcacttctatttaaaagtcttaagttctgttgtaatgcgatttttgattttctagtgtttagaaaagagggttttaagatagtagaatgttgttgctttcttttaaactatatatatacatatatatacatatatatgtatgtgtatatatatatacatatatatatacatatatatgtatgtatatatatatatacatatatatacatatatatgtatatatatatacatacatatatatacatatatatatgtatgtatatatatatacatatatatatgtatgtgtatatatatatatatacacatatatatatgtatgtgtgtgtatatatatatatatatatatatatatataaacctgctatttggatagaggccagaattaaaacatcagtagtcaaaagagggaattcagtgtttcttgagtttttagctttatatgtctaaatttgtaaaattcaaccatgtattttccgttccacatgggcaccttttgcaattgtggtagcagatgtcctaggcagatgaacatgcagaagtggtttgtttagccttcccttttaaagttcgtaatctagtaaatttgggttagaatggtggttcccatacttgactaacccgcagaatccctggaggaatctttcaaaaaagccatttattctggttccttactctagccataccaaacgtaccagggcagatccaggaatgagtgaatgaataaatacgtacatacatgcacatgcttgtacacacatgcacacaaatatacttctaatgcccctaaatttggggaccccaggtgtggaaactcacgcttcagaacctctaactgttctctccaaggtcacatcacacaggcaggctctggcttgagttggcctggccagagatgcttcccttcatttcccgtgttgagtgtataaaatgatttcacaagaatttgtgcgtccatgattgtaggaagggatggctgagtgttgaatgcatttcctcagctgtaactatctaatttatgtggttttgctttaagccattcagtattccgcttggagggttttgaacttacagaggtttttaagaagaggctcaacagatgaaagaagcaagaataaccaaccttggatttttgtttttactcctttattatagctaccaagtatatagctacctacccactttagcttccccatgtgtctttgtgtggttttctgttttgttccttttaagagataccgtctctttatgttgcagctgttgctaggcagccagtggccaggtgccagttttagagccctgatctgtacaacagtgaggaagcaacctaaaaagacccctttgcctaccccgttggatgaaagagaggcttggcgctgggatgtagactgctaggcgcatgagacctacgaagaactgaggctgcgtccacttacccagagtgtctttggagagtaccttttagtccttcctcggggcagttgccatatagtctgaaaatgaagccacctcaggcagtgggcttcgattggctacaattgtgcccttcttactttagcactttggcaaacattgagaaaattattattatggaaattttctttctgttttgagacaggatctcactctgttgaccaggctggagtgcagtggtgttgtcatagcccactgcaacctcgatctcctatgcttaagcaatcctcccacctcagcttcctgagtagctagggccacaagcacatgccataactccgtggatgccgaaagtagataacgagacctactggatcagaatgaggcagattagtacacatcgcacagcaaatagcaggaatatcagcatgaaagtgctggtgcccctgacctcaagtctcgtggggtgacatgatgggcccagatgatgtctatgcatgaattgggtttgcctacagctgaggaaccaaggaccaccaaggacttagcactttcctttctttttttctttcttttttgtttttttgagatggagtttcgagtttcactcttgttgcccaggctggaatacaatggtgcaatctcggcccactgcaacctcctccgcctcctgggttcaagcaattctcttgcctcagcctagcgagtagctgggattacaggcatgcaccaccatgcccggctaattttttatttttagtagagacggggtttctccatgtttgtcaggctggtctcgaactcctgacctcgggtgatctgcctgcctcggcctcccaaagtgctgggattacaggcgtgagccaccacaccgggcctgggcttagcactttttatagcaagtgatagacaggccaggcttcttctcctcaatgggggcatgtcatgctacagtctccttgaccaacttcatgtcgccagctacaagaagacagaccttgcagtttggcactctcagcaaggacatgcagggatgcttggggcctcggccaaaggcagcatgatatagatggagcatagtttaattaatcatcctgtcttgttatttagaagtttccactttgttcctgtaagaaagaatcctgtaacattcttgtggataaagttttgctcacatttccagtgattttcttaggctagattcctgtaagtggacttactgggttagggagtttaactttgtagtctcttgatatgtactgccaaatgggttttcagaaagtgtgaatcagtttacacctcataccagtatatgatgatacttgttaatttatccttcctgacattgaattactatttttttaaacttttttttgaatttttttttttgaggcagagtcttgctctgtcacccatgctggagtgcagtggtgcgatcttggctcactgcaacctccacctccctggttcaagcaattcccctgcctcagcctcccaagtagccatgcctggctaattttttttgtatttttagtagagaaggggtttcaccatgttggccggactggtcttaaactcctgacctcaggcagtctgcccgcctcagcctcccaaagtgctgagattcaggcatgagctactgcacccggctgaatatttttttaatcttttgggttgctgatataattaaaattttttcctgcctctctcagcattggcagaatgaactttgttctaagaacctcggctagtgtttacatgtattagaatgggaaaattatagcagcttctttcccaggtcgttttttattcatctattcaacagatacttattgaacacctataatgagctggacactctatgggccttgcaatttagacatgaatagagttctcaggtaccttacattctaattagaaggagaactttgacctctaaccaagacctgtttaattcataggagggtttcttttcttttttttaaactgcactcacggtcatccccccaaaggatgagggtttcttaagttatgttgaaaattcaaaccttgagtccgggcatggtggctcacgcctgtaatcccagcactttgggaggccaaggcaggtggatcacgaggtcaggagatcaaaaccatcctggctaacacagtgaaaccttgtctctactaaaagtatgaaaaaattagctgggtatggtggcgggcgtctgtagtcccatctactcaggaggctgaggcaggagaatggcgtgaacccaggaagcctgggcgacagagcgagactccatctcaaaaaaaaaaaaaaaaaagaaaaaaaagaaaaaaattcaaaccttgaaattccgccttgtgaataatcttagtctaatttttgccatgtttattggaatataggccagtggttgaactttgtgttcctaacctctcagcatccttgtgtctcctggtgattatgaaggcttttttttttttaaatgagatcttgctctgtcaccgaggctggagtgcagtggcatgatcatagctcactgcagccttgacttcctcggctcaagtgatcctctcaccccagtggtattttctaatagacatctgtgtccccaaaatgtgttaaagacttttgaagatgagtccactcaaataatgatttagttctgaatagacagatttttaaattcttttttgttttttagatggggtctcactgtgtcactcagttctctgaaggacttcaaatagcctcattagcaaactaggggtactaactgacattttcagcacctttaattggtgatgatgagcacattaatttccatttgtctatttgctgcagacttttcaggttccttctccttgttttaaaaaaattattgaggtataatttacatggaataaatggtatccatttaaagtgtacagtttggctgggcgcggtggctcatgcctgtaatcccagcacttcgagaggccgaggcgagtggatcacttgagatcaggtgttcaagaccagcctggccaacatggtgaaaccctgtctctactaaaaatacaaaaattagctgggtgtggtggtgggcgcctgtaatcccagctactagagtggccgtggcacaagaatcgcttgaacccagggtgtgacggttgcagtgagctgagatcacgctgctgcactccagcctaggtgacacagcaagactctgtctcaaaaaaaaaaaaaaataaaaataaataaataaataaatagtgtacaatttgatgggatatattcaacagttttgtacaccagtgaaaccactatcacaataaagcacaatattttcttgacctgaaaaagatgcttcatggccctttttgttttgtttttctttttttgttttgttttttttttgaggcagtgtcttgctctttctcccaggctggagtgtggtggcatgaacacagctcactgcaacctcaacctcttgggctcaagcagtccttccacctcagcctcccaagtagctgggactacaggcttgcaccaccatgcccagctaattgtttatttatgttgcccagactggtcttgagcttctgggcttaagcagtccccctgcctcagcctcccaaagtgctgccaccgagcctggccgccgcttcatgtccttttgctgtccattcctccctctaccccggccccaggcaaccactgatctggtttttgtgactacagatgagtttgtatttcctagaattttatgtaagtgaaatcatacaatgttacaatgtatattctgtgtctggctttctttcctttttttttttttttttttttaaataaacccactgccaacatcatacatgtctggcttttactcagaatgatgtgtttgaggctgggcgtggtggctcacgcctgtaatcccagcacttgggaggccgaggcgagcggatcacttgagatcaggagttcgagaccagcctggccaacatggctgtctctgctaaaaatacagaaagctactctggaggtggaggcaggagaattgcttgaacccgggaggcggaggctgcagtgagctgagattgcgctattgcactccagcctgggtgacagagctagactctgtctcaaaacaaataaataaataaataatattatgtttgagattcattgttgggggtatcagttgttccttttcattgctgagtaatgttccactgtatggctgcaccacgtttttggtctcttcacctgttgatgaacatatgagttgtttccagatttgggctattgtgtataaaactgctgggaacattcatgtatgagtcattatgtggatatgttttcacttctcttgtgttatacctacacatggaatggctggattgtgtgacagaccattttccccttaaaaatgttttattatatataaaatataatagaggttagttaggaatggaatgtacaaatgatatgtaactagtttcaaaataaggcttagaagagcttttatttaacataagtataatatgcaaagcagttaaagatttttataagtatgttattttgcataaatttaaaaatggatttaccttaaaaaagtgacataaaacttcagtcacaaactaaatgcaaaaatttattttatattcttgtactaaaaatcacaattttgggctgggcatgatggctcacacctgtaattgtagcattttttgaggttgaggtaggaggattgcttgagcccaggaatttgagaccagcctgggcaacatagtgacactctgtctctacaaataaaaaagaaaaaaattagtttggcacgttggtgcacacctgtggtcccagctacttgggaggctaaggtgggaggattgcttaaaccagggaggttgaggctgcagtgagccaagattgcaccactgcactccagcctgggcaacacagtgagaccctgtctcagaaaaaaaaaagaaaacaaaaaaccccacaattttctatttccttaaaattgagggaaagtcacgtaaaaactagaagtataaattcttatgggtgggcaaatctgcgtaagagggtttgtttttgaagcatggcagatcagagaagacagttgctcttggaaagttctgtcagcatcacacgcatgcctttcctttccgagtttatctagatgcgctgcttctcagtagccggtcgctttgtccacgacggtcctgacacacaatgtgacatagcttcacacaacggccactttgaccctccctccctactccacgtgtatctagaggagaggatcctagcatgccatcagccaggtgtttgcagtacgctggattgatgatgtcattaccactcagtggtgaatcattttaaaaaaggggtgaggtgggggacttcttatattttttaagggattattttaaaaatcattttagaacaattctgcaagggttttttggtgtttgaagtactagactagacaacatactttggaactaagattttaattaaaggttactctaaagaatcagtgattgatgtccccagatgagatagatggcaggagttaaaagtaattaaagtttgcagaagttggtgttttcataattggagtatggcaaatcacctatttagtccatttagtaccttattatacactgtcttctgtcctaactgttattactgctcagttaatgtttataatctactgttagattccctaagggcagtgcacaaaccccatgtaattagggatgtcagcagccctccgattctttgttgttatctttatttatttatttatttatttatttatttattaagtagagataaggtctgaccatgttgctcaggctggtctcaaacttctgggctcaagtgatcctcccgaaagtgttgagctaacaggcatgagccactgcctggccaagagcatgagtcttctggggaggtttggcacttgcctgtggcaccggccttgtgacttgtttttattttttctttcttttttccttataattaaattagagatagggtctcactatattgcccaggctggtctagaactcctggcctcaagcaattctcccacctcagcctcccaacgtgctaggattgaaggcatgagcaaccacgcccagcctgaccatttattgacagtctgttagctgtgctggggtggcatgagaggcttgcctctgattgtcctcatgttcctggtgactctggtgcccctctcccaccctgccctacactcactcatacatgtgccttaagactttgggaaaaggaagagtaaacctttgggggagatttggtaatcctgagtgtactttttcttgctttatgtgttcttgtgtgtcctgtttcccaagattatgaatgtcttggcaggactagtcttgaactaaacaacaacaaaattcatgcgttatagtactacctatggctttgtatttaattaggcattttaacattttcagtatcgtatttaatctgtataatcacattgtgatatgaggtgtgtgaccttacttatatttacatggttaagattataaactgaaatacgttgttgaagttctctctcttggccaggtgcagtggctcacgcctgtaatctcagcacattgggaggctgaggcgggtggatcatgagctcaggagtttgcggccagcctggccaataatgaaaccctgtctctactaaaaatacaaaaattagctgtgcgtggtggcgcgcacctgtagtctcagttactcgggaagctgaggcagaagaatcacttgaacccaggagacggaggttgtggtgagctgagatcacaccactacactccagcctgggtgacggagcaagactctgtctcaaaaaaaagaagttctctgtcctgtctgagatgatcggcagcattgtttatccctgtagccctggtactctttattgatagtagagattttactccaattaggtactttttaaaggtaatttctatgaaaatctctataaaaatgcttattaaaaaactcctttacagtggaaaagagtaataactaacatttccctttttcctcacaagctctaaacctactagaaatagaaaaagaaatctgaacatggagatcatatgatcagccttgtaactggcgaagagagggagatggaggagtccttatttcaaacatctaggaaatatgttgcaaattagtaaaataggttaaatttctccgtttctttcccagtaataggatctttgaactagactatttgaaattatcatttgaggccgggcgcggtggctcacgcctgttatcccagcactttgggaggccgtggcaggcagatcattcgaggtcagggtttcgaaaccagcctggccaacatggtgaaaccctgtctctactaaaaatacaaaacaattagccgggtttgcagtgagccgagatcatgccactgcactccagcctgggtgacacagtgagactccgtctcaaaacaaaacaaaaaacaaaaaagatgaaattatcatttgatataaccaatagcagagagatacctgtactctgattccttcttcgtttatgcagtcaatccttgttatttgtggattttgtattcatgaattttcctactcactaaagcttatttgtaacccgcaaatcagtccaaaggtagtcctttcgtggtcatttctggacattcacagagcagtgaaaaatgcagtttgctcagtgtacacatttccagccactgtgaaacaaggtgactgatttcttgtttcagccctcatactgtaaacaaatgacctttatgtggtctatttagcattacattttttttttttttgtatttttgtgcctttgctggtgacttgctctttaaaatagcccctaatcataatgctgaatttctgtctattgttcctaagtacaagaggccatgatgtgccttatggagaaaatatagtatgttagcgaagctttgctcaggaatgagttacagtgctgttggccatgagttcaatgttaatgaatcaacagttggctgggcatggtggctcacatctgtaatcccagcactgtgggaggctgaggcaggtggattgcttgagcccaggggtttgagaccagcctgggcaacacgacgaaaccctgtgtctactaaaaatagagcccatgtccccccgccatgcgcccatggttccagctattcaggtggctaaggtgggaggattgcttgagtctgggaggtagaggttgcagtgagccaggatgtcaccactggactccagcctgggtgacagagtgagaccctgtcttaaacaaaacaaaacacaacaatatatattaaataagccatctttaaacagaaacccatataaacaaggttatgtattgttcagttgacaaaagtgtgaccagaggtctgtaggaacctaacctgtatttcccctaggagcaacggtttagtcttttccaattcagtgttagcaatgactatttttgttttttttttttttgagatggagtctcgctctctcgcccagtctggagcgcagtggtgtgatctcggctcactgcaacctccacctcccgggttcaagcaatactccctgcctgtagctgtagctgggattacaggcgcccaccacctcacccatctaatttttgtatttttcatagagatggggtttcaccatgctggccaggctggtctcgaactctgacctcgtgatccacccgcctaggcctcccaaagtgctgggattacaggcatgagccactgtgcccggcaacagcaacaactttttaaacaataactactttgaatagcaagaatcagctatagcttagccctcttcctacccctaaacttcaggctgtgacatcccagtgccacatttgacatctcctgggggatacctacagggtctctcacagttggcatggccacagcagagcccctggtgctgtgtccctctttattcaccccacctgagaaatagcatatccgctcacataggtgttcccatcaaatgttttgaatgttttgatatcagccttccctttctcttgttctgcctatccagttcattagtagtatggtttattctacttccaaaacgcatcttgaagtaatctgtttttctgcatctctgctgctgatgtgctagtggaggccactgaattacttgcctggatgccacatgagcttcccgtagctgatgccactctgtgcacccatatctcatgttcccttccttctgggcacgtggagaagcatattctcaccccctggccattgatttgctatccttttcagacccagagggagcaggctaagaaatattttgtggaataagtatgtggtattattttaggagcacttggtatttctttgggtaatagtagtttctgcaatttgaggactgcttctaaacctgttaggaatattttttgaactgtaagggaattttttttttagggcagagaaacatctgaacaatgtattaagtaaaagcttggagaaaatcttgggaaaaaaacacttcaaaaatagattgttttagagttctttttttctgaaaccacctgccttctaaagcaagataattagattttaaacaatggtttctgcttagttaggtttttttttatttttttatttttatttgttattattatttttttgagacagggatctcaatttgtcacccaggctggaatataatggcatgatcatagcttactgcagccttgacctgtgggctcaagcaatcctcccacctcaatctcctgagtagctgggaccacaggcacacccaccaaacttggctaatttttaaatttttttttgtaggggggatggagtctcaatctgtcacccagactggggtgcaatggcacaatctctgctcactgcaacctctgactcctgggttcaagcaattctcctgtctcagcctcccgagtagctgggattacaggtgcctaccaccatgcctggctaatttttatatttttagtggagacggggtttcgccatgttgaccaggctggtcttgaactcctgaccacaggtgatctgcctgccttcgcctcccaaagtgctggctggtctcagacttttgggctcaagtgatcctcccaccttggcctcccaaagtgctgggattacaggtctgagccactatgcctggcctagtttgtttttaaatcaataacaggtatcaagaagtttggactggctgaccttggtggtcttactgctgccacctttgctctgcctcacacagtatgtgggtgtgttgggcccttctcgcaagctcctctgtcatgtgatggttccgtcttcagggctgtggcaggaccgcgctggttcagtttgctctgtgtcagctgagtaaaggatgggtggagtacaccaattttgtaacttgtaacatttggtcttgtggttttgcaaggaaggggtgatatataattagtaaggcaggagagcaaaggaaacaggaaggggatctgcagtgctcctgtatcaaagtagatctccaaagcaacaagggacaaaagcaagcacactcctcccgcccacccgtttttacttactcttatttgatcagagaactttgctttcataaacatccttgaattaaggctggaattttttggtaaaaattcctaactgaatttggtttagaagtatacagaaaacccaatgaattaattgaataatctcccttacccccttcttcagacaattctcctgtattctctcaagtaataaaagtactagaaagatcaattgtatttatcattaaatggctggtgcttataatttattccttgaatccagttaaacagtgagctttcctgataacctaggcattgttgtcccctacagtaacctgggcctgttggatgtgtaaacattttcctttgacccaggactgtgttgaaactatttgttaatcacacagcaggatgatcaatacttacaccagctgacgggacacctggcatgactactcagtgatccagtaaaaccacgccaagctggttccatagagttttcatttttgatgataggactcgtagctctcagaatcagagaatgtttagaggtgaaacttaccacaaatgtgggtcagcatctttagtttgtttccggtgtgtggggtgcagtggcggacagtgagagagccatgtgatgggaggaggctgcagagctggactttgaataatgggtagggttcagaaaagtagaaaatattgtgaaatttattttattttgtttttttgaatgaagcaacaaaaacagagatttattgaaaatgaaagtacactccacagtgtgagagtggacccgagcataggggctcaagggccaaaaatactgtgaaatttattttaatcaaagtggaacatagatatagttttaaagatcctatacaacacaaaattttacgtgcttatagcagcagttttcataagaaccccaaagtggaaacaaccagatgccatcagctcatgagtgggtaaagaagatgaagtctgtccctacaagggaagattctttagtcataaaaaggaatgaagttctgacacatgctgcaacatggctgaacatagaaaacattgtgccaggtgaaagaaaccagtcacacaaggccatgtattaggcaaatctgtagaggcagaaagtagattagtggttgtcaggggtttggggatgcgggaatgggggtgactcctatggggtatggggttttcttttggggatgatgaaaatgttctagaattagatagtggtggtggttgcataactttgtgaacatgctaaaatcactgaatagtattctctaaaaatgtcctgcctctcccagacagtgcctcctccccgcagatgttgacctctagatccttcaagattgggaccgcagtgcagtatttgagtctccccagatctcttcctaaataccagagaatgctgctgagagtgtgcattttcttaaaagtcactcccctcgttagtatacctgtgccactatcttcccacccctcccagggactttttctattcttactctacgagcctggcatactctgggccttcagagcctgatccttagcatgccatgtagttttttctttttttttttttttttttttttttggcgctgccattacctgtgtcctccaatgaactcttgtgttttgaagagggagatactttgttttcttgacctttgtaggtctagctcttggctaacatagtgcttggcacagttcaacagacatcatttagaatgaacacatggtaaagagtcaaatctttttttaataaatcagtgtacacttttattattattatttttgagacagagtctgactctgtcacgaagactggagtgcagtggggtgatgacagctcactgcagccttgacctcctgagcccagatggtcatcacctgcctcgccctctgaagtagctgagactacaggcacgcaccaccacagccagctaattttttagttttctgtagagacggagtctgtttatgttgtctaggctagtcttgaactcctgggctcaagtgatcctctcacctcggccttccaaagtgctgagattataggcacgagccatcacacctggcctttcaaattattactctgatgagtaaatcaatatgtgaagagcagctagaaaatgggagagtcggcattctaaaagtgttaggctctttcagatggaaagtaagagaatctcaggttaccatgtagtgatacttttaccctaggaagacagaggaagtaggaaactcggtcgccgcactgtcactgtgggtcttggagctcgggtctccttgtgggaaagtggcctttgtaataaaatcttgcaggtgttgcgtaatttcattagtctacatggtgaggaatagaggaggttcagagaagaatatacatgtattttgtatacctcagaattttagaaaagagaatcctgaatatttttttggaggagttgaggaagaagtaactgaggtttaaattttatctttgcagtgatgcctgttctgaccgtcttatttaaaacttaacaatacctgaccccaccccctgccacatacttctcttttccccatagcacccatcactttctagcatgttacttattatttattgtgtatatagttttttgcctatgtctgcctgtatagtagaagcctattatcactatccctcaaattagccagtgtgtgtggacaaagggcaaaccaatgttgatattaacaaagccctttcaggaaatcagtactggtgaatatacacataggaactggcacatgcgctgggtagaacatgaattgcctctcctctccctatatatgttcaaaaggtaatgaaatttttttttcttttttttgagacagagtctcgctctgttggcaggctggagtgcagtagcacaatgtcggctcactgcaacctctgcctcctggattgaagcaattctcttgcctcagcctcccgagtagctgggactacaagtgtgtgccaccatgcctggctaatttttgtattttcagtagagacggggtttcaccatgttggccaagatggtctagatctcttgaccttgtgatccacccgcctcggcctcccaaagcgccgggattacaggggtgagccactgcgcccagccaggtaatggaattttttggtgcaatttctatgtcaatcttttaacaatcttttcatgtagccagcagagggcagcacagatggaatttatgacattcagtatttttgactttattttaaagggcgtttaaaactactgtagcaaccacttctaggagtagtgtgaagtttatttcaatttcaggtttcttcttattctttctcgcttgtaaattgtgctgtttctgctttgtctttatggaggaggttatttctgtttaccttatcatcatgaatatgtcaaattaatactttccaaagtctttttgacatgtttccagatgcctccgagggctgtggtgaggttggcgatggtgggtcctgaaggggcactgttcttttgcctccagaaagtagcaattacttgaaccagagttcttcgaggtcttcccaatgctcccaggctccacggtgcacaggagactgcagtcctggctcaagggtcctctctgagcatctgaccaatgctcttgacccccttctcagaaagaaaaatccccaaaatgtacatactcaaaaccacacagtttttcagttttgtggcaagttatggaactggtcatggattttcttgatagaaactaaataagatcagtctttgtgatgcatacctctcttattttttttcttgcaagagttactggtccttaggcaaaaattgaagtaaatgcaaattgtgtacataaaacaaaggatatggtttaggttttctttttttttttttttttgacatctaatcggttttgagtttttcttttgataacaaaagtgctaaaaagtctgtgtcatgaaggtatgtactagcaaatgtgatcagaaatcccatagcttgctttgctaggtacaaggtaagcctatgtcaaggaatggcaagttctttgaattcttgttgacacattacatatatcctttgccatcaactcttttttcccccaaggtctaatagatgcatttatgtcaatacacaaaaatagtatacctctatgttttttaggtaaccaaagtagaaggaacctttgaaagaattgtgcagtgtgtccaggtgtctggatttctgcctgcagaggctggacaagtctttgttatgctccaccccaccttgcagatgttcttcgggactttggaggacacttgcgtgattgtatgccctaagctgtctcccatttggcagcttgttaggaaaggtctaagctgcagagagaggataccaggaagcaaaatgatttacccccaaattccagaaaggctgcagggtacccagcacctctgagaatggagataaggaaacgagggtggtttgaaagtgttcattgttggcagttaagatttccaggtctcctctccatctcctgcagcaaggcagtttctcttgcacttctggtaaacatgaaggtttaatttctgaagaaggctgtgaagatacagagagcgagtgaaaatctatatttattttaaaaaataccaaccaagaagcagcaccgaaaaagcccgtatatttaactgtgagattcccatcctttcttcctcagtgtagcccccacaaatactggtggtcagttttacactccacacagcccaggtaggggattggagaatacttctttgggtaactagtctaagcaaaaataagctaccgagccccacatgtggggtctctacacattactgccttatcatattacattgccacacatcaatctataggccatgcctaccacacggcttttaaccaggttattagtgtgtcactcttaaatgagaagaagtagactatgcttgctagagacttaaggaaaatcttcagtgttagcaagcaaaagagcaaatagtttaaggaaacaggtcatgggacatgtagaagaaagccttaaaaagtatatacttaagagtctcagatattaaatgaatgaaacaagaataggctgctatcaaaaaggactatgggttgagtatttcttatctgaaatgcttggaaccagacaagttctagatttcagtatttttttggattttggagtacctgcattgtacttgccagagcatccctaacctgaaaactggaaatccaaaatgctccagtgagcatttcctttgagtgtcatgttggcactcacaacgtttaggatttgggcatgtttcagggatttgagatttgggatttgtgttaggtagacagcttcagaggccatgacacgggagcgaagctggaaagtaagactgctggctggagaccagtgtggagtctggtgtactgtggacgagaacagagaaggaggggctggtgagtggacggagatgatgggagaattctctaccatcccaccgcccagagataatgattgttaatgtgtttagtatatattcttcctggcttatttcttttttcatttttatagtctatgcatttttgttacatgattttttcatttaacagtataacatagacatctttctgtctctacaaaaatagttacgcaacattttccaattactttttttaagtgccaaggaatacttttaagtaactcacaggacaaatgcccacactaaataaatacaacagaagctctgacaccaccacaccacagaagcgtagacattaaaatactacattatgtctgtctagttggcgtgtgttttaaatgataatccacactgtgcatttagctgtggctaggctagcactttattttttattttacttatttatttatttattgagatggagtcttgctctgtctcccaggctggagtgcagtggcaccatctcagctcactgcaacctctgcctcccaggttcaagtgattctcctgcctcagcctcccgagtagctgggattacaggtgcgcccaccaccacgcccagctaacgtttgtatttttagtagagacagggtttcaccatgtcggctaggctggcctcaaactcctgacttcaagtgatccacccaccttgtcctcccaaagtgctggaattacaggcgtgagccagcacacccggcctatttatttttgagacagggtctcactcttgcctaggctggagtgcaacagcacaatcatagctcactgtggcttcaaccttgcagattcaagcgatcttcctgtctcagcctcccaagtagctgggaccacagacatgtgccaccacgcccagctaatttttacattttttgtagagacagggtcccaccttctctcccaggctagtctcaaactcctgggctcagtcagtcctctcacctcagcctcctaaaggcctgggattataggcatgagccactggcccagcagggcagcatgttagaagacagctggtaaatgaaaacagttattttggaaatcagtttcatagcagtgtatagtgagccttaaagtagttcgtatcttttgaccagctcttaagcccacttagagaaatttagcctaaggaactagtaggagctgaggaggcaaaggttacaaggatgttgcagcattttacaggatataaggaaagaaaaagattaatgcccaacagtagaagtggttaagtaagttacaacatatacataatgcaaccattaaacataccagctccttcaattccattccaaccttagggttctttctagccttcccccttttcatgtttccaaattccttttcctgacagtgggaaacctggcccccaggatctggcttgagggttgcacccgacaccttccttttgcctccagctctacttcctgtccggctccatcctgctgtctgccggaggctgtcctggagggagtgtggttcctggttgggtttgaccaggagacgcaagggtgagagaagagtgaagtcaaggtgattctctcctgctggtaactgaggcttgctgaatcctctactgacactcttgccagagagctcccatttgccacttttagcagcagtatgatgccctcgcaccccgtcttgacttagcagtgatgggggctgcccctgttgctagtctggggggctttattactccttggtgtcctctctaaactctgccctcacttttataggtggtgcctatcttacctttctgcacactcccactctaggaatgtttctgtctctgggataatgattgatatgggtattatgctttcaaaaaacaaaccttccctagaatattatataaatattcacgtttttttttctactgtcatttatttaatttttttgtagaaataggatcttgctttgttgcccaggttggtcttgaactcctggcttcaagcagtcctcccaccttggcctcccaaagtgctgggattacagacatgaaccacaactcccagcctagttttgaaacattttagaccattacatgcttgtgtattcccacctaatctattgctggagggggtgaggctaaaatctatttaagggatttattaattaaaaatataaaatgtcttgaatcaacaacacttgcatcaaaatggcctaatgtgtgctttttaatgtgaatgacgaacgagtgttttcttctactttgttgatttattgcttttcatagggcctgtgctagctcctgtatgtttccgatatcatttgttcagacactgctctgaggccctagattattgttctggttttgtaatgtgccattatttttttagttattttaaagtgtactttgaaactttttaaaagcttccatttaaataaatacgtagtaatctaacactctgtttgggattgatgttatagatatgcctcatgagttgggttattatatgttttagtttcccagagacaatcccagtttatgctgactgcctgatgtaattattaatagtacccatttgcaatctcaaaaatatctcaatatggatgataaattatatggtcacttatgagtgagtgaaacatacaatttggtgatgcagtggttaaatgtctattttaaggaattggagacatgagattcattatttccttttttaacaaacagtggtaattgttgtactagagatgacagtgtggtgttgagccaggtatgccttgccatgcttccagctttaagggacgctgcctggccaggagcctatgaggtggcctgctgtgcccaatagggatgatggctattaaacgagccagtcagagtccctcttttgagaatgtgaactggaagtataacaagaatgaggcattgaatagtgggagcagaagctcaaagtcaaaaggtctggaggagcaggggacctgtgaggccatgggtgggtggaaggaatgatggggcctttaaggcagaggctgtggggagtggagatgggggacctggttggcagcatatcagaagatagcagctccaggcctggtgcaatggctcacgcctgtaatctcagcactttgggaggccaaggtgggtggatcatttgaggttaggagttcgagaccagcctggccaacatggtgaaaccccgcctctactaaaaatacaaaaattagctcagcatggtggcaggcacctgtaatcccagccactcgggaggctgaggcaggagaattgcttgaacccagtaggcagaggttgcagtgagccgagatcgcgccactgcgcttcagcctgggcaacagagcgagactcagtctcagaaaaaaaaaagaaaagaagatagcagctccattctttcacttgccaggccagaaagctcggagtcacccttgacttctctcttttacacctcacgtggactccattgggacatccttggctgtaccctgaaagtaaatatagcaagaatatggccacttttatcaagtaagccgccaacccgtctcacctggatgactatagcagccccccaactggtctccagctcctgtgctggctgtctccagtctgttcttccccacagccagagtggtcttgttacaaaggaagccacaaaatgctctgttgctcagaaccctggcagcagctatgcatctcacccagaatggaaaccagagtccttaaaatagctgccaaggccccatgcagttcgcctaccaccctcctcacctctgcgaccatatcttccactcctccctacactgttcttcctgctccagccacagtagcctcctggcccttctcagcagaggccttccctgactgcacttccacttcccccactccacagtacttattttctgacatactgcatattttacttacttgtttccccacctttcccatctcgttagagtggagacgccacgagggcaggcattttgtctctttagtcctctgatgtctcactagtggctggcacttaatgtgctcagtgaatgttgaacgaaacagataagacaaaagatacaactatctttgtaaaaactttttaaaaacaagtgactggttatgacaaaatatttgtaacatttcatacaaaggatttgtaatctacaaatcatttaaaaaatgataagcaatagaaaggtgggcaaaggctttgaaaaagcaattcatgaaagaggaaatacctcaaacttacgaaaagataatcagcatcatcagtaatcaggtcagtgcaaatgaccaacaacaacgagaaaccgtttcccactgtctgactggcagaagttaagtttggtcccatcagggacgtggcaagcactttggcagcatctgtgaaagctttaagtactcaggcctcatgaccagcttttctgcctttgggtgtctattccagagaaacgctataccatttgacagtagggagaaaatagaagtgacctgccctcttacaagttgggatcactggctgtgaatcagacctgataccagaagatagaaatgctgtttgggaatcattaaacataggttttgaaatggtgcaggctgggacttacaactgtgattttgacatactaaaccaaaaggtgacacgttgggtttatattaattgcctctacaaaacaaagtgttttttttttttaaatatatgcatatgtatttattcaactgttattaggcaagaaagaagagaatgtgatgaagtctttgccctggagtcatgtcagcaccttcagagtctgactggagacagcgccccgttgtcttgctgtagatgtgtgtgttcccagctccccagtgagacttggccaaagtctagcacttcctgcaaagctgctgcaggtgtttgcatttacaatgaagactaataggagaggggtttgggagtccagcagagagcagggtgcggaggatgggctctgcagccaggtctcgtgctttggcaagccatgcaacgtctctgggtgctagcatcctcatctgtgatctggggatggcgaggacactcaccccatgggatgttttcaggattagatgagttaggtcacatcaagctaggcacagagtaagcatgcaataaatgttatctattacgatgatgaggtgggaagctatgtctggatccagcagttctacttgtgagaatttttttctatggagataattaaagagatgtgccgaaacgtgtgcacacgtgtattgagatacgtagaagaattggaaatcacttagaagtcttacaatatgggactggttaaatattatgtctagactgagaagaataataaatgtgatagatgtccatttacagtcatgaaaaaatgttataagtaaaaataagtagctataaaacgacatataaaatatcgtgtgtgtgtgtgtgtgtgtgtgtgtgtatctatagaagagagagagaatatatataatacttataacaaaagtctggaaaatgtctaccaaaatgtcaccaatggctatctcttggtgataggattaaggtgttttttttccttgttactattttctaatcttcaacaatgaatatgtgtcatgaacatgataggactgtgcaggcaagaatctttgggtgcagcatattagaaatcataatggagatgaaactgaacttagattgggagtttggcccttggattttttttttttttttgcctctaatatctgctttctgcttttagcctgtgacctcataacatgctgtaatgattacgatctcttagtcatgctcttgggaaatgggctattatctcattgtgaggggaccagggattttaatgattccattttaagaaaatgtagtcggctttccatgggctccccatccatggatttaacctattgtggatggaaaatatttggaaaataaaaaaaggtcacacctgtactgaatacatacagacttttttcttttcattttctttaaacaatatagcataacagctgtttacatagcagttacattgtatttggtattagaagtaatctagagatgatttaaagtatatgagtggatttgtgtagcttatgtgcaaataattaaggactcaagcatccgtgggttttggtgtccatcggagttcctggcaccagtcccccttggataccaagggacaactgtacttgaaagtgaagagaaaaacagcagtgagtcctggctatgactttggttgagtttgagaaaagactagaagtgtggctactaaactagtttgactccagtgtaagattgctttcagggaagcagatggttaacacactcggaaggtgcttgagctcgacttcaggaactgggtggtggcactgactgggagtgccgcttctttggaggctggaggttgattggcccaggcgtgcagccagccattgcctgtctgttcaggaagcagctctgagctgccctagtggctggacagcttcacaggtatccccggcccctcccagtcagaccccacaggaaaacttggctcccagtaagttaccgctctcctggaagcacagaacggacttttcgtgtcccgctgtaaggaaacaagatggtccttaaaaccgaagaggaggacggtgagtcaaagccgcagcccccggccgggactgatgcggcttggggtatatggagtggagttttaggtatctcttttcattagtatgtgaaatcctgtgaggatagtttactgagccttttggggaggagttaaggaccaacctagactctggtttttatcttactgttttcaggagaaagactgcatagtctcttagtggttaggaagctgaggctctctcgggtgtgtgtgtgtgtatgtgtgtgtgtgtcagagagtgagagagaggagagagagagaaagagcgagaagagagagagatattaaggtaactcagtgtttttaaaccaaagaagttctcctccaatctttgctttcgttagagttccgccttgggtgtttcttggtagattccacttcatacttggtgattgtgtctacttcctgtatcaaaataacagttggtcagaacttctgggaattccacaaatatccagaaagaatctgatactaaaaagtaaagacattagagatcggattgaaagaaccagtgagatttgggataaatagtacttgttttgttaaataaaatgtgtctaagggaaaagacgatgtggtcttctccctttggttgttaggtgaggactgtttgaagcctgggagggcagggtctgtagaacttcctttatctgctccacacctgtactgtaaacagtggagctatgagtaatgggatgacaagctgtgccttctaaatcccaagagattctgctgaagagctgtgtcttaaagccctgggtcaacacaggagttgtgtttgtggatgtgtgtgtgttttattgtattttattgtggcaccttatcagatggtggtgttgtaatgctgcaagacaaaatagtaaaatgcgtactgggttgtagctggtaatgtgtgatatttttaagtttggaataaatatctggctatgtttcaagtggattttgtgaaagttgtaataaaacttgggtgtcctctttaggcttttcccactctggttcactataaagcacatttgaaagccccacctctaagtgcaaatgatcctggacagtgtccacgggcgacactgaaagctgcagcacgcgtgggggacgctgggagggaagcatgcacaggtgtccataacgatacttctgtatctgaagaggggtcagtagtgaggggacgtgccaggccagggctgaactgcctgcttggtgcttttctaactgaaaggtgagtccacactagccaagatctagttccaaagggaacacttttgagagtggaagaggacactagtgactatgctgggacagcaggagtgagccgggcctggccatggtccctcacgcttacttgcttctggtccttccgggtgagcctagcttcagacccaccggaggtgctgtgtaatagtcactttttatcctggaggcttcaaaagtcaacataaactaccctaatcaacagtgggagtgatgggggtggggcatgaggttaggggccgggagcttagaggtagaattactgaacagctttgctttgaccaagtaaccttaaagaactggtgcttcttcgcttcccttaccccctcccatggtatttccttgtgttgtcacctgggactgaaggcagtgttgccctttaaaccactgctaaaatagatgcccttagacattgccgtgagagacagagtggcatttaggtaggtgtaaaaggagggggacaaatggagtttcctctggcaggtccctgagatcccaggggagggcagaagttaagagtcagttatgctttccatagagctgcttttaactagacttacgccctaaagaacacgcctaagaaagggtatgtgggggtttttgaaaatattctttaaggaagtcagactcttctgctgcattaatctcaaacccacaatttttaggttaaaaatattgctttctggctgggcgcgatggctcacactgataatcccagcactttgggaggcccaggcaggcggatcacctgaggtcaggagttccagaccaacctagccaacatggtgaaaccctgtctctactaaaaatacaaaaattagccgggtgtggtggcaggagcccgtaatcccagctacttggaggctgaggcaggagaatagcttgaacccaggaggctgaggttgcgttgagccgaaatcgtaccactgcactccagcctgggtgacagagtgagactttgtctctaaaaaaaaaaaaaaaaaaaaaaaaagcttttttttacctggtacattggtacattggtacatacattcgtcagttttcattctgtatatgtgtgttagtgagaattaaccagtttaattaattgggcactattttcttaactgccataagttattattatttttagctatttaatcttgttaatgtcagtcccccttgatttgcctttttttttttgagacagagtctcgctctgttgccgaggctggagtgcaatcttggctcactgcaacctctgcctcctgggttcaagcgattctcctgcctcagcctcctgagtagctgggactgcaggtgcatgccaccacacccggctaatttttgtattttttgcagagacgaggtttcaccatgttggccaggcttgtgttgaactcctgacctcatgtgatccacccaccttggcctcccaaagtgctgggattacaggcgtgaaccactgtgcccggccttgatttgcctttgaactctctctttggcatctctttgggatagattccaaaatctttggtgtgggacctgaggcccttcacaggcagacactaagcccccttcagggtgccagttcagccctgctgtgtcctgggccttgccctgtggtgtgcccattgttgctggcctctgtcacttccatacactttatcttgcttggtatacaccattctgttcttgtccatctggggaatccgttggtccttcaagttctggctcacaggttggcccctctgaagcctcttggcatcgcctggaattctgtgagtacttgctgcacttggccgctgtggccgggtgtgctgctgctacgggcttacatgcctgtccccactggccttcactttctgtgcaggccagggactggagctgtttaaatcccagctccaagcacaggctgcgcctatggcagatgctcagtaaacgctgagctgaagtgaatctgtgtatttcagtaagagaaaaaaaaaagagctgaggatgcagccggtgaccggaatgtgaattgggctctattggtagtgtacccgaggtagattatttgtactcattgagtctttatcttacctgtaaactgatgagaacagtgtatagttcattgtcaggaaatatgcagagttacagttgagctttgttggaaaatttaaaaaagtggaaatgagaaaacattttaagctgtaagatagcatgtgtgtataaactagtattatttgtaggaaaatatgccaaatagaatgaagtataggcttcctcagtgggacactggattttcagattgcttctaaaatgctgtccttgacgtgaactttccatgttatcctttttttttttttttttttttttttttttgagatggagtctcactctgttgccaggctgggcgtgatcttggctcactgcaacttctgcctcccgggttcaagtgattctcctgcctcaggctcccgagtagctgggactacaggaacgtaccaccacgcccggctaatttttgtatttttagtagagacagggtttcaccatgttggccaggatggcctctatctcttgacctcgtgatctacctgtcttggcctcccacagtgctgggattacaggcgggagccaccgcgcccggtggttatcccatgttttaatgcgtgccatgtgattgtggtagtctctagttggacaagttgctcaggttgtggtgtttgcaggaagacctgaggtgctgtaactatcaattcatatccccctagatatttctcactcccttccttatggattttgtattttgcagaatcagaaatggttacatctttatttttaagcaggagcatgtttggcattgtacaaagcacacatcatagcaagaaacctgtatcaccatctgctgtgacaagttttgaagaggattcactctggtttgaattttataggctttcctgttgagtacaccagagatgaatgctcacggtattacacagaggattagaactgccctttcttcttaatgaaggtgaatagaaacaagggcttggattctgcccctctgaagaaagctgacccttatccattatctgagtctttgtgtagcctcccaagttttctcttcattatggaatatgaaagcacaggactggctgtgggggatcaagacccaaagtctgattagacaggagggatgtggaaggcaacaggtggaattttctaagatgtcagtatcggtggagagaaaaggcaggtatcttaggtcttggtaggcacaggtctgggcattaagagcctttatcagcctgcagcgtggtcagccgaagggaggacaaagtcagggactgtagatgcagataggaggtagagttggagcaggagtggccctaggaaacagcagagattcccgttttcatccacccctccctgtgcttcaggagggttcgcaggaacctgtgtgtggctgcaggctgacagaacctgcatgcagtttactgctggttaaatcagagatgctgggctagacctcctggaaatttttagtagtatccatctctcatttttcccttggattttgataatcctgcaaaggcaactttactggatttatagtgttcttgtctctgcctttctttctgttttcagcctagctgagatttcctttttatttgtttttttttgtttttttttttttttttgagacggagtctcgctgtcgcccaggctggagtgcagtggcactatctcagctcactgcaagcttcgcctcccgggttcacgccattctcctgcctcagcctcccaagtagctgggactacaggcgcccgccaccactcccggctattttttgtatttttagtagagacggggtttcaccgtgttagctaggatggtctcgatctcctgacctcgtgatctgcccacctcggcctcccaaagtgctgggattacaggcgtgaaccaccgcgcccgacgagatttcctttttagaaaaggactcttaaaactgccaccatcttctcctgtttaccttcagaagaactttaacttgtggggaattcatatgggttttgtgttacggctggagccattaagtaattacctgggacagagtcactaacagtagtgtaatcacagactcttaaagccatgaggtgccttagaagttatctagtctagccctggtcagttctgcaaatgaaagccattgctgtggctcctgggaaggactctgaaaactgagtccaaatcagccaggattttaagtttcaacagccactgttgagttatgctgatctcctgccttcatatattccaagttacctttttgtttttctcctgactatgtgatgcgttgattctgtagccctaggtaatacactaggggaaaaatggagacagaaaagtcaaattctgctttcctgtagatcagctggtgtgtgaggactttccctagcacattcacttcttccttaagaagataatttcggcccgagcgcggcaattgcaaatggttaacctcttatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcctgggcggacagagcgagactccatctcaaaaacaaaaaaataataataataatttcgtaacttgtatcatgttcttccttcctctacagaggaatcatggaagctcaatttctgacctaaaaaaagatgcagtgaatttctttttttgagtcagtgactgttgttttttttttgagacggagtctcgctgtcgcccaggctggagtgcagtggcgtgatctcggctcactgcaagctctgcttcccgagttcacaccattctcctgcctcagcttccagaatagctgggactacaggcacccgccaccatgcccggctaattttttttttttttttttttgtatttttagtagagatggggtttcaccgtgttagccaggatggtgttgatctcctgacctcgtgatccgcccatctcagcctcccaaagtgctgggattaaaggcgtgagacaccgcgcccggcctagtcagtgactattgacgcctttccttctggtgtctaaagtctctttccctttgtgttttctgtgaagaattgggattctgagtcacagaattcagacgagagaccacatacgaaatcacagcagaatgggtgtagttacaacaggcacttcatgggcattaaaacagaatccaaggatgtttcttctataatagaaatattgggccagtctgagcaaatataagtggctgggggcatttctgtattttctttgaataaaaacttcaacatcaaattttgtgttagttgtggatccagatatacagataggcagaagaggaagagtccaggcctcccccactctctttccacagtccttgctttgaaaggtgattcctgctagcagtttcaagtgtgtccttctcagaagctccctgtgtgtttagcaagcgtaggtgttacttgtgagaaggtattctgtgccatcctgtttcaccagatgtgtcttagagatcttttcatgttagcatttacaaatcacctcattcttttaaattaccaagtagtttttaggtagtttaaaatttttggaatttggggagcatatccactcttaagtggaatttaagaatcaaattcataagtttgattcaaatcaaatcaaaaggtgtgtgctctttatgttttgctagtgccaaaaggttgtaccagtttacactctcccagcagcacgggagactgcctgtgtagcccactcccctgacagtatttcgtctcatctggcattctgattcctgccagactaatggaaaatggtatgttattcatgttttaatttgcattaaacacatagtgactgtgagcatcttcttctgtgtgaccatttgtatttctctttttgtaatctgtcttttatatcctttgctcattgtattcatctttgctttactaatttttatgctgctttctttgtgacttaaataaattaaccctagccaggtgtggcacatacttatagtcccagctattctggaggctgaggtgggagtatcgcttgaggccaggagtttgaggctgcagtgagctatgatcacaccactgcactccagcctgggtacagagtgagaccctctctctaaaaataataagttaattaatttaaaaaaagatattaaccctttgtcatatgttttgtgaatttattgtcctagttgtttaccttttagcttatgggatattatttttcactcagaagcttttcattttcatgtcgcaaatgagcagactcaccaatattatgactatactaattcatgctctattctagaattattcaggttttattttacattaacatctttgattaagctagaattcatttcagcttagttttatcccaaatggctagctggctatttatttgctcagcacccttgactgaataatcctatttttctttaccgattcaaagtgctacgtgtgtgtttcagtatttcttgagtttgttttctggtctttttcttccgttgcagtttcaattaccaaagcctcacgtgctttaatctcaggtagctacaccctcacgttaccctttctccctttcatatttttctgactattgtcatatatattttttcccatgtgaagtttaatatcctttttattatatttctgtaaacatcatgttggtaatgtaaataatttttttttttttgagatggagtttcgctctcattacccaggctggagtgcaatggcgtggtcttggctcactgcaacctctgcctccctggttcaagtgattctcttgtaataccagcctcccaagtagcagggattacaggcatgtgccaccacacctggctaattttgtatttttagtagagatggggtttcaccatgttggtcaggctggtctcaaactcctgacctcaagtgatccacccacctcggcccccaaaagtgctggaattacaggagtgagccactgcacccggcgtaaataatgtttttaaacatcgtggtgtatgtacgagaactttgattactggggtctttctacctttgctcaggtcccctttgttttccatgtttctttttcctgtctagatgagaggctggccctgctgcaggaaccagcctggcttggggaggatttaccagtgtttggggtagaatagagtttgtccagagaaactgactatatcgtgccacctagaggtgggcatccatttgtcgtggagggaggccataggacacctgcatgatatcagggactcactgccctctcatgggtcagcacctcttcagctagttctggagtgggtgtgctgccctggatctcaaaggtgcagagcttggcctgccttctgctcctcctcactgctctccttggctgcccctgccataggtctcgtctttcttcctcctacagttctgccccctgcatgggcaggagataggggacggtccaagagcagcctcatgagagcagccaagacagagaagaagaagcctgccctcctaacacactgagttggcaccagaaggatgcactcgccaggaggcttgggtcggccgtgcctgctccagccttgccctgctggtaggtggaggcagggggccagtatcctggaccttcccgcgacttggaaggctggtgccctagtcagctccttcttacacctctcccaaacttttgcaaacccggactcggggcaactctggtaagggtgatgtctggaacagggagccagtttgtttctattttgaggtgcaggtagaaatgaccttcctttcaagagatcttcaaggacttctcagagcaggaacagatgccagtttttgcttctttgaagaagattttatgctcctagcatttactaaagaataatgaggcatttttaagtgtaaggagtggaatagaatttaaagaaaaaagtaaaaaaaaccccaggcctctgttttcatgggacacagaaggaggggagattgagaatgctgactcgcctaaaagctttatgcttatcatgtctgtggtgcttggagcctgtggcccaggtgatttggggtttggggacgcctcatgggcagagaggacctttgagcagcattgtgaattcgtgggtttgggatgctgatgaaactgcgagatttgaatgtattccttgtgcctcattttccgctttagaaataaaatgattgatgcacattgcccttgcacgcttgtcagagggtcactttctggttgcacctgtccttgagcctgagagagagaactggaaagaggatgggaagtcagtagtggtttggggaattagtgctggataaggatggtagttgaaggtgtgagttggagtagggcaaaaaaccacttatttctttgctaccgcttctgaacaggagtgcagaccgcggtgcagtgaagactacgcaaagcttccagtcccttttctttctcatggcgcctggctgccgcttcttgctcttccagaagagcttctttatctctcgcccaactcaacagcagaatagaatccacctgtctcggtgtcaaattcaaaggcaccacagtctgcctggagcttgctcttccagactctgtcccttgtgttgccctttccacctctgcctggactgccctctcccaggctctcgcgtggaaccgtcttggactaacctgggccctgctcttctctgagccccactccgcatagcaccttgcagacagcatttatttggcatttacgggctgcctgtttcttttttctttaaaaggaatagtaacacatgagctcttggagggccgaaaccatgtcttttcagcattgtgtcttccacagtaactgacagggggcctcttccacagtaactgacagggggcctcgtttccatgcagtgaactttttaaaagattgttgaggccgggcgcggtggctcacgcctgtaatcctagcactttgggaggctgaggcgggcagatcacaaggtcaggagatcgagaccatcctggctaatggtgaaaacctgtctctactaaaaatacaaaaaaattagccaggcgtggtggcgggtgcctgtagtcccagctgctagggtggctgaggcaggagaatggcgtgaacctgggagacagagcttgcagtgagccgagatcgcgccactgcactccagcctgggtgacagagcaagacaccgtctcaaaaaaaaaaaaaaaaaaagactgttgaattatgagtctgagaaattattttttaaaacgttcatgttttctgttggtcctgagattcctattctgtggccagtcgtttcctgtgattctctctgatggatgtggtttcataagcttgattgtgtggtatatattgtggcatctgttttgttcagatatgaggagggccacactgcagacttcttggttgcagcttttcttgtaacttctttgtccactgacatccttttctcatgttgtctgtgcctagaattaactgaaagtgcaggtttttgccacctgcagtctctggcctgggtcaagctaaagcctttgcctaggttcacacaccacaggtaaaccccggctgtgatccactctgtcggcgtagtggaagctggccatgttaaagagagagtcatagtgagccttgcacatgatgactgagtcttctgtagagagtcacgggtcagaactcacctgctgggctctttcaatccctgaagagagtgtgtatgtgtatatgtgtatttgtgtaaaaaccagtgatgtcacctcaaaataagacagcccttaggactatgaaaagtgctatgagaatatttacagtacaagatattactgaaaagcaagagcttaatctcacatgaaatccctgggaaacatggtggtagataaccagcgtggatagtccaggctgtcttcactgagtttgtttgtatcacgtaatttatcacctggttatttaccaagtgataaagaaggtcatcaggtgatggttaatatgggtaaactgagcagggagcatggctggaggaatctgagttctccctgtaggaggtaagactcgacggatggcggatggtgaggatgagcttctgaacaagaagaaagaagcaaagagatgtaactgagtactctggtggatcccgggaaagtggaatcttccttggactgggaggagaggtgggatggcttactagacagtgagaaggaggaagacaggggcccagggacgtgttgcactgggactctcaatatacattttgtagaatgtagaattttagaatttgtttttcatggacttagtatgattcttttaaataagtactactctcttgacactaaaagaaaattgttcacactatggctgtttcttgaaagacaagatacaacgcagagccagggtatttgggtcaggcctggtggcactgcctggtgatgaggacgtctgtttgcattccccagccagcccaacccccatggcatggcagtggaggcagggcttgcagaggggcgggtgccttccatgactgatttcctaacggcaggagactggaaaggagggagggtatgggagtgtttttaggatttccaccccctcttccattgtttatctagagcaatggttcttaaccaggacagttttgtcccgcaggggacattcagcaatgcctggagacatttttggttgtcaaacctggttgtggggaattgggatggggatgctgctggcacctagtgggtagaggccagggacgcagctaagcaccctgcaaggcacagggaagcccccaccacaaagagtgacctgctccctgtgccagtaatgcccagactgaagaaccctgctctagcacggtgatttcccttttactttctctccttggttattttagaattgtttaaaaaatatctcctcccttcttagtcaaaagctgtgtgtggtctgcagtaaccctgtattctgtgtcacttaggggcctgggtctctggagttcatgcttttgggactggggtcccaaatctgcgtgtttaacaggcgcccttggtgattctcgtgccctctgaggtttgagagctgctatcctcaggctgtagccatatttcttgtcaccagccatcttgtattatcatccccaaggttcgcttgcctaacattccaacctgataataggcaggtgtcctcaaaggcgatgccacagcctctggtgaagaaataaccattggtggctgcgagtgtactgagtaggaggcgagtccttcttggtgaaaaggctggagtgtccctcgtggaagtggagggcatgggatccctggaggaagggagcaaaggatactcctcctgaagcccctccaggacggtgttggagcagtctggtcagtgccactttgcctgctgacctgatgcggggcagtggaaaggactaggcttgtgcctttggggtgacagaacatccaccccctagatccagtctcttgtttatccatgcagaaaggagagggcatctggagtaaggttggcattcttgcagtgaaagcaggcattaggcttttgcttctgagggagagaggaaagcaagtgcagcctgtgcgcaaatgctggtggtgcctcccctcccccccgggaggccgggaatgggggatagtaggaggggctggctgtgactgcattcatggaaatgagcctggaggagcggagcagcacacactcggagcgtctgctagggctgcagctctgcgcgtccatctctgcgctctgcgccagccttccccaccgggcccagcgagtttccacctgcagggccggtgctctcagcttttgttttctctggacaccttcttctctacccctgctgtgctggcgcacacatgctgtccttgctccggctctccctgcacctacagctgtgggagctcccggcagcctggtactgtggggtcgctgcacggagccaccatggcctctgacgtggagagctgtgacctgccgaggctttgatgttgctgcccagggctggccaggacactggggccgcaggagaggggactcaccgtgggtaagaggctggtggatggcgtgtggagccctgtcagcagatttcccattatgcgttgctgcctgcctgcctctcccacccagcagccagcagtaggagctgatgtgtgcgtggctgtctctctgcatgtctgtcctttgggtctgcattctatgctctcctctgaaggtttttccactacacttttggataggtatccaggcattcagtgtcgtttcttctaagcctgagacttaggaacatgccagtagtcaatttccttggtccagcttccgtgaggtttgaaataggggggcagaaaacagcgggacagattcagggtgatctcccctctaggcctgccacccgtggagtttctgttttactcggtaaggacttgggaacctttcctgggcacgagtagtcctctttccatcaatacacatagaaaaggagttggaattgtacgtcgcatttaatgctaggggtcctttccagctgtcagactgagggagaatatttcaatgtacagaaaaattcagagcattacaaagggctagcaaacaaacagatctgagccactgagggtaaagtgagagagaattgacttccaagccaccaagcctctcttttggacacggaaggggtgtcgtggcccagctgtgcaagctgacagtggttgcagctggcaggcacggggagtggcagcttcacccaggggacaggagcctgcccccttgggaggaggggcgagcaagctgttttggcttgtttggaggaagagggaactccaggctttccctgggagtgaaggagcaggccacttggctcaaggaggctagggctagaaaatggttcttccctgtggagctctgcgcccagtccctgggatcctttcgaaacagcagtggagtgctagaaagaagctgctgggaaaccccagctatgtcagctatatcaggtgttgtcactgtgagcttttagaaaaagttaaggttcttaaaatggttgttttctagtttttagcttttattgaaagcggatgttaactttatttttctaaaccaaattcgcaggataaaattttgtcacttaggttctgttactaccttgaaatgcaagctaagtctttgagttctaggatttattaaattaaattttttgataccttacttttttgttttgtgagatggagttttgctcttgttgcccaggctggagtgcaatggcgcgatctcggctcgctgcaccctccgcctcccaggttcaagcgattctcctgcctcagcctcccaagtagctgggattacagatacctgctatcatgcctggctaattttgtatatttttggtagagatggggtttttcaccgtgttggtcaggctggtctcgaactccttacctcaagtgatccacgagcctcggccttccaaagtgctgggattacaggcgtgagccactgcgcccagccaataccttccttttataagatagttgagaagggctgggtgacatcctcattacataagtgaggaaactgaggctggaagaggtgattgtttgctccaggtcacaaagtagtgagtgaaagcccaggcagcatcgcctgtgaacgtgaggagctgtcagatgagacggctccaacactgagaagaggaccgaagtcttccctgaaaatgcagaatgcagtaataaaagcctttaatagatttactgttagtggggaaactgggtagtttttgcatggaagaaatttaaattagaatagtctaaatattcatattggcaatttgccggaaggcacctctgcctctatgttgaataccatttctgctagctgcctgctaatttaactctttttggtcctgggtagtgtgtgtaaatttttttatttttattttttgagacggagtcttgctctgtcgcccgagctggagtgcaatggcccgatctcggctcactgcaacctctgtctcccaaattcaagcgattttcttgccccagcctcccaagtagctgggactacagctgcatgccaccacgcctggctaatttttgtatttttagtagagacagggtttcaccacgttggccaggctggtcttgaacacctgacctcaggtgatccacctgcctcggccccccaaagtgctgggattacaaggcgtgagccaccacacccagttgtaaattcttttaacaaatctcttaggctgcaaattggtggtgagatacttattttaaaatgcactacgcaaaagtcaaatcatagtttcttgggaaaggaactaaggtaagcagacagagaagttagaatatgctgtgaaatttttgtttattttatatttttatttttttgagagagggtctttctctgtcgcccaggctggatgcagtggtgcaacctgggctcactgcaacctccacattccagggcttacgcggtcctcgcacctcagcctcctaagtagctgggactacaagtgcgtgccaccacatgtggctaacttttgtattttttgtagagatgaggttttgccatgtcacccaggctggtctcaaactcctgagctcaagccatctccctccctcagcctctcaaagtgctggggatggctgggtgaaattttaaagtaatggtatttataggctgggcgcagtggcttatgcctgtaatcccagcactgggggaggccgaggcaggcggatcacttgaggtcaggagtttgagacaagcctggccaacatggggaaaccccgtctctactaaaaatacaaaaattagccaggcatggtggcaggtatctgtaatcccatctgaggcaggagaatcgcttgaacccgggaggtggaggttgcaatgagccgagattgcaccactgcactctagcctgggtggcagagcaagattctgtctcgaaaaaaaannnnnnnnnnnnnnnnnnnnttgggtgacagagcaagactccattccaaaaacaaacaaataaaaaaacaaatcaaagtgccgggggtattataggcatgagccaccatgccaggcctttatttttaatggtggtaaaatacatataacaaaaaatgtaccatcttcagcctgttaagttcagtagtacattcatacgttcatattattgtgcaatccagtctctagaactttttcatcttgcaaaactgaaacccgccattaaaccttcattctcccactccccctctccccagcccctggcaacatccatcccactgtctgtctctatggtagtttgactactccaggggcctcttatcagtggaatccttcagtatttgcccttttgcaactggcttaatgtcctccaggttcatccgtgttgtagcatacatcagaatttccttcctttttaaggtactaagtttgaaaagtattactgtgtttctgactcagtgagtgggaaacttaattggtttcccaaagtagatagactgtgtgaaggtgtgaactcttcagtgtattattggcagaaagtgtcacctgggcctcctgctctagtcacacccctttgctacatccatctttcttcatcctctgatcctaacatttatcctgaggactgtctcaaaatttcaggcttccagtaaaatcctggtatcattacaactgtttgctttacatctctcttccgttacattttacctgaaagatacactggattttggttgcattcttatccctgccttaaagatctgaccccacatatttgtaatgtcagcatggagttttgtgaaagttgaaaattacttttctcagtgaggggaaaaaagttcccctaaaccaagccattctccacttgcagtaatgatctgtaagaactttatctttgactcctcgactgtttttttttcttgtttgctgccttacctgcagttgttagccatgcctcacagcactgccttcttatcctatagtttttaacttaccagattttgtattattgtgggtcatttgtatgttccccaagtgatataaaagctgtagtcattttaaacagtactctgctcaggaagcaacctcttagcttactgtttgctttgaggcacagatagccgaagtaacttgcccagggtcatccagctggtgagtgtggccccaagctaggcttaggacccaagaccactccctgtagagtggcagtccccggatccgtcccagaagttgggtgaggcacccatgctgtggattcatacagccttgtgcatgatccctcgttaacatgcacacctgaagtcatcaccttctcagtggatgcttccagggactgctgctcctgccggaaggaaccagatctgtctcttcagtgttgtacccccgctgccttccacctagtaggcaagcagtaaatgcaggctgaatgcgtcaatgatgacattgttagaaagaagcaaaagaggaagatgaattgggtatgcagataaaggaaagacatttggcatttgttgggcacctatttgtgctcacagctttatcttttccatcacgcattcctcacaacagtgctaataactgcagtgccattttacagctggacaaaactgaggcccagagagattagcagtttgttgaacattggtatgtctccaaagcctgagttgtttccagtattttgaagtttttcaaattataagtcactgggattttctgggagacaaagtgacttacacccatagggtagtgcagagggaggtgaacacgctggtttgtttaaggtctgactagtaggattgacacaggtatgtggcgagtaagtgctgaatactggaaccagtgctcaggatatttggagtttcttagccctcacgccatgatcactgtatctttggaggttggaggaacaagatggtttcccagatgcgcgcttttgagcccaaagcctggtttgtaaatagccagttgttctcctctgagcaggtggtagtttctgtagaggctgtagaaaagctgggtgctttatttcattactgccactgctgttttaggcagagcttaaggttaagagagaaggagcgtgtgtgtgtgtgtgtgtgtgtgtgtgtgtgtgtgtgtgtgtgtgtgtgtattcagtgtttatgaaacttccaggtctgtaaaggggtgtggccgtgattagcaggagggcacccgttggcagcaggccagctggaggggatgaaaaggaaatggcaatgacctccttggcctgggagcaactctgactaaggtagttaccttttgtatatttaccttctccgcaaatgagggctcactccttaattactttataaaatgtttccccgcattgttggtttaaatatggacctttttatccattgaaaggcagaggctgtaagaaggatgctggttaatcattatagtggaaaaaaataaggcaagtgatgtatttgaaagctaggcagaggggtctggtgccagctggatgacctcaaagagacatcctggtcctaaagcatgccttggacacgttcatttgacggtacccacggggatttaggacagtgtggtcctggcagctgctatgtgtctgccaagcagaacctgctgtcagagagctgcgttttccgtggaactttatggcatatccccgggcatctgcctgtggccggtggagcgcgggttgcaggattttagactagagcccgccgtgtgctcatgtatcgtcctctggcttggaaagagggctctgtccctttaagacagtcctcctttgtatgccactggctggaacccatttcagctctgggtttctgccgactgttaaaatctgcaaagcaacatttaaataaataaataaatgaaagcttcccttgtgtggctttcctattcacagccaagcacaatagcgccttgttgtttttgtcactttaatcctcttcattaaattggaaccctggaaaggaatggtgatggggctgatgctggaccgtccccctgactgccagccggacaccttgcagattaacctttgtgggcatggattccgggtgcccctctggcaatgggcgaggagggcgagcgaccgggtggtgtgtcagggcggctccccctctggtttgtctccattgtgctcaggctgccggcagggacaacctgctgccctccccagtggccattcttttaaagagcaaggggttcagccgcctccctggcacaccgcctccctggcacataagcatggctgcagcacgtggcagtgggggagggaggagctgtttgttgtgctgccatctggcccatctgagccgttcttttgcagtttaaccctaatggctacacaggagagaagcggcatgaatagacgggtttcccagggtgcggacggtgctttcccagaaactcccgggctgtgaggtagacatgggtatttctgaccaccacctttcttgttccagctgtggccttcgcagtgtcctgaagacactagccaagactgtaggaatcaatcacacctcagctctccagcaatagtgttgattcttcatgctgctaaatgaaattaagcattttgtttttggatgttttttctgtccggggcagcatgagaatgaaggcttgaattaaagatttgatgttgcattgttaagtttatgcagaggaaaatacttattaaaatattagattttgcctcatctcagaataaaattccactagaaaaatgaggtgtagttcagctttttaaaataaagttcttgaatgattggttgagccagaaggggagcagcattatgatttaaagttagtaagtatggaatggagaagtaatttagcagtcatgtggcaaatgtcaggagattggatcaaaataaatgtagataaatgtcttatttattctagctacaaattggccagaagcgttttctgtctgactccaaggacacagaagggctatcttttctagtgaccatagttgtacatttttagtcttttgttttcaaattgtcatagtacatatatatatgtattttaaagcaagtattcaggggcttatatgtcctgtctctctattcccagacccactccccaaagcagccactattaattcacttttttctgcttttaggtcttctagtgggtgctgccaagttcttaaattggtgattattttgtcaagatcaaaggttatctcctgccttctgcctatgatggatgaggatgcagctcacaccattctcttccttccttctctcactgtccatttttggtagttgatcacaattttcagttcctggatttttacctttggcatatttacagcgtgggtttcttgttcatgatccttatccatgcctctggtctctagtgttgtaggaggaagctgtggggaccatttgggaccctgctgccctctccactttgcttccctcaaactttggtcagctcttccttcaccttggtaacagatagctttgcttctccagcctgggttggtctttcatgctttgtctacagggtgattctgtaagttaactaccagcgaccagcaccatgacaggaatgtagataccactcaccgtagagccaggtgcccactcaaagggagctgttcctggcgtccctgatggcccagaggacaccactcggggggcatgtttcatttcttctgtgatttcctgtagttgagtttttcctgttgcccagtcctttttattctcttgagaggaaaccgaatgatgcctgttggtatcacacagttttctcagctgctttctccttcattctctggtttcgagtctgatttcattctttctgatggcattcctctggcagccctttggcttcctgctctgacccggtctggtggctgttggccatcacagttgatggcgcttgctgtcctcaggctcctgagtcagtcccgttccttgatccacatcttgctcctgaagtagcttcttcagaaggggtgcacagaagacaaactttctgatccttatgtatctgaaatgagtctgttttaccctcctacttgactgagaatttggggttcagataattttcatttagaattttgaaagttccactgcgctatctttagtgtgcgggctcttatactgacaccagcgagatcttccctcgtgggtggtctgattaatcactctccttaacctctgtggaggttttaggatcgtctttattcctggaacttctgaatttttcctatgagaatttctctgtgggatttaaaaatatttttattcaaccgagtttatttttttgcttatatttccaggtttgcttatattttcaaacctctttgttctacaggaatgccccaactttatcttttaatccttcgttgacttttttgatgtgggggacaaaagtatgtttaatttgcaaggccgtattctttttctgtaattgtcccttttccagagttttctgttcttttaaaggttttttttttctttcttttttccccctaattatctctgtttgctctagggtgagttttctgttccctgtcttgtcctttctcactcctggcataggtgtggttatctctgtaagtgtaagagtgaagcagtagacatgttaagcggaagctctgtgcatggctgggccttgtgggcagggaggcttggcttcagggcgagtgagccagagcctgcttggggtagggttctcttaggtgtccgctgtctacatatggaggctttaccctggacaccagctccacacttgtctgctcatgagaaagttggcttcgttcatgtgtgtgtgtttgtgtgtgtgtgtgaaatccttagtgtgctaggccctgtgctgagtaccacaaacacaacagtgtacaaggcatacggtgtccctgcctttgtggagtttttattctagaagatattagcacttagcactgtttctttcctttctctgttctggaaatttgttgaaatctcttctgatggcccttctctgtgtactctttgatattgtaggtttatggatgtttttgttcctttactattttttttaaatttttaaatttttttgagatggaggcctgctctgttgcccaggctggagtgcaacgttgccatcttggctcactgcaacctccacctctggggttcaagcgattctcttgtctcagcctcccaagtagctgggattacaggtgtgcaccgctacgcccagctaatttttgtatttttagtagagacggggtttcaccttgttggtcaaacgggtcttgaactcctggcctcacgtgatccacccttctcagcctcccaaagtgctaggattacaggcgtggaccaccgcgcctggcctattcctttactatttaaaaaataatatcttggaagatagaggactagaagggcattttgaatttataatacagaagctagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagatagggatttcttttatacgattgctctgtttttcatcagcttcattatatggaccttggatttagtcttgcttctgctgggtagattgtgtccatccagaaaaattgtcatgtgtgaatattaaacccagaatggttgagtgctcagattctgaaaagaaagcaacgatttagagtttccagtttagaatgatacaagttggcttctcagggtatatagcagtcttgagataggaatttcttttatacgattgctctgtttttcatcagcttcattatatggaccttggatttagtcttgcttctgctgggtagagatacattgatgatctgattaagccagttctgtagcttcaaaatcaaatcccaattattgagcctcttgcggagcagctgtttttaaaaaatgaatgttgccttaatttcaaaaccatgttatattggaatgaatatgtatcttctagaacctgaagaaattaatttcttaaaggggtcttctacttggactagaaatttttctgggctgtgaagcacagaaaaatcagagtgaactgctttaaacatgcgtttctgtagaacggtgtacgcatcagtagagttgatgttgtttttcaaaacggcttttgctttaaccagagctcacttatttgtctgactttttcctgaagcagccattttaatatatatatatatattttttaatgttgggagaactgttcagcctgggaagaaacatttggggtggtgggtttggcgggggtgcagggttagaatccacataatgctgatggattgctgagctggagtcctgggtcttgacacaggaatgggactggagagcaggtgtgtaggtgaacttatttaaggctccgtcctccaatacacacacctgagtgatcacccttgagttctcagggacgcagtttaaggcccactcttgtgaaggtgacctgggttggatttagttggtctgttgggatctttagagtggctgtctcttccagcctctaaaggaagagtgtttttcaaaccacaggactcagtatattaggtaattatacgattacctaattgattatgaaataattattttttattttttatattattattattattatttttgagacagagttgtgctcttgttgcctaggctggagtgcagtggcacgatctcagcccactgcaaccttcacctcccaacttcaagcgattcttctgcctcagcctcctgagtagctgggattacaggcacctgccaccatgcctggctaattttttttgtatttttagtagagacggggtttcaccatgttggccaggctggtcttgaactcctgacttcaggtgatctactcacctcggcctcccaaagtgctgagattacaggtgtgagccaccgcatgcagccataaaatcagtttactggactaaaccactgttaagaaagctcacagtgaaataacagacatggtgagatattatttttgatacttttatgtatggtggagattgggtcatgatgtaaaatgcatttcttttctttttctgtttctttctctttttctttctctttctctctctctttctctctctcctacctccctccctccctccctccctcccttccttcctccttcccttccttcctccctcccttccttcctcccttccttccttccttctttccttctttccttctttctttcttgtctggctctgttgcccaggctggagtgcagtggtgcgatcttggctcactgcaacctctgcaccccaggctcaagcaatccttctacgtcagccccccgagtagctggaactacaggcatgtgccaccatgcccagctaatttttgtattttttttagtagagacagggtttcaccatgttgtccatgctggtcccaatgggctcaagcagtctgcctggtttggcctcccaaagtgctgggattacaggcgtgagctacaaggcctggactaaaatgcttttcttattttggattttgagatgtttaaaaaacacttttttagagaaggttggggaaaacctaggttaaaaaaaaaaaaaaaggaaaagtcggcttttctaatgtagctaattaacccactgtacacttcactgtagtctattgtttctaccctcttgtgatttttatgaaatatttggggaaagtaactgctctgtgaatgtagtagattaagttttaatgccatgggcagaaggaaagtatgtgtatcctaactgtgctctcaagcagagatgttaattccaactctatgctgtctagaaatataatatgagccatagatgcacttttatttcatactagttcctttgagatcaattaaaataatacatttcattaagttatatcaatgtgcaatcaatataaaatattattaaaaagtcattttcctttgtttttatagaaagtctggtgtgtgtgtgtgtgtgtgtgtgtatatatatatattatttatttatttatttatttatttatttatttatttatttgagatggagtcttgtactgtctcccaggctggagggcaatggcgggatctcggctcactgcaacctccacctcccgggtttacgccattctcctgcctcagcctcccgagtagctgggactacaggcacctgccaccacgcccagctaattttttgtatttttagtagtgacggggtttcaccatgttagccaggatggtctcggtctcctgacctcgtgatctgcccgccccggcctctcaaagtgctgggattacaggcatgagccactgtgcccggcctcggtgtatattttttacctacagcacatctcaaactgggtggtgacatttcaagtggttaatgtcacgtggggctcctggccgccatattgtacagtgcagctcaggctcacataggcacccactgaaggatagaaggaccctcaaaccacccctacccttgagagtgtgggtgccctttgctgtgccatggagggaacaagagccaacacttctgagcttctgctcagcaccaggcagggtttgaggcactttaattactctacatcatcttcacagcagccttatcaagtgggtgatggtgggaccacttcattgatgatgaaatgtgacccaagtgggttacataacttgtctgaagtgacctaatttgatatttggtagattggagctaggatttgaacctggtttgtttgattctaatgcttgttcttctcatttgcccacatggcttcccatagcatgcttgaagggtcattttagagggtgtctgtccaaatctcctgttggtataggtgggggagattgagccattggaggatggcagaagtattttgtggtgagagctgtgatctgggaattaagtaactttcttctgatgataagagcacattgtaaaacatcgaaacaatgaagaaaggtatgaagcagaaagagaaagtcccatagtcccagttcccagagttaagcactgattttaggtgtatattctagactttttttatttctcagtgcatacatagtctctttctccaaacccctcccagagatggcacaaaattgttcgtacacgttgctttgcctcttgcctcccctccccacctcagggggtcatggacatctttccatctcggagactctgtttttgaccatgagggagctgaggcctagagagattaattaaatgtcagcctgaagtctcccagctggaagggatgaaaatggccaggcgctcagctaatattcatcctttttcattcatagccaacctaatttaaccttcagtaatctcttctctctcgtttttccttccaagagtttctcagagcttttctgtgtgatttaagggccttcctttcttagaaatctgataagaattggagccataactatttctatcactcagtcatttctgaaactgacttctagtttctttcttgatatctttctccttttgtggcctctggatcttccttgatttttggcgagataaaagctttcttgtaacattgccctccatttttgtagttcccagtgacctgacagcagaggagcgtcaagaactggagaacatccgacggagaaaacaggagctgctggctgacattcaggtaggagagtggcatggtggtttcaccaacgtaagaaccacagtgacagttccatttgtatgaaagggtgtcctttgcagagtgtctcctcaagacacttttgacctgccctcactacagctctgcacaaagcgtaggtgttgataatcagtcacctttcctctacagctgaggagatgcagtgtcagagaggttgagtggcttgtccaggttcacccagttggtcggttgtcggagctggagatagcctgcaagactcctgtctcctgagtagtcctctctgctgtgtttgcccttgcggagcagagtggatgaggagaggcaatgagaatgtgggcttcaggcgaagctcggcccacgccctggctctggctctgccgcttactggctgaatgatttgagacaagagagttccggttccttgaacttcagtttcttcatctgtcagatcatgaaaacacctgctacacagttggaaggacttagcatgaaagacagcataatttctggtccctatagatgtacttagtgatagcaattttacaattacaatttttccaagttcctttttgtaactatcaagcttgtaggaaataagtctagaagccaatagttggattattttcgccctaagacagcaaatgttattctttcagaattcttcacaagacattaggagtggggttaaggagggaatcctgttgcccaaagtagcaaaatgaggaaagacttgactttctctggagttgatttaagtatattttgatagttctccctgatcctttgatttctgcttcactggtagatcgtgagaaagctaagcagctctccacttaagccccacttccccgtgagagcccatccattctgaccaacagtgtgctggaatgaggagggtgggtgcggatgcacagccgatttgatcagacattccctttgccagccgcttggtggcattgttgccctggcacagctactgcaggctctgcagcctgggctttgggtaggagactttgtcctctgaattttctggcatgcttgtgtttagtaagctgcagacttgttctgaaagattgtgatgaggcagccaggttttgtttttcacacagcatatatgcttataaactttcctagaccgtaaactccttgaggtcagaggctgtattcttttctaccttggtgttttctggaatgcttactgtttggtaggcactcaataaatatttctgaaacatgaattttcctaatttactttttgcatttttgtcatattttgtttcattttgctttattttgtttttggttggagggagttatgtgagattttagaagttttaatttgatctgcatctgcctttcctgctgactctggactgtctgttttatagaggctgaaggatgagatagcagaagtagctaatgaaattgaaaacctgggatccacagaggaaaggtgagtctgccctgctgccaggtggcttctgtggttgtaattccttaaagcacccaggccttaattatgcttacgtggcacattgaaggaaaaagtcagctttgtgtctttctaattctagcaagcacatacacacccataatgtctgccttccatccttcaccgcaaggcctcctgaacataggagcttcttccagtgtttaaaaaattgaactggaggccgggcgcggtggctcacggctgtaatcccagcactttgggaggccgaggcaggtggatcacgaggtcaagagatcgagaccatcctggccaacatggtgaaaccctgtctctactcaaaatacaaaaattagacgggtgtggtggtgcacacctgtagtcccagctactcgggaggctgaggcaggagaattgcttgaacccgggaggtggaggttgcagtgagctgagatcgcgccactgcactccagcctggtgacagagcgagactccgtctcaaaaaaaaaaaaaaaaattgaactggagaacttcaaaggtcccagaaagccttaaactgctcctaaatttttatgtgaattactcccctctgttgtccactgtcggtgtgcattttaaagtttctgtttttcctttgtgtaaaggaaaagcttaatgaatgctgctgatacgatttcaaagggctggagtgtccagtcatgtctgaggataatcgtgagcttatttgcaccttcctaatgcttaagggaagaaaatgtagaaatgcgatgatagtataaaaggacaaggactctgcttttttttttccttttattttcatgaaatgttagtgactttgagagtttagttttgaatggggttcccagaccgttttctgactgcttaatgcaataaatgagctgtttccaattcactacatgtctgtatttttctaagcctaagtcttcctgtctggcttcgtaggactgtttgatttgttgttttagactcctgtgggcagtgccttcagggtatagtgaggctgagtcctccacagaaggcagccagctcaccacggccagtctctgtattgtccatttggtattttggattagtttcccctctttccattttaaacactcgtagcttaaatgaaacggatacgttggacttcataaaaatttaaaacttccgcttttgtaaaagataaaactattaaaaactattaaaagaaatgaacaggcaacagattagaagtaaatatttgtaacaaatatatctgaaaaaggacttgtatctagaatatatgatagaaaggcagcccaaataagaaaatgggcaaaaaacttggacactttacaaaagaagccatatgtgtagtagacacatgaaaaatgcttaacatcattagttgtaggggatgtaatttaaaaccaccatgaaacggtacttcacatcccctatgatggctagaattaaaaagactgatggtacctcatgttggcaagtgctagtgagaataaaataatataaccatttgggaaagaagtttggcagtttcatcagcaattcaactcctagttacttaagagaaatgaaaacatgtccatacaaagacttgtacaagaatatctatagcattcttatataaaataaccaaaagctggaaataccctgaatggctgccagcaggtgactggataaacaggtcgaggtaatagactattactcagcagtgtgaaggaatgaactgctagcgtgcagcagcacggatgaatctcacgaacattgtgatgagtgaaagaaactgtgggcaccgtgtgcttccatgcgtgagcatctagaacatgcaaactaagctgtgctagtgtgctagccgaaatcatgacagtgctgcctccgaggtggttgctggggcggggtggggtggggttgactaggaagggccatagggaacttacagggatggcaggaatattctgtattaatctgagtggtgcttcaagggtatatgcactcatcaaaacaaattgaactgtgcacttaaggtgtgtgcattttgttaaatgtaaattttacctcgatcttaaaaatgtaaaaaaaaatggcttttttctgactataaaggtaatacacctttactgcagaaaattggtaaaatacagaaaagtataaaaaacaaatttctcataaacacttatcccagagataatcaggattcatattttggtacgtttcctttctgtatattccggtgtctgcacacacatattcagaattcagtgtgccctttgtttttctcttgattaattctctgtcagttaccatagaacagcaaggaaacgcagacaccaggaacgtgagtgcatccaaagtactcagccagtgaatttgggaagacttgtaactcatgaactgcatctgaagttgtgagtcaggaagtagtctttaggttattattattttttaatctggaacttaaaatggttttccggtatcgaaagcgccaagacggaagtgattctgcacatccctgaggatccatccatacgggtactcaggctcaccctgcatttgtttctcaagcaggcattacatttgctcggactttcttataggagagaattcatgtttctcatcgacgatctgatgcattttgtaggaatgatcctaaatactatttaatcaagcagaaataatatactcatgtagtacaggatttcactttctgaaatgtatacgcgtcagttaactaaggcgatccagtagcagtaagctgttttcctttggacaccttaactggggtgtcagacctgtgtaggctggggaaagccacttagagaagtagctgcctaaggcctagagctataggggctccaagtggggcagatagagaagtgagctggctagctaatgaaattagggagccatctctggtgtgtgtcccaggcagtcatgtggcacagactgtgactggcggatatctgggagtgtgcgttctggtggctgcaggaaagcctttggtgaggactggactgaggcccaggaagctgagcattcccaggagtttcaccccttgcttctgtgggcacctctgacgctgcctcaccacttacactggaaaccatgaaacaggccttccttgtggtatttgtttggaaatactgatcaaagtaatcttcctggatttagaaaaaaatgattagacaatcattttagttaaataggaatttctagatacctggtcataacccttcattctggctgaaattaaatggtgtttcccccatgactttgtttcctaaggcagctgttgacaggggagcccagattatcttacacctggaagttctgatactactcacagttttcaggtgttcctttcaaaaggtcaaaacagcctggatgcgatgactcatgcctataataccagcattttgggaggccaaggtaggaggattgcttgaggccaggagtttaagaccagcctgggttacatagcaagactctgtctctacaaaatattttaaaaagtagccagttgtggtagtatctgcttgtagtcctagttactcaggaggctgaggccggaggatcacttgagctcaggagttaaaggttgcggtgagccacagtcacaccactgtactccagcctgggtgacagagcaagaccctgcctgtaacaaaaacaaaaacacaaaaaacaccaaccctcaaaacacttaggaatattttcttccctccatggatttagctagagaacacatgtgttctttaaggcaataacattttatgattttatttccgagcaacttttttgctctcggagattataaaattactattgatattgatggcagtggttcttaaatttgggtgcataccagaattactgcaggaggttttaaaaattcaaattcctaggttctgccccttgtacttctgagttactcagccggtccagggccttgctactcagactccacacatgggatcatgttaaacatacagcagaagcacaggccccttctcagacatagagtcagaatctgttttgttgaggccccaggtgacgtgtatgtataaacgagcggagcgtcttcacgtctgatatgctcccaaggctgctggttggtggaccagactttgagaagcttggtctgtgaatctgcatttttcattctgatacagtcaagaaaactgcctattatttagcaacttcttaaaaagttaaatacagatgtaccgtatgacccagcagtgtccacccctgggtatctacccaaggaaaatgaaaacgtgtccacacaaagacatatatgcaaatgctgatagcagccttctgcataattgtcccaaactgtaaacagcctaagtgtccatcatctggtgaatggataaacagatgtggtttatccataccatggaagatgacccagcagcaagaaggcatgtagtactggcccacgctccagcaccatgaccttgacaacattatgctaatgaaagaagccagatctgaaaatccacatcttttatgattctgtttgtatgatatgtccagaataggcaaatctgtggagacagacaatagattaatagttgcctggggatggaggtagaagtaaggattaactgtaaaaaggtgtgaggaattctgtaggggagatgaaaatgttctaaaactggattatggtgatgttgcacaacttagtaagtatactaaaaattcaaatatgtacctacagtaggagtattataagtaaattataccctgataaagtttttttttttttttttttttttggagacggagtctcactctgtcacccgggctagagtgcagtggtggatctccactcactccaacctccaactcccaaattcaagtgattctcctgcttcagcctcccgagtagctgggattacaggtgcccaccaccatgcctggctaatttttgtatttttagtagagacagggtttcaccatgttggctgggctggtcttgaactcctgaccttgtgatccacccacctcggcctcccaaagtgctgggattacaggcatgagccactgtgcccggcctaccctgataaagtttttttaaaaatcatgttaaaaaaagaaaactggctgggtacagtggcttatgcctgtaatcccagcactttgggaggctgacgcaggcagatcatttgagcccaagagtttgagactagcctgggcaacacagtgagcatggtggcatgcgcctgtggtcccagctacttgggaggctgaggtgggaggatcacttgagcccaggaggcagaggttgcaatgagccgagatagcaccactgcacttcagccttcagacagagagagaccctgtctcaaaaaaaaataaagaaaacctctgttccagggtagaaggagcaaatgagcttggagcttggagccaggttcaggcttcaggtttcagttggcctttcatagttccaccagattatgcctgttgctttcctggataaatctttcaaaaacctgtgtaaatcagtggaaatcatattagtctttcaagcctttccgatggcctgaagtactaaaatggctgtgatggttgttttacaggaaaaacatgcagaggaacaaacaggtagccatgggcaggaaaaaatttaatatggaccctaaaaaggtaagtgagaaagaagcgggaagtggtccatattagatggggtttttttatagtgctcagatagaccctaaaaacgtttttttccaagcgttacagttcatgttgccgttttgtagagcaaatgttatgcactaagcccttgttcctaaactgtgactccccggctttataggtcacttagcaagtatttattaaatattccagtgcacccacacccatttcttcctgtgccctttccccttcttttcaactgtttcccagcaaagcatcattggcgtctttgttgtctttttctaggggatccagttcttaatagagaacgacctcctgaagaacacttgtgaagacattgcccagttcttatataaaggcgaagggctcaacaagacagccatcggcgactacctaggggagaggtaaggccttggggattatgcgcatgctagggaaggctgttcaggaacgacacaaagaaacaaactcccaaatactctgaagttcttggaggggtttttgccttaaagcatctgtagccccactggagttgaggggaggcttttctggggaatagtgatgggtcttttctgggggtcatggagacatcttgcttgttcagccagtcagcagagctagccagtcttcttgcggacagtgtgcacaagtggctgtctgggcaggagccacaggaccacaggacgcagtgtaggagacatggcctggctggagattctcagtgttggtgcctgactcctgctttctctcccattttttgtcttttctcgatagagatgagtttaatatccaggttcttcatgcatttgtggagctgcatgagttcactgatcttaatctcgtccaggcactacggtgagtattcttgaggtgagcccctttggaaggagtgggaggctagcctttgatcatgagtctgtcctggggggcattttattgaaattatatctttgggtatgatttgaatattttgaagtattttggagggaagaaatctattggtctctgactgggaatgactggatggtcaaggggaattcaattctgttacgttctggaggccgattctgtaacactcttccttgagtcttatatttgaggttttagaaattgatgaatacttaaattttgaaatttttcagtttagaaaatcctttaatttcttgccctggaataagtagttatacatttcattttggaaagaaaaaagtaaaccttaattttttattaaatctgttacctcatgccttttaagaaactgtcattctgtattttcactgctgtaggtgtaaataatgacttcatcttttgtgctatcatttagctggatggaaacaatccacaattaaacctgtcagctgtgggtctttctttctttgacttaaagggatcgattgttaatgctttgacaagacaatcttctctttttctgccacccatattgtttccggaaatagcgtttgtttaaaatgagcattatctatgtttcagtcttgtatattattctgaggagggaaaccactcctcagtagggattgtttccctcctaatttttcactttttcctaagaaaaattttacttttgattaaggtaacagtggtgtggatggcaactttgcatctgttcagagttacagtaacagaaggctgcagcccagcagggttccctttgcactttgatgttaaaaaatcattggcagtggtcaggcaccgtggctcacacctgtactcccagcactttgggaggctgaggcgggtggatcacttgaggccaggagtttgagaccagcctggccagcatggtgaaaccccgtctctactaaaaatacaaaaaattagccgggcatggtggcgtgtgcctgtagtcccggctactcgggaggctgaggcagaagattgcctgaacccggcaggcagaggttgcagtgagccaagatcacgccactgcactccagcctgggtgacagagtgagactccatctcaaaaaaaaaaagaaaaaaaaaatcattggcagtttaacaattcatagagaaataaattgcctccccaagttctggaacactctgtctttacccactcaggcagttcctgtggagcttccggctacccggagaggcccagaagatcgaccggatgatggaggcgtttgcccagcgatattgtcagtgcaataatggcgtgttccagtccacgggtaaatacgatcattcatcctagtttatgatgggcgttttacactggattattttcttggcaccagataatttctaaaacaaaagggctgagattcatgcctaggaacgtttactcaatgatagttataatagtaaaatgttggaaataacctgaaagtctgacattaaggcactatgaatttaaattgtggtacctctgaactacgaaatacacagctattaaaaaccatgttttagctgcatgcagtggctcacactggtaatgtcagcaccttgggtgggaggccgaggtgagaggattgcttgaggctaggagtttgagaccagcctgggcaacattatgagaccctttctccaaaaaaatttttaaaaattagccaggtgtggtggcttatgcctgtagtcccggctatttgtgaggctgaggcaggaggatctcttgagcccaagagtttacgactacacgcagtgagctatgattgcaccacagcactccaagcctgggtgacagagtgagaccctgtctcaaaacaaaaactaaagaaacccatattgttacaaagaatttttattgacataggagaatgatattaagattagcaaaaaagcatgtgtatgtatttgtttgtttccagttttgttacagtatatatctgtgagataaatatgtggtgagttatacatagtcatatttacgtagaggaaataaagcaaaataaattattgctagatagtgggattatgggtcattacaggtcattttgttttaaacacattgtgtttttcagagtttctacagtgtgtgtattctcctttccaatctgaaaaaataaacagctttaagtcttgaatactttatatactttttcgtgccttgctcctttcagacagcagtgtgccctggagtgtacccgtacatgtggattcatctcattcttttgagaacatgtttttttttttttttctgagatggagtctcactctgtcgcccaggctggagtgcagtggcgctatctcggctcactgcaagctctgcctcccaggttcaagcaattctcctgcctcggcctcccaagttgctgggattacaggcgcgtgcagccacgcctggctaatttttgtattttagtagagacgggttttcaccatgtgggtcaggctaggcttgaactcctgacctcatgatctgcctgccttggcctcccaaagtgcagggattacaggtgtaagccactgcatctggccgagaacatggttttttattcctgatttcatctgataccactcttgctcttgcgggtgggatgtttctgaacatctgagcatgcaacggctcccctttgcttttctctcatctttagatacttgttacgtcctctcctttgccatcatcatgttgaacaccagtctgcacaaccccaatgtcaaagataagcccactgtggagaggttcattgccatgaaccgaggcatcaatgatgggggagacctgccggaggagctcctccgggtaagcaaggaagaatggtcttcattcaagtcaagaaagagttcactgggaacaggatcgtcttttgtaggaaggaagaaaaaacatacaatttatcaagggtctcctcttttaattttttaaccatgtgaatttcattaagaaagtggtagtaaggcccagctagggaatcagggaggggacagtggtttgtaaacatgaaactaaaagcttgaatagaagtcaggctgcttctttattttcctaattgggaaggcttatttattttgtcactgtgagctgcctgaaagcagaaatggtcataatcttctagtctcagcatctagcaggcttggcttactataggcacatgaatgcttgtggaatgaatgaagagaaaggggaggaggaaaaaatatttctagaatcagagacataaattgtcatcttttatcccagaatctctatgagagcataaaaaatgaaccctttaaaatcccagaagacgacgggaatgacctcactcacactttcttcaatccagaccgagaaggctggctattgaaactcggtaagcgcacctctgagtcagggctcctaaagctgagacttaggaagaaaggcggtgtgtgtgcgtgtgtgcgtgcgtgcgtgtgtgcgcgtgtgcgtgtttgtgcgtgtgcatgtgtgcgcgtgcgtgtgtgtgcacgcgcatgcatgttcacacacattcatggacacacacgcaccatgtaggaaagggggtggcttatagaggactccagagagactttggtatgagttctgttctaacaaaggtcggcttccaaaagggaagtgacttcatagtcattgcccccatgggacacagagactactggggacagacttactccaccataaatattgcccacatgtgtctgtgctccacatttttacccttgaattggttgaccaggttttgtttcaaggcagttccctgagcacctggtccgtttgccttccctgtccccataaccactgggagggtggccgaccttgtccatctttctacttcccatcccacagatttgtacctggcgctcctgcccccaccccagtgcatcgtcacttccttctgcatctggctcccccacaggcagtgtgcatggcaagcctagagcccttggctgcagctcaatccacagcactcttactcattcttgggcagtggttttttttttttcttttttttttcccctccttttcaatctgaatcagccacattaattattttgttcatttagaaaagctgaaaatgcatttctcttccctttgccagaagtgatgagcttgtattgctgagatttgtggtcatgccttgccgtgaaggtgacagggtaatcaataggaaagactttagtagggttttcatacacattcatgtccacatgtgtttactttattaatggtttcagaacatagagctctagactctctggacataatgatgtcctttttttttttttttttttggacactagcagggtactttcctctgttgccttctgctttagcctttgatgagttgggttctcacattagcaggggctgttccgtcctataccagcccaactgcttgccccagtgattagaagtcagtactctcttggtcattactgacacatctgggaaggctaaaatggaatcctttatttctgactaggtcagatagcagtagactttatatttccttttaaagtcatatcccaagtccttgtgcttatacataatgacttaattcataaattccccttacagcaccacttcaccgatcagttttaaatatctcttgaattggccatcattttatatatctttaagccagcagaatctttgaagttaaggctctaaaattactaaccccataggcagccttcccttccacattcctattgccaagtggatggagttgaaaggaaacctactggaaacgtttaaagtgtgttcaagtttggatttacttccccctacagcgagatttgtttaaatgctaatactaagtgttagctttgacagcccagatactaaaattagaacagtacaaagattatcttggttcttagaccaggatgacatgcaaattcatgaggcatctcgtattttaaaaaagagaaaatttaaccaagtgtgggactcagttttagctcattgcattactttttctaaacctccatcaaatccttctagactctgaatattgtgttttcattgtagcacacttagtatcactctttgtgtttatgtgctgcagaaggcagggcttccagccgtctgtagctgtgtgtatatgtctgtgtatgcatatagccataagaatgtgtattcttgtgtatacacatcagtacatgtgtactcatgggtatatgtgtgtgcattcttacacacactttaaaaagtgacagccatctcaagaaagacatttaattttccctgaaataaccttagctttctttgctctgattctggatatactagtaaacattggctttgtaaaagccgatttgtggcatctttggggccaggtttccagtagtgcctcaaatcttgccttgatgaggtggaacgtggcatgtaagagcccctcgttcacgtgccagacagtagtgggatcatttgcccgttgagtgtttttagttcagctctctccccaggcaggcatgaatgtgactgatacattgcactttaagattaaggaatcgggtttaatttctttgttttaattttcttttctccctcatttgtatgtttccatgattttggctctccttttccttgccccaaactccaggaggtatgtaaccctcagcctgctcgctcgctctgctaggccactgtcattactgcagcattttctgatttcgttatttttggttattttgttttttaattgccggtggtagtgttaatgctgcttctaacttattgtacagtccctagggaactggtcaggatcaggggtttggagcaattttcgtttttcttttttggaggagtatatgttatattcattactgaatgcagtaatgcaagaaaacatactaagagtgggtttgtaaaagcagaggaagtttccatgacattttcacttggaattattggctaagacatgcgctatgtttgatattcaatttgacgtccattaatcagcctgattgaaagttaatctctgacgtggggaagaggagaaagaagagaaggaagtctttcttttttcttcttttttcaagctgagacttactccagagagaacaaagtcttgacttcccaaagctatggaaagcttctgatttaccatgatggaaaagcaaactagggaaagaactaaattagatgatacttaagacatttgcctttgcacgaaaaggggaaatggtatttcctaaactcaaaatgataccgagtgaaggtgaaaaaaacaagtccaaaccaaaaaaccctccctgaagtcctcgtgtttagtttcctggggatcagagaagggtattaacagcctcggctctgttgttatgttttgttttgctccctcgctttttcagcgagtcctcgttaaagccccgaatcggtctcctggttatggttttggtgtctcctctccatttgctggtttttttggggaaacatattttcttagcccaagacccctcaggtttgtgcctaagcattccctgagcagtagctacacttaaaaagaacaaccccaaacacgcacagttactgagatgcttcagggacttgtcaggttgttctcaactgtaggggaagatggcatccggccttgatgtctcggggaggtcacaggaggcctgaggagccgtgcagtgggaggtggtcctgtgagttccacagggactgtcctaggcgcacattgatctgtctgcttgtttcatgtctgcttttctttccacgtggaaatgttccccgtgggcccacagtgatgctttatggtagaggtctctgtaatgcaacaaattgtccaggcataataaccaagcttttgtaatcaggcagagaatttcttctggctttgctttttctccttgatttctttccatcttgtttcttttagcatctgactcgctttttccatgatctcctatgtccgaagggttccccgggtagtgtcctgtgatggagcgcatgggaggtcagcatgggttgatgttccctttgtgccgagcctccgtgggcaaccaatggcccgccaggctggaagaccaaagttctcagactctgaattggtggagggggttcctttttaagaacaaattggcttcaatcctgaatatagtccttgccttctttatcctccttatttaattctgcccgggctttcctgttttccacatgcatgtcatagtatccatttatggttttctcttaattcatgccatctaacctttagggaccagtggcaagggctcacatgaaacttagaagttactggagggagagtctcaatttgcttgatatagcacaggatgggcaggtggagggcacgtgcttgcttacagcaaattccctcgcataacctagatctgtgtcatttggaatcttggcaattaatgatcagtcacgtaagcccgcctagggttcagcatccaagcagggtgctaaaaactggcctgaaagtccagtggtccttttacttgtctgccaggacctacgctggacattttcttttcataacattatttgcatactccccttaggtttctctggtgtgagcatgcaggcaggtcctggcagttagaataatccctgtaaaaccattctcctctttgctcagctatttgtgatgagggcaagagagaaagcatgatcggaggtatgagatttatgccccatgatccttgctatttaggaagattggagaagcggtattgtctgtaggttaagtcttagcaaaagagcaggcacaagaagtgtttctagaatgccatgcatagcttcacaggtcaaggccttagggataagttttgagtggttcatgttcagaaaatgttcccttgatgggagagaggtggaggaagagaaagcctgtggtcccgatttgacagcaggtgtagcttcattcagataggcttggggaaatttttccttccttcatgtctgtctcagcataacttcacggccccaaccccaacttttttttttttcttttttttttctttttttttgagagggagtctccctgtgtcacccaggcgggagtgcagtggtgcaatcttggctcactgcaacctccacctcccagttcaagtgactctcatgcttcagcctcctgagtagctggaactataggcatgtgccaccacccctggctaatttttatacttttagtagagatggggattcaccatgttggccggctggtcttgaactcctgacctcaagcgacccacccaccttgacctcccagagtgctgggattatagacgtgagcccctgtgcctagccatgaccccagtgttttgtgctgagaaatactaaaaagaaccaagggaggcccttgccagcctcccagccaccaccgccagagcttgttttgccatggctgtatttgccagctgtttctgttataagctccaggtgagaagcccagaacggaaaaggctcctgaggccacctctcagtacgagttgattcttccttgatagaggaattctgctttgattctcacccaggacccgggagattttgttttcaggacactagcacataaggttaagagccagtgtagaagctcactgtaatcatgaaggtgaagaagagagtagaaccatggggatttacttcgtgttccagggaaagtgtggatttgaaggctcccagcatctcccctcctgcttcctccttccttcacttccagtgaaacactccttatgtgccgggctgcttgtcagtagcagagtagcctgcactaggtgctgacccttccctctttttctgttctttggcaatttctaccacataggctttttgctgactctggcaaatttgcattgtatgtcattattgccccgggttttctcgccacaaacccatgctcatcctgccgtcccgattccatctccgggtgtcacctagatgcgcttgctctgcttgtacccacaggctttcactttgtgaaagacgcttctgtttcagctctgtgtcttgttactgatgtcaatgttgtgggctccacgttctcctgatgcctctcccccaaccctctctgagaagagagggtgtcgtgtgtgtcgtggagcctgcacttgtctggttgtctcttgtcgaacgtgcatctctttttgctctgcaggtggcagggtaaagacttggaagagacgctggttcattctgactgacaactgcctttactactttgagtataccacggtgagcacctgctagtcggcctccagactagggatgggcaaggcctccggttccaagtgtctctaatcagacatggttgaggagaccgttggatttgcccttcagtatctgtgggggatgggggagagtttaagcaaagtgcaagaactgaagtaaatctcagaatggggaacccctgagaagaggtgcgtgccttaaagggcacgggctcagagcaggcacccggttctggtgggacaggagatacctggcctggaggagggggagcactagaaatgggttttggaactgggctagaaagaatgaatttgcattggttgccgagaaagagtatgtggccctaatcgaaagggagatgaaaagaaaaaggaaataatcgtgatttagaaaattcacctattctgggttagcagaaatgtgatttcagaagaaacagcccaaggggtaaaatatatagtgggggaaaaggaagtgaagtgaaatgggaaaagtcaatttgagattatctggagttttaagaagttttgttggtttttattcagtgggagagacttatagctgcaaatttgtgttttatatacgtatatctcttttgtaataatagccaaagaaagtaaaaatcataaattagctcttttcagagctccctctaagcaaggtacccagaaccctggcaagttagcacttggtgtggagaccgtggctcaccggactggtgatggggtgctttttcatttctgccacctttcttggtcattgtaagggcaaagcgggcatactcccatggcatcgaacttttgtcttaaagtaaatcaaggccgttgagttgagaatgctttgcttttgttctccaagtgtatcttcatggagcaaaagtcattgatcccactgagaaaattaagactcagaagtatcttttaaaatcagtttagagcaaaatggggcttaagtaaaacattgaaatcctgaccatattcaccagtcacttatttaggaccaagaaacaggtacacgccttggcattttctgctgtgaggtgtgaagatgggtttctgtcgtgtctaacacttagcgttgttctccatccccatggacatcatgcacatgcagcttctcacccagggaatgcacttcgtagcccatcaggctgcaggcaagagccgctgcttctgatggtttggtgactgaggatagtaaatcactgtgaagggaattctggccgggatttcatatgttgtaggggctcagctcatgccctgcaagttctgcactggctttgcttttctgttgttatagtcttttcatatgagagtaatacacttcaaatatctgcaaaataataaaaagaaagctgctttctgcttcacccccaaagtaccactgtgaacatcttggtacaattttttctgttttgttcacccttctgccctatattttgccttttttctgaagacacctacactaacgatgtctttaacatcgtgtctgaatttgtctcgctattttctgggtcaaaatgatacataagcatctaagtggtgtacttctaagtcctggacaatcctatagcaatgctacgagattctagaatcttgtggtttttcgtgatgcccaccgtagtggtgtcaccttaatccttaattcagcaatatttattcagcaaagtgtagcattttatcaagcaatggaaatacagagaaaaatacttttttttttttgagacggagtctcgctctgtctcccaggctggagtgtagtggtggtgtgatcttagctcactgcaacctctgcctcctgggttcaagtgattctcccatctcagcctcctgagtagctgggactagaggcgtgcgccaccacatccgtttttttttgttttgttttctgttttttaagtagagatgggatggggtttcaccatgttggccaggctggtcttgaactcctgacctcaggtgatctgcacccagcagtaaatacatttctttttttttttttttttttttttttttttttttttttgagatggagtctcgctctgttgcccaggctggagtgcagtggcacgatctcggctcactgcaagctccgcctcccgggctcacgccattctcctgcctcggcctccggagtagctgggactacaggcgctgctgccacgcccagctaattttttgtatttttagtagagacggggtttcactgtgttagtcaggatggtctcgatctcctgatcttgtgatccgcccatctcagccttccaaagtgctgaatacatttcttaagacacagagaggatgctgtcagaattaagatggtagattgaaacttccacacagaattacctaacagagcaaaagactagtaaaaaaataagtagggaaaaatagcaaccaagcaggggaaggggcagaacgaattcagtgcactgcagccctgggcagcagcggaagcagcggtggcaggggcagcagtcaggagcagtgtgcagggtttctacctcacggcccaggatttgaggagacccggcagtctcgctggtttctcaggtctgggaggaggcaaactgaacaggacttgttattttttcctccctgatcaaggagtagtaaaatcccctgctgggtggacattggtgaaatgggaaaagtgaaaaaagcagccgttatagacataagtaaaggctcaagactgtatattcactggggaagactgtccatggagggtctcccatgagcatgatatccatccccaaatacaggggtcctcaacctcaggccataggacggtaccagtctgtggcctgttacgagccaggccacacagcgggaggtgagtggcaggcgagcggtggaagcttcatctgtatttacagccagctgctccccatcactcacatcacctcctgagctccacatcctgtcagatcagtggcggcgttagattctcataggagcacgaaccctattgtaaattgtatgggccagagatctaggttgtgcactcctcctgagaatctaatgcctgatgatctgaggtggagctgaggcagtgatgctagtgctggggagcagctgcaagtacagatgaatgttagcagagaggtttgactccacagagaccataataatacatcagttgcttgcagactcatcagaactctatcagtgagtggcaagtgacaattagcctgcctctggtggcaggctttatagtggcaagtgagctgatgtacttcaattgtacagctgtatctggtggcaggctttaagtcagaatccaacacttatttcagtccgtgcatggcctgcccgttattttatttaccactgccatccacatctctttcccacactgtgtacttgtctcagccatggttttggtaagcccacccaccaaccctagccaaaatgagtaaaaaccaaacgtcactggagagcttctttgaaaagggggagagacccattgatgagacagcagaacacgccaagactgccaacaaaaataaagctgcattgtaaagaaaatgccaagagttctactcaaattctaggttcatttcaacaggtgatcacattcgccaagcccactttgtagaatatgtggtgaccaactacccaacaaagccatgaaagcttcaaaactgcctcaccgcatggagaccaagcaccctgcatcaaaagacaagcctttggagttttcaaaagaaaaaaatgtaaacatcaagaacagaagcaattattgaaggccaccacttcatcaaatatgtctgcgctgaaagcatcattcttcgtgtctaaccgcattgccaaagccaggactggctgttggtgaagagttgatcctgcctgctgctaaggacatttgtcatgcgcttttaggagaggctgtggttcaaaaggtggcacatgttgctctttcggccagcaccgtaactaggcagattgatgaaacagcagcagatattgaggcacaattgttagagaggattaacgagtcactctggtactcaatccaggttgacgagtctaccgatgttgacaacaagacaacaatgcttgttcttctgtgacatatttttcagggggatgttcatgaggatatgttatgtgtgctttagttgccaaccaacaccacggctgctattcaagtctttgaattattacatatcagggaaactgaactgttttgttttgtggtgttatatgcatggatggagcggctgccgtgactggacagctttctggtttcactactcaggtcaaagaggtcacttctaaatgtgagtctatgcagtatgtcatccatagagaagtgctggctagccaaaaagtgtcacctgaacttaacaacatttatgcaggatgcgattgaaattaccaaccacattaaagtacatggcctaactcaggtctgttcatgcagccctcggaggagatggacgcagagcacacacggcttctgtgatacacagagtgagacgctctctaaaggcacatcactggccagagtttctgagttgcaacagccacttcagagatttcttctagaaaaagtcaccactagcagcacatttcagtgacacagaatataggtcaggaaacttgtgtacttgtgtgacagattaaacctactcacaaactcaatctgtcacttcaggggagagtgacaagtgtgtcccagtcggcagatcaagtggctgctttcaaagccaaactggaattacaggggtgatgagtgaacactgggatttctgacatgtttcaaacattagagagattgtgagagacggagccagggccttctttgccccagcgcctcagctttcagaagagcttgagcgatacttcccaaccacaaaagaacctgaactggaaaggaatggatctgtgacccatttgagaataagccaggtgaatcacctttgccaatgctagaagaagatcaactgcttgagatcgcaaatgacagtggccttaaaagtacgtttgagacaacttcaaatctccatatgttctggattaaagttgaggcagaatatcctgagattgccccaaaagcactgaaagcctgcttccacgcccaacatcctgtctttgtgaagcagtgttttctgcagtgacagcagccaaagagtgattacagagtagactggacacaagcaacacatgttgggtgtcactgtctcccatcagccccagatgggactatctagttgcaggaaaacaagctcagggctcccattgattctacatcatggtgagttgtataattatttcattatatattacagtataataacaatagaaataaannnnnnnnnnnnnnnnnnnnnnnnnnnnnnnnnnnnnnnnnnnnnnnnnaaaccccgtctctactaaaaataaaaaatcagccaagtgtggtggcacatgcctgtaatcccagctaccagggaggctgtggcaggagaatcgcttgaacccaggaggcggaggttgcggtgagccaagatctcgccattgcactccagcctgggcaacaaaagcaaaactgtgccccccaaaataaaaataaataaattaattaacttaaaaaaatgtaatgtgctcgaatcatcccgaaccatcttccctcccctgcctttgtccgtggaaaaattgtcttccatgaaaccagttcctggtaccaaaaaggctggggactgctgcccagatagatggagcaaaccctgacgttggatacttacaatccgagaggaaagaccagaactcggggagtatcttcgatgagctctcccaccactcaccattctctacgagactgcataatatgctagaatgcagaacacctggccgcccaccacaggtcagggtaagtggttagggggacacaagcagatcagagattcacaggaggagaaccaggggtcactcacagatttaccagagccagctggaaggccagaaaagcaaggtttccgtcttcaaacaagtgagaacccaagcaatagcatatacttacagtgcaaccattaatatataatcatagaattataacttatttattcttaaaggtaagttaaaactttaaggagtggaacaaattagctgaaaatataatcatgtcctataaatataatgtcttaaacgcttgagccaatcacagagattatatctgaaaaagacaagtattaaaacaatgagagaaaagctagcagatgcagagaacagaagacgatcccaataataccagagtaattggtgtctgcagaatcaaagatacagtgtggcatgaggtgatttccctgagaaagaggaaaaagccctgaatctgcaaatcaaagaagacaccgtatttcaggaaactgttacagaaagggtcgctccaaagcctggccccttagaccattgaacttggagccaagtgtctggtcgttctgttggaaaaagcagatcatctccagcagcttttagtcccagaaattaaagtatcaaggtctgcacagttttgaagagaagaatgacccaagaccctttatccagccacgttattgtttaagtaaagcacagctggccgcactctcctgaagaaaacatgtgaaatgcggcactttggaaccttcttgaaaaaaaaattgcttgacagtaacatccagcacgtaagagaatgaatcacaagaaaggccctgggaagtaaaagactggtagtgagcattgaactattcatttaaatacagaactaatacttaaatatacaactaatactaaaatatgcttaagttcagaatacgaaaatatacttaagtatggaactaataccaaaatatacttaagtatagaactaatagctaaatatactcatatagaagtaatagctaaataaacttaaatatagagctaatactaaaatatgcttaaatataaaacaaatactaattaaccagaaattgtggctgcaggacgtaccatgaatgttataaacctggacaatgtaaaagtgaaataataaaaatcaggaggtgggaggaggaacaatgtgaagaattagaagattttgtactttttaaaatgcagagtcaagaaatattgttaaaatggaagcatgttgtattttttaaaagaataagtaaaaccttttttttttttttttttttttgagacagagtcttgctctgtcacccaggctggagtccagtggcacgatcttgcagtggctcactgcaacctccgcctcccggattcaagaaattctcctgcctcatcctcctgagtagctgggattacaggcacgtgccaccacatgcggctaatttttgtatttttagtagagatggggtttcaccatgttggtcaggctggtctcaaactcctgacctcgtgatctgcccgcctcagcctcccaaagtgctgggattacaggcgtgagccaccatgcctggtcagacctcttaatgttttcataaacttctttgtcttagcttgaataaggttatttcaggaactcttgtggtaaagaaacatttactttgaagttcaacaattcttcagtttctgcttccttttttccccctgttaaattctaaacaattaaaatagaatgtgttttatgaaaataataccactcgaaatatcccattttcataaaacctgtttttctccatctctctgcacacacacaaaatatcttcacctaatgtcagcaatgataatttaggagtgattggatttggagtatttttaaacctttcacctgtattcttttctacaatatttagttctttataataagcaattcgtatttttacagcaacagtgattgttcttaaagacaaatttaaaaagccaaagacgttggcctcggttatttccctcttcacaggggaagggagtggttattgggcacacacaagtcatcactgaggggtgcagcctgcctgttattaggcctgccagagtccagtgaaagttctaggcaggggcctttttaatatttgggattttacattgctgcccagcagcttaacgtttagttgtttccatcagtggttctcattcttctttcactccagcactgagggatagcgtgagcacctgtctgcgatgctggctcactcaagccaattctcaagtggcaggatgagtgtgctgagaagagcgaggagggccacgctctgcaggatggagcaggaaagagggggggccaggaaggataccagaatccccagtgggttctcccggtgaccaggagggtcttcttataacctggtccccactcccaggctgaagagcatgggtgtaaatcatcttggtttaaaatcatattccatcaagaatgtgcatcatgcatatgtaacctggatgccgcaggcctcaccagtcaaagagtatacattatgtcacatacttattgaggtccaaagtgtgattactcttagaccacccacctgctcgcctggtgatgcctcaacccagttaacccagcggaatcctcaaaaggtgcaggcaccaattaaaccctagaagtgagaatggggagggtaaaaaccagaagcagaattggctgagaactgtttaggaaacagaccagctgttgccctcacctcatgcccctgagggcctgtccccaccacccaggcagaagtctgagtgctcgctcacaggagagactgaccaagcatttctggatgagggactctaggcccagttgaaggtgggggcattttccccagacaggagtgtggggtaaatgcagccttctcgaatgctgaggacttctcccacccccagcttctcctcactcagctctcagaaccacaggtagccaggtctgtagcttgcagacagagtgggaaacttctctgcccaagaagagatgcgtgaggttatttagtcagattccccagcagacagcctagtgagagggcccttgtagatggtcacagtgcacaggcttcaggtcccagtcagctcttagtcttccactcttcaaatgggacaaccaaggagtcccagatacctgaggaattcctgccggctgagagcaggtagagaccaaagcagccgaacagccaaagagcaacttggatgagagagagggaggggtccaggaagaagaagggtccaccaccagctgtgaagagactcagccgtctcaggtgacatcacagctgcgaaacaagaacaggatcctgtatgaagccatggaacaaaaataataaaaaaaaatcctcctggaaattcaaagcatggtagaagtgaaaactcaatggaaaagttggaagaaaagcattaagaaaatctcccagaaagaataaaaaggcagagggaaaataataaaggaaagacttttattttccaaagaagaactagtccaggaggtctagcatgttccagagaagctgagaaaacaaagagggggtaacccttgacaaaataatttttttaaacctcccccaaacgatggatgtgtttccaggttggaaggcttactgaataccctgcatgatgactgaaaatgaatgcacgccaaggctgcctccttagggggcctcagaacactgaggacacagaggacggcagtcgtgtgcaaagcaccagcaaccagaacagctttgtgtagggtgatattgaatgctgaaggcaggaatgctgggcttcccagtcttggaggagggtcacgtccagcctagactgttaggcacagccagatagcagccaggtgtgagggtccaatagaaacattcttagccaagtgagatttcagaaatgttaccacccacacaccctttctcaggatgctggtggaggacaaaggccttggctgtaggaaaccagagatcttgaaacctcttgtttcaagagaggagggaagagtgctctggaatggagagtgctgaggttaaggatgaagcagtttaccgagtatcaaggcaaccagtccagactggaacaggtttcagaggctccaggaaggattacttcaagaaatgaaaattaataggatgcctgatacaaattagcattagcaaggagattttgataagaggttaaccatttgcaattggttttggtggtaaggtcacagaaatataaatcaaaggaacaacccacttctccaccctccataattttggttccagtggggaaggaagcttttcaggaaggaaaaaattaggaagttcactatatggcacaggtcggaagagaaacgtggtgttaatgaagacactgtgtatagccctacctcagatgaccagatagttattttaggaggacggggaatatgaatatgcccgggtaagaggagctcagtcctcttctgtagataacatctaaaatcaagcagtcaaaaggcagttctaatatggtattttggagatgtgtgagatacagaggtaaagaccaagcaggttggcttgaagaagttggaaatagttgctagccaggatggggaaatggctgaaagactctttttcgcttttagagaactcatagaactggttggttttttttttttttttttgagacagagtcttgctctgtcacccaggctggagtgcagtggcgctatctgggcccactgcaggctccgtctcctgggttcacaccattctcctggccaaatataaagactttaacagtgctaggacttggccatgggttggctggatatcaggggactgtgaaactgccgtcaggcgtgtgctggaagtgtctgcggtgccgtgccctctgtagatgagatgggactagttggcgggtgcagctctgttctggacaggagtcaaggtgcctttggaaatccaggtggagttgtcaggatggcagtgtctctgaggattgtactgtctggcggtggggcgatggacagaggcagtgagtggttaatggtcagacccacagctgcagtcccaggcatcggggcgctagggtgaaactaggaaaggcttcctggagttgttgccccagaactgaggcttcagaggtgagtgggagagccaggcaaagggaagagggaaaggggcccgcacactccctgcttgaggaccgtgcccgggtcactgccggccacactctcacggtgtctgttgaatcttctggtctttctactcgcggaggacttagcagttatattgacaatcctcagacatttttggtgttattcttgtttagaatgtaaggagttccctcaggctgatttatgaacttcatgtcctgggagaaagcaggaaagttcggctgagtcaccggcgaggaatctgacagtgtgtgtccttaaactgtgatcttaaacttcctctcttcaactgttctgtaggataaggagccccgtggaatcatccctttagagaatctgagtatccgggaagtggaggactccaaaaaaccagtgagtatttttgctgagatattttgaggggagaaaggggatgggcatttcaaagattttttttaaaaaactcaaaaccaaaaaactgaaaagcgtgatcaggcttttatttagtctaattttttattatattgttcaagccaaagatgagactcgaaatcacttcttcctgtgccgtctgtctgctttatcgtttcacttagtgaatgtcacatggggtgtagaagttgcccctcctgcaatggcagcggcaagcacgcaggagtgggctatgtagtttatacccttgggacacctcccgtttagttttcctttgttttgggctgtcaggatgttactggcttgaagttaaagtcgtgagtcacctgcagttctctccgcattttacgtacattgcaagtggggccagcttatatcaggccggtgtgtttgcaaacgagactgacttctatacaatttacagtctctagaattccgcttctaggcttcacttttccacaggaaaatatgtattccttgtattttgtgaaggtcagaagaaaggggttttggggaaagaaatcagcatgtttctcagttaacagcttcctttgctccactctctccctctctgttttgattctcagaactgctttgagctttatatccccgacaataaagaccaagttatcaaggcctgcaagaccgaggctgacgggcgggtggtggaggggaaccacactgtttaccggatctcagctccgacgcccgaggagaaggaggagtggattaagtgcattaagtaagtgactgctgagaaagggcagtgcgcgcctggtgcagccctcacctcaccaggtgttgatcatcttagtggttaaacatgccgcccgcatctcttctgtgctccaagttcttagggaagcttcgtcctggttcccagctgacggcttcccaggaggcctttggattcttggctattatagcatatgtaagagagcacgtcccatctgggttccccacgtgtcctcatagacccaaaataggaagaggcgagtgagctacccacacagatgccatctgctcaactggtctttctgtgtctgacgaagccgctctcattctcatagtgacagctcagaggagatagtagtcatgttctgtaatttgtgaatcctgtgagacaccattttcctagctacagatgaggaaactgaggcccatagaggttaagaaatttgctggaagtcacataccgtgatccaaggtctgggaggagggagaagcttcctcagggttccacagctaagaagtggagctcccaagtccaggcctctgactcctacctctcgggctctgttggctccactgggccacgccatgtaaggtctatcacggggctgggaaatttcctgatgtgacaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccggggagctgcggaagcattttctaatggacacactgtctcttgtgaataggttccaggtcagcccaggagagccatagcagctgctggtgccaccgttcagcaggggtgagtgccctgcctgcagtcaggaggcttgtgcccgagctctggaacaaatcatcacttaggatacagcttccctggaaagaaattaagtgtcaggacttttagaccataagttgcttgaaagtcgagaatggcagacatagggttgtggtgttgccagtccactgcaggtgctccagcccgcggcgcggcctgcgctgctgtctttgaggctgtagcacaagcatgagctcgggccccctccctgtgcaccggagacccagccaggtccagccggtctgtccatggtgccccaccagcagcatcgtgctgggcagtgccgcctgcagagtcatggagccttagttactgagcaggtgcacgtggggggcttggaaggccccactgcattaccatgccagctatcacacaccccgtgccagaggactgcatgtgacacggcttgattacgtggcactcgctgctgcaaagcaaagtcagatgtcatcatggaaactcaagcaccagtctttttctctgaattggaatatagctgtaagaatgtggtatgattctgttcctaaatgtgaattgattattatgttgaaacaggtaaaaaccccaaaattttcttgtcacgtgttcctgtgtctctttcgaagtgtgtcaccttaggtcactgtgtggacacagcaagggtggaggacgctaacttggcctttgcagtgatggtggggtgggacaggtgttctggggcacgaggggcccctgagaaacccctgcctgggtgtgtttcttctgattctgtccctcacgtctctgttttctcccttttctgtgctccagagcagccatcagcagggaccctttctacgaaatgctcgcagcacggaaaaagaaggtctcctccacgaagcgacactgagcgtgcagccaagggcgttggtctgcgggggccttggagctcctgctcttctcccgcacctccatggatgcactgctgccgagcagagcgtcctctgccaggccccgccctggattcctagagactagcttcagcttttgctattttttttaagtgggagaagggtgggcagttatcactggggaagagaggaccggccacctgtccagcatgggctccagagccttcctctctcacagggcagagctcttgtcggcagggcagcctcctggccagtttctctgctcagtgttctggtagcagagctcagagccaactgtttacctcttggttgtccccgtgaagaagccttcaaaccctgcaccataaatacatgtgtccatatattattatatgttaagagaaaaaggtggaaaggaagagaagccacatactataaagatctatttttttttttttaagagagaacgtagggctgttcaggtgcattctgccctggctgcgctggggagcttctccctggagaagagcacctggggctgcggccaaggggcatcagcctgggcccgcggcagggcctggcctgcctctcctgtgctgtgggagctcgctgcctggtgcttgtctgggcgagatggacaggtgaggtcgaggacgcagagggcagaggcccagtggagcctcagacggcacagtcagagtcgggggcctgccctggccggggtcgcagtcggcagcagcgtgcagtccggcatctcccgcggatgcttttccatcccaagtgcctgcggagcgccgaggagaggagagagctgactggacgcttacgttattttcctccttcagaatccaagttcttgttgggctttaaagtagaaagtcagcattttccttgagctaaatacctaataaccaaaactgtgaggaaggttatcgggacagaggttccggataacctgtttcattttgggttttcttcctcttccccagactccagtcctcgttctagaggaaggagtaggacttccccgatccccgtagggcttcagctttttctgcctcaaaaccagccctaactggactactctggatgcattttgtggtgggccccctagaggggaagatgggcctttatctgctccgtggggtgcactggagtgaggggggtggccgggctgcctctcgcatctctgtcttcccctgcaggcgctgtgtgagctggccctgcccctcctcattacagtatgaagggagccgtgacacgcagcattttcctgccgttctctcagggactctcagggcagctcctgccactccgccagggccagcatgccagtccaggcagagcaggtggctggctggctggccgtctcgccccgcccctccacaggaccctggaccagggcggtgcagggcgcagccccgaggaggcaggtggaggagctgcgggttttcacagggccgcgtcgccacggctcctctgatcctttagggttggcgagcatctctggaaatagcttttgcagaggagtggtgggaggaatagagggggacagtctgtcacctccctccccgccactttgtgtagatcctacctggagggaatggctttaggcacttttgtgccagagcttgtgagggtgacagaagagggtccaggctggaaacctgaactttctgggtgggagaaccaggtggtgcctgccgaggtctgggcgtgtttgggccggtgctggagcctgtccagctggcccgggccctggcctggttctcaagtgtttcctagacagagaggcacctgggtcagtattagtctatttatcagaggtgtaaataatctatgtatagtttttctccttttagattattttgtatttgtttaaaagaagttttgtcaaaatacaaaaatataaagaaatgactgaaagttgttgacagggtttttaagaaataattattctaattgtttttgtttgtttgtttttgccttgtaaactagcgccaaggaactgcagcaaataaactccaactctgcccaagccatctttgttgttcgcggtgtctctgggctcaggcggggccctcgaggtgggaaaggggtgctgaccggacacttgtgcaggagggtgttactccagctgcaccttgagttcagttgtaacaccttgaaagtgggaggagggttctgtcttctgttaagaagagcagagtcagaaaagataagtaacttagtctttgcaccgcccccacttttttagaagaaacgtgaaacatcagttttaaattaagatcaagaaatatgccttcagtcaatataatacatttttagtatgatttcagtttccagagatgacttcataatgccagggaataaacagggaaaagtctcaggtgggctagaacccagaagcaggggaaggcgcttggtgaaccggcaccgaacagagagacagcaaagcaccaggctggccccttctgtgggtccatctccacgggctggtccgcgttcttccacacagcagcagtcatgcctgatgtttcctccttgcttcaagcccccagtctaccctgaccattccccaggtgactgccccactttactgagaagagacgaccattaggtgtgaagggcagcattcctacctttccacatcagtcagagttgtttttgttccctcccatcgccagaagaagtggcctgcttttttcctgtctcccctggatccatctctgtcaattatcctttgtcttatacatatccccagtttctttccccattaatttctttccctcaaaccacagaaacgcccatctcatttgaaaactccctaagctcaggaacaagacagagatgtccactcttaccacttctattcagcattgtactggaggttctagtcagggcaattaggcaagaaatgaaaggcatccagataggaaagaagagagattacatttattggctggtaacatgacttcataatgcctagctgagccatgggaacggggccactcccaaggctccagaactgtgggaccaccagcttgccgccccagccgggagagctgtatgtaggcactagatgccatcctgtgacagctgcggcatgggcagaacccagcacagggtggggctgctcctggccttgggggatcacattaagatgagtcagagatcattctggagtcttaagatttaatgtctgccctattgggtttcagacttacttgggattggttattctttccttcttgcccttttttcccttttggaatgggaatgtctatctcatgcctgtcccccagtgtattttggaagtgcataacttgttaaatttcgaggctctcagctggaggggatttgcctcaggatgaattgttccttgagtctcactcatatctgatctagaggagactctggactttggacttttgaattggtgctggagcaagttaggacttttggggcagtcgggatggaatgaatgcgttttgtactgagactggcgagtgtgggggaaccagtggcagaaagctacagtgtgaatatctgttccctccaaaactcatgttgaaatgtaactgccattgttacagtatgaaaaggtaggacctttaagaggtgtttagctgaactaaggaaaaatcctgcaatagtaatacatccacgaagttattaaaacgccaataaaatccatttgagaacagttcatcaccccaaagcacaccctgtctactcatcagcagcctctcctcctcttcccctggtcccgggcagtcctaatggttctgtctatgcacttgcctcttctgggcatttcatacaaatggaatcatacactacatgggccttcgcgtttggcttctttcacttagcgttacgtttacacgactcatccctgtagcgtgtgtcagagcctcattcccctttatgcccagataacattcatcgtatggagaccacgttgttattcattcatctatgggcgtttgggttgcttccgcctcttggctgttaggaggcctgctgctgctgccttt

SEQ ID NO: 12421 - DNA, 65518 bp, Human
ttaagcatctaaaaatgttacaaaatagtgtcattacctttcaaattaaacatcaaattagccagagaagttgagttgtgagtactccaacaagcaaaatattaaaaaatgaatttcaacttggtgatcccacctagtgaactaatgggatataaggaacctcttacgtcccagacaccatgcttagcattatgcacagttatccatttaatctcacagccttgcaaggaggtattatatccactgtttgagggcggagaaaacaggctcacacaaagtagtagcttccaggggtctcacagttaatattaatgaaaggcttgggcttatacataggtgtttcaggttccacattgcaaagcattatctcagggacgatctatggcatgcgcatcccgataaaaacgtaccaaatttattggctatcaactacagttccatctggaaatactcagcaaataatggcagtaaggcatcccgccacttcctgcatgattagttgaaaaagaaacacctgcgcacacacatttgaacaatgtgatacagctaaggacctggacagtcagctagcaggaagaaacatttgaacgaagggtagaccacggcctaggaggtggatgaagacacccgtccgtttgcctactgaagcaagatggggctgaggcgctcaagggcctattggctgcccagaagcctttgcagcgccgcctgaatacagcgaggatgacccagggttcaccttcagcgttgaaggcaagtcctggtataagggacgcacataggtccgcgccacatcctgacactgtttccacaggaagtgcgggataggaggggggattcattaatccaggtcggaaatacaccttgttcctcgaggattttggaaggaaattccacccgcgaagtccccttttggagatgcccttttcctttcaggtacagcatccttcattatgtacccccagggtacaatgtatccggggctcgcaacgcgtccctcaacccccagcagcgcggtcaccgcggggtccccgggcgggcgggggcggcggtgacgcaggaggcggtggggccccggtgcggcgggcgcggggagggggctgctgggcgcgggcctatcaggacgcgcggtgtttcgggcgcggggagggcggggacctccaggtttcctcggggcccggcgcagcgccgcctgccgagttccgagcgagcgcgcgaagcgcgcaggggtctcgagacgttcccgccggtcccggttttcctccgcggctcccccgccccttcacgtccgcctctttctccaaccagacgcggctccgacggcgctcggcctctgctcttccggctccccggctctgcccgcagcgcgcgtcgcccggttgctcttcgcctggtgtccgcgggcccggcgggggcgcctcaccccgggcgcgcggcggtaatgccgctgccgcccttgcggccaggcaggcagctggcggcggccggagtcggagcgcgttcgtcgctggccgggacgccgccctggcctgtgctcagctcccgcggcggccgcggggcgccggggcccggcgcggcatgaggaggcggctcggtgcaggcgagcgcccagctcctcggccccgagggcccccgcgggcccccgcgcgtggcgcgcgctggttgcggccccggcgcccacgctagccccgcgcaggcaggagacgccgcggcccggagtaggaggcggcgcagggcctgccgagcggacgcgggcggcccggaccttaagcacggggcttcgcggcgggaccccgccgggcgcgggcagcggagccgggcgtgctgcagttagctgcccctctccgcaggggcgccgcggcgcgcagcctgcgcctcctcccacctgcagcccctcctcccgccgctgcttggcggagaaaacgctcctcctcgcccttccccggctttcttccgtcctgccgtccccgggcccctagcccccagtcccctctcccccctccacctcttgtccctcggcctccgcgcctcccctcccccgactctctggcctcccattcattccgtccgctccctcccatttcctcttttccgctcgggccctctccccagagcctccccgcgcggaccccgctgcagtctcggggttctcagcacatttatggaagtttagggcctggacagtggccccgagtccggcctgagagcgcagcctgggctgctggcagggaagaggaagatgtctgtgctcaggcggatgatgcgggtttccaatcgctctctcctcgccttcatcttcttcttctccctctcttcgtcctgtctgtacttcatctatgtggccccaggcatcggtaagcaccgagacacaccctcgcttcccctggtcacaccacagccagcgcaggctgttatccgatgttacttctgggatttggaagctgtttaaacaggggcccgcagaaaagcgttttgttttaaatgttatttcagacgtgtcaaactgcttcagggcatggctttggtatgtgagttttgttaatgcatgcattttgttaatgcatgtttgttaataacgtaaaagattgcattaaatagacgtagcaaaattagtgtgatggcccgggatgccctagtcgctttcttgagtgttcatgacagctttatccatttaatgttaagtctttaagcctaaactgagtgcttaatcgtagttttattcaaacactctcgggtataataactggttgtaaaaatatggaggagccagcagcagggaatgtgattgagtccaacaatgtgtgttttctagggtcctaggtcgcttttttagaatggggtcagtggaccccattctttttgtgccatacttggggaattttaaggcgatgagttgtcttgtaaaaacaatgctccattattttagtctgcttgggtgttattttcaagggtacgttgcctttgctacctgttaggatgacttctgagaaaatagtgattaaaataaccgttatctaagggaacttgtagtttaaaatgttaaccggtttatcattttttggcctttggtgcaaaatacacttttgtaaaactgcttgaattaacttctttattaaatatccgaattcctcgtcccccatttgttgaaaaggagccaatgcggcgttaattctagtgaatgagaattatgaacttcacatgcatattaaaatatgtcatatttccaaaacttttctgagtttttcctggctattacgtatttaatgttcaattacttagtaacagtgagcatctcctctcatttctccttacacactgtggtcgtttgagccagtgctctttgttccgagttagctaaaaatgtaatgccccttacagagtgaaaacacctgcagaattttcagatggaatgatcagggcattgtcttgagtgtagtagattattgcagtgaattgcagcagggaaggaagatggaaacctaatccagactgcttcatttcttaaaattactatgagactttttctttaataattaatttttggattcagtgaggtgtataaactcagatgatgatgtttaagaagaaatgcattgtgaaacgttgacgtatcccaaaatagaagttttagggtaaagtttgaagaatattttaacattattgcagttttcctttaggccagaaaaaacaaaaaacctcacaaaaacctaccccttgaagcctatagtacaaatgacagtggtagcttagtggatttgatattatctagatactcaacaagagctttctttattttttgccattttggagtcttataaattaactcttcattctatagcaatttttactttctcatgtaactctttaaaagtttggacatctttggggtatgtttttttactaggaatttaactttgaaagattttggagaaagtttttttcacacttacataacaattttcccactttcttagtattatgagtaacatgttaaagttatattactcaaaaagctaaccaaaggaaatcagaattctagtcatccctttttttttaaagttagtgcgtcagtatattatttgtagattcttaattcaacttgtgtgaaacactaataaattttccttatttgaatgcttaatgtttgccatagaacggtcactgatataatgtaaaaatgttggcacgtgtcttgtaggcaattagattgatgtggcttaacctactctgtttttgtaggtcttataaatgataataagttattaaaaccagttagaagagtgcaaaccaaaaacttacaaaatgctgtgaaattgtcaagctgaatctgtttccaaaaccctgtaccatttagccaaaaaaagcctcctttttaatcttttgtatctttaagtattgggaagcagttttccaaaattcagattttcgcttgaaagtttgaattttatcattggcaacaaatactgtcagtttttcttgaagtgtcaggctcactttgctcattttcgagaaaatgtaggtcagatgcacaagtttaaccatagtttttcagttgttctttcaagtaaaaatgatgttccatgaaaaatgtggcttgttgagtccatactgcagcaatcaatcaattgcacaagtgcttcagatttcttatttatgagacatatccagaagtaattaggttcttataactagtttttattcgatgtatgtagatttttcttgaaataataacttcaagaaaataattcatattttagcctgaattacatcttggggcaaaatgtgtttatgactaaaatgtatgttgtaagtactttttatgtgccctaaaaagcgtttcaaatctcctctgttaagaaattcctattaatcctaccatatcaacctgtttggtaaactttaattctctttccctacttgttttctgtcctgagccctgtgtatgtcatgggctttcttcccaggtagatcttctgtcattttagttcctcttctttgccatcttgagcagatacatcacacagttgtaggcagcgtaatctgtttagtttccagtgttttcagatgttcctctgaaatagtctatttctggactatttgggtcaactacagtgagttccatagaactcaaagctcattattttcaaggaaccatttttcttgaagtgtctaatgcatacaggaaacacagggatagtctttacattataaaccttagtactcagggaaactggatggcagacacctgccccatcaccacaccataggaagtccatggacagattgctgtagcccacccctagaggccagagccataaattatttcttattctgtgtctacctttgtgcatgattgcaaagatgagtgcagtttctctccaaggttttgacttggctggattgagaacagaattgcatttaataggaaacctttattaatataacttccaatataacgtagtcattttcttgctgtcatatcaaagatgagctgacttacaagttcattcaacaataggagttgtgcacccaagagaggctggacattgtttgaggtatggaagatagatgactaaggctcattttcttccgtcatagtacaatgggctgagccccataaaactgctgtagtaaatccttggaaggcatgtggtgggaagtgagggctggttaaggatttccagaggagaaagtggttgaaatgtaatggatgagatttatctggactgagcaaagggatcctagtcagagggaacagcatgagcaaagcttctagaaaatgggagtagctccatccagctactgcttagggcttggagtggcacatgggccaggttttgaaaggtctctggggctccagtgtccagccatggtgttcagatgcttgaggtctctaaaattcctggcagagagagactggtctttgttcatacagctttatcaaagcttctgtgattacaaaataaattgatagtgcctgtaatcagtggggctatataatgggaggagattacataacttccctgggagtggggatttcactgtccatttgactcaccagaagccctgacctttcctagacacactgacgggctgttttgctctctgggtagaggtgaaatctggttgggccactttggtctgacttcctctgggcccttggaggaattatctggctgagtgctttgttatttgggcctccctggggtgtgtgccctgctggaaatggtggagctgatggcgatgggtagtcaaagtgtggggtctatgtgcaagcatgtatgttgtgggagaggtatcttaggtcctttcctcagagtccctctggcattttggctggggttcttcctgggctagcacagaaggtagctagttaaccctgcagctttcttatcatagccctttagcctcctggccctggcaagtgggcctggctgtgttctttggagctgttaatagtctgctttgtttcaaaggtctttcagttttattcacccagtgctctgatctgcatggcccatttcaggagttcggatttggtatccgaatatcatggagggccatggtattgggcatctcttttttctgggcctcccttactggccacatgtcccatgctttttttgtcctgtgagtaacaggaaatgtcagaagtcttgaaagcgatgcagtccattgtcttagagtgacccttctagcatgaaggatgggttatagggggcaatggccaatagaagattagaactgtcgaggttggtagttcatcagggcagagttgaatggatgggaatagtaggtttgaagaaacaggaacagctttaacatgaggtttggattctagcttagacattcaggtagctattaatagggagtatagaaagtcacgtctttggggggctattttgcttttagagaaattgagttgggatccctgtgtgatatccaggaagaattagtaggtaggcagatgaaagtaagggcgtgctgcccaggagagagatttgattgtcttcatcatgtaggtgaatggtatttatttatcctccaacacatctgagtaataaaactcactccttcaactggaagtgactcactgtgtgacttcctctgaaacatggaatcacgggttaaattggaatacagaggaagaccaagtatagtttgaaagtatccgatgggatttgctaccctccttctcactccctagctttgttacaagagtcattgggtccattccacactcaagagatgagagatgagttagagattgtttccacagtcagattgccattcctaagtagcatatgtgactcagctatatctcttcagtgtaaactaatccaaatcccatggccttgtgggaaattaggcaatattgaagggaaacttgattcattgaaatctggcaatgctaactgctatttttcaccttagccttccttttacaaatacatttgaagtctgttaaacaatgtggcagagtgaggcagaggtgtgtttttttctgcagcagtgcttatcattactgcctttaatgtttattaaagataaaaatagccatgtctgtgattactttcagaagagaaacttctcacctaggtttgtagtgtctgtgtgtaataggtattccaaacactacgtgtaatttggttgggactaaaatgcattttccttttgaggcagtgtggtacacagtagttaatttcctaacccgtcctgtggaaagcctgtttctcacaggttgtcctgcagggcttctcagggcacttgtccttctgggcctcatctctgatggttctagctgtggcttttcctctcaccctcagagcccttgcgtttgcccccctgtccaagggcccaaggccaggggaaacttgggcatagaagcattggtttctggagccagagctatgagcagagcagccccaagagcaaaatcccaaagagagcccaccgcgttgtccatatttggagatccatgtcttccctgccacacccctgaccccttgccagtagggctagccttgtctgtgaaatgagagaaggaaggacaggctctggaagatggccacttgccgaaagtgtcacacatcattgttggaagagctgaaatgtacaccttaggattcctgactcattctactgtgcccgagttgaaggaactaattatttttgccctggacaatggaagattttggggaaatacaagctctcttttcttcagtttgaaggaatactgtatagacgagcgatgaaattttttggatagcctaagttagcagtgagggtaattacaatgaggcagagttgaggcttattgaaaagagagagagaggaaaaaaaaagaccagtcttctaactgacctgcaatcagtgaaataagtggccttataagtgctcctttccttacacattgtgaggtgagggtagatgaccgcctcttaaagctgtgattaccctggagagggtgctttgtttgggatactggacagacctcttggattcccttaaacactgttactcagtgctgtgtttatactgtgtgcttagactccgcagcaccctggcttaccttgcaaaagggcagacctgctcctctacctgtccgccacccacactgtcttttgtgactccttttccctttcaagcctgcctttcatgtttgtcttaagtagaaatgtggaggtaggaggggaggctgaggtgagacatgtgtgaggagtgatttttctagagcttgggtttcctaggtcgccattgggagctcctcagacctgtatgtttgcaacattctttttctagtccattttcttggccgccttggaccaagctggcttttgtcaccactgcctgagcctgcggtttgccagcctaagctggctgtccccacctctttcccttcctcttttctcctttccccttgtccctctgaatctgtttcgtgttttctttttaattcctgaaggacacggtgatttaatatttaaaagatgttttcattcaaattctgccttttgtcaggataataaagagaataatatacaagtaatacagtgattcaggttgaagatcgattcaagtgaagattgagagtaggttttctgaggatacccataatgcctttaacatgcctttggaaaattaagcatttactccagttataatgagatatttttacctcatatcttgggcccactggaaactttcaggtggcactcaattctgtttttcttcagcatttacatcctgtattaggccagtttgatttgctatgtttcatggttagactgcctgtggacataattgtttttggttttagcaaaatttagctgagtttggtttaagatacagcaatacccccttctcagttgaaataggagagttagcttaaaggatgtttatgtcagtaattatatttttggctgtgaagcacagcaaaatgtttaggaaaatatacttagtaatttcaaatcttaatgttttattttttttcctccagaagtgtagtatggctttttgcttgcatctttgtttttatgtttaattacttgaattagtgaaagtctttggcttcaccaaattgttgtgttatgtgttcattaaggatgaaacacagatactcttatgtccaaatgaattgtggtatattcaaaagctatgtaaaagaagatatatttaatataagttaaactgatttggaaggaagggtctactgttttacttgttacaaatgttatgtgtggagaattactacaagaaatagttttcaaatatgaatgtgcttaaggtttatttaaggtgatatgctttaataagcttatttcccaggtcttatgggagattctgattctgattaatttttaacacgtacccagatgtttctgcacactgggagcgatgtttctgaaaaataccccaaatggtggggaaaaaatagtgctacatacttttctaaattgattatcttacatcatttgatatttcatagaactaatcttacttactgaaaacctgattaacttgtttataacatcatgttttactggcaatagagatggctgtcatggtgaagaatcttttccttcagaagagaaatggacggatacattattcataccaaccaggatcatgtgttcctttatgagtctgcagtgactaggtgattgggtcctaggtcatcctaaatttgttatttagtgtttttaattattagagacattgtaatttacttaagatcaataaaacttattaaactggatagcattataggttactcagtggaagtaatttcaaagcatttcctagcatttggctagaaaagtcatttttataatatctttacagtggtatatttaagtagctatatgaagtttgttactatgacatgatatcttgattgaatactatggcctgtttttatatatttgaggcaagtgttaatatgattttactgaaatcttgttacgtgtattgccttcctgataattaagttaattgctcagaaattatgacttctaattatagtgcaattttcagtttgactcataggaagagaaattggacattattttcatttgaatcaagagaccaaaggtagagaattaaaaggtgccttgtttactgatttgaaaatatgctttggaagtctttgaaattcatttcctacccagttcccttctctgattctcattttaggctcattttcctttcatgaatactaagttggaattctgaaaggtattttaattgtgaaaacacaagtaaattggaggtgattataaaacatattcaaatagttcacattttacttcattttgatagacttcttatatactgtacacttatatactctgacatcactaattttcaacaattttataatgtttcctgggcctgcttatttatggcttggtcttttagtctgtaatgtcattaagttagtttcctgattagatttttaagatctgtttaatttcctgcattcttccttccttgatttcttcatttcctcctgattccactttccccagtgtggttcataactctcttagggttcctgtcatgctttaaaaaagctatatagttattattttaagtgaattacacagtgcattagcagatgacaaggctgatagttatcttttgttagatagtgttttcatatcactaggttcagagtctactttttgaattatcaactagggttaaagtaggctgaactaatgatctggttgttggaaaagtccttctgatgttttagacagtttgtgcctttgcaggatcttggttctttacagaggaagccagatggccccttaacttttggcattgcttggtaaacggcagacactcaataaacatgtggataaacatgtttccaccctgaacatttttagtaagatcattggaaaagtcagttttcatttaaaaatgtttaaccttgatcagtattcaaacacaaagattctccagaaataacttaaaattgttaaactgcagagtggaaattgtaaagacaccttttacaaagaatttcttgtcagtttttagtatttgcatctgcaaagcttgagttgttagctaagatctgaaatagatctcctgtatgtgatcattgtatttgttgtttgataaagtggggctctgaacacagaattcttgcagactctgtcagcttataacttgaaaagtagaggtaaggatattatatgttagtaataatttgcactgcagatttccttgagttcatacatggttttgaattattgtcaccatggtcaaatagtactttgacataaaagaatttttttttttttaaacagcctggcacatccttgacatttgttattttttgtttttaatccaagtaataccttccttagtcctaggtgtagtatgaataatatttcatatataatctggcctaactttggggtttacaccattgttattgaagataacatattttcctttacccacatggatgagtaattcttggggatttattgaacaagaggctagatgtggaaagaagaaaaattttcagcatcagaaacagatacttagaagattatcataaattcttagaaattcttagaaagagatacctgattcacatatctgtagttattattgagtggtgcattaagattttcacttttgtccatattatttccagtgttccgtagataatatgggaaatcattttctcttctgtaacttttaaggatctcttctggctttctcctcctctttgtattaaaggaaatctggtttatctctcatatgttcacttccctcataactttttacaatgaagatttctttttccttgtctctccctctcctctgtggccttgaaccaacatttcttccaaatcccttcccctcagagtcactccggcttgtgcttgaatcctgagtttttaattctacttatgttaactttcttttgagtttgttttctcatcttctaatggagaaagttgtacctgtcgtggggtggtatgttattttcctaaggctgccataacacattaccacatgttggcttaaaacatcaagtttattttctcagaattatggaggccagaagtctgaaattaaggtgttggcaggacagtccctctggaggctctggggaaaatccttctgcgacttccagcttcaggtgcctggtggccacatcactgcctctgtcttcacattgccttcgtgtgtgtgtgtgtgtctgtgtgtgtgtgtctgtgagagtgtgtgaaatctctacctttctcttagaagagtacttgccattagatttagggtccacctgggtaatccaggatgatctcctcatctcagaatccttagcttaattgcatctggaaagacccctttctgagtgtcacattcacaggttctgggaattagggtgtgggcatatctttttggggatttccagtcagccaactccaggtggttgtaagaattaaaggaaatataattgtgtatgtgtacttaacatatatttatatgtggacttcagctcagtgcctgaccaaactcagcacttagtaaatgttagttcatcttctgctcttcagaaacctatgcctgccaagattctatatccctggacgatttcggcagtcagtgctcaattctgaatgttgccttccactttgtcccccgtgtccatcctcgttgctgaccaccaggatgtctagctcttgtcttctgccctcactccgcctgggcatgccctgggtgtcagcatagctgtggcctgctctcccttgcacctctccagaccacgccttcttaaccttctgcttctggaactttctcacctctgttaacagttatgtctcatcctcacaatgacttctcgtcctttcactctcctttgtttttttttaaactctccatctgcttgacccttcctaacttccgttactacccatctccactcagggcagattgtcattccctgggtgtgcactgcccctgtgcacttcagcctctgcttaaactttcccaccaacagaatggttttttctccttcctcttgcttcttttagtgcctgaaattattcaccctttcttctagtttttttccactcaggctgctgacatgctcagggccctgctcttccagaaaaccttcccttgaccttgctaatcacttattttccttttctgaaacttgctgctttcactttgtcagtatccactgaaatctttactattttcctttggtttccactgcttcctgaagctgctgtcttaaaggcttacagtgatctcctgtaggctttttaaagaggctaaatggtgtgatggtcaagggctagcttgctggggccacactgctgggatttgaattctggctccaccacttactaacaactctgtgacctgtggcaagttatgcaactccatgcttcaatttctttatctgaaaaatggggataataatagtacctgccttatagaattgcttgtgaggattacataggttagtatatgtaaagtatgcttgacaaagagagtatgctgaatttttttaagctgttgtttttaagtccttctccttagcatctgcagcatttcacgtggtttacctctccctcttctttagtccattagcattttcactgtgttcaagctgagattaattcactttgggatcttttatctttgtgctgcctatttgtggtctgtcttcatacatcagatcttcaccttcttatctcctttttggataatttttcctctgggaatttatcacgatagttccaggttttacatttattgaatgtctccccaaatggtatttctagccctcttgtagcttcagtcctacatttataactgcatcccagattgcctgaccaagatcatcatctccctctcaaaatcatttattcactagacttttgttaagagacctgggaactgtggcagcatgtcatagcagctaggaacagagatatcaggatcacagggatgctgcgttggtgtcctgcaaagcccaggaaacagttctagatccctgcaggcaggcatgttcttcttatcttgaatccttacagcactgttagtgagcaaagctggatgtggaaaggggctgggaggcacagttttatagcagatgtgtcccttaattttcttaagtgaagaattagacaagtttgcctcataaactcaggatagaatgcctggcccaaaagctttcataaactgttgaagataggttttattctttctattttttaaatttttttctgatgttgttaccctctgggaagcagaactggtaaagaagttagatttatgtctcacaatgcagagtcaaatagaaaatgaatgaaattagagaacacacagcatggttttaattaagcagtggtaggtttccctattagttttatgaaatgagggtttcttataaattggaatagatattttagacaaggattttctctacctaaagtcttgccaataagaaattacattttattttttgcaatctatccatcggacaaagggctaatatccagaatctacaaagaacttgaatttacaagaaaaaaaccccatcaaaaaataggcgaaggatatgaacagacacttctcaaaagaagatatttatgcagccaacagacatatgaaaaaatgctcatcatcactggtcattagagaaatgcaaatcaaaaccacagtgagataccatctcatgccagttacagtggtgatcattaaaaagtcaggaaacaacagatgctggagctgttgtggaaaaataggaacacttttacactgttggtgggagggtaaattagttcaaccattgtggaagacagtgtggcaattcctcaaggatctagaactggaaataccgtgtgacccagcaatctcattactgggcatatacccaaaggattataaatcattctatgataaagacacatgcacacgtatgtttattgtgacactgttcacaatagcaaagacttggaaccaacccaaatgtctatcagtgatagactggattaagaaaatgtggcacatacacaccatggaattatgcagccataaaaaaggatgagttcacgtcctttgcagggacatggatgaagctggaaacgatcattctcagcaaactatcacaagatcagaaaaaccaaacactacgtgttctcataagtgggagttgaacaatgagaacacatggacacagggtggggaacatcacacactggggcctctcgggggttgggggactaggggagggataacattaggagaaatacctaatgtaggtgacgggttgatgggtgcagcaaaccaccatggcatgtgtaaacctatgtaacctgcacattctgcacatgtaccccagaacttaaagtataataataaaaaaaagacattacattttatactactactaataagcaagttttggatttgggttaacatagttttatgtttggaaagcagacaattggaaccattctcatgctggtttagtgtgtcttgcaaccctgtgacatagcactttcttccggttaacagccactttctgtttaaacacagcttcattccctaatgggttttggtctttagggattaaacccatgaggaccattaacctgaggaatgtaactcaattagctgtaaatgatttggaataaaggaatagattttctatttggagaaattggtgtgttgcttttcttaattttggtcttcattcatctaatgaatagtaaatgcactcttttggtaaataattcacctttgttagaggtaccataaaaaatcattttaaaggcctggtgcggtggctcacgcctgtgatcccaccactttgagaggctgaggcgggcggattgcctgagctcaggagttcgagaccagcctgggcaacatggagaaaccctgtctctacaaaaaatacaaaaaattaggtgggcatagtggcaggtgcctgcagttccagctacttgtgagactgaggtgggaggatcgcttgagcccaggaggtggaggttacggagagccaaggtggagctaccgcactccaacctggatgacagagtgagaccctgtctcaaaaaaaaaaaaaagatcatcatttttaacagttttgttacctacaagttgtataatttaaaaagttgtttccaggaaacataataatgcatataatgcttctacttagcatctcatttcttaggccagggtcagtcctggaagtacaagttttttgccttaggctgagttctagtactttgtggcaggttttcttttcacagtttggtgtagcacaaatataagatgtttatattactgacaacaaatttcatatgtaactttaggattaaataatccaaggtgctgcaaaccaggtgtcattagtaatctatgtgatgctgccccacccagataatttcagttgaactttgggtcttcacttaggcggagttgttaatgttagcttgtcttctattgaacattttcctgcatttttggttggctgttcttttagttttcttttttctcttcgtctcttttcttccatgtttttgtagttaccaaagatgaatttgttgctgtagatactttcattattaaaaaattaatatggattaagaaattagaaaaaagtctatacaagaataagatcaggaactaatacatttaaaaatagaggaaaaaagaattgagatattcaagacagattatttaagtataagcaatggaatacacaaatatgacaagtcttataaaaataaaagggagtgcttgctctggcagcaaatatacaaaaatgggaacaatacagagattaacatggcccctgcacaaggatgacatgtttattttcaaatttaaatacaaaaggggagaaaacaattaaaaatcaaaagtagaagagattcgaaaattacgtaagttatgcacagctttacctaatttgaatatctcaatgaaactttgaatctctgggacaaaatactccaaattgtatcaagaataaatagaaactgaaatacacctaatacaatttctggcagagggcaggcattcaacaaatcaacaaactgatacatggacagagaggaattggaacaggtgtctgattacaacttttttttttttttttttgacacagggtctcactctgtcacccaggctagagtgcagtggcgcagtcctggctcggctcactgtaacctctgcctcctgggttcaagtgattctcctgcctcagcctcccgagtagctggggttacaggcgtgcgccaccacgcctggctagttttttttttttttgtatttttttagtagagacggcatttcaccatgttggccaggctggtctcaaactcctgacctcaagagatcgcctgtattggccttccaaaatgctgggattacaggcatgagccaccacgcccggccagattacaacttttagatgactttttatgagaagtcaattcaaacttttaagggcttaatatctgccacactatatcagttgttgcagagttaagaaaatgacagcaatgtgtacagtctattttatgaaactaacattaagaacaaaaacatagatggcaaaaaacccacaaaccttacttatgaatatatatttaaattgtatgaataagtttttcccccatatggtctatttattttaaataatttcaacttttattttagattcagggcatacatgtgcaactttgttacatgggtatattgcatgatgcagaggtttggagtatgattgatcctgccacctaggtagtgagcatagtacccaataggtagttttaaacttctgccccgctttgtccctccctcttgtagtagtccccagtttctgttgctggccatcttttgttcatgagtacccagtgtctagctcccacttacaagtgagaacatgcggtatttggttttctgtgcctgtgttaattcgctaggataatggcctgcagctgcatccatgttgttgcaaagcatatgattttgttcttttttatgactgtgttcttcattctttttttttttttttgagatggagtcttgctccctcgcccaggctggagtgcagtggcgcagtctcggctcactgcaacctctgtctccagggttcaagccattctcctgcctcagcctcctgagtagctggggttacaggcttgcaccaccatgtccagctgatttttttgtatttttagtagagatggggtttcaccatgttggccaggatggtctcgatctgttgacctcatgatccaaccgcctcggcctcccaggaattacaggcgtgagtcttcattcttttaaagtccacttaagtacaaaaatgtagtcaaaatgtgttgtatttgtaaactagtatagtaaattcaggtgtaggcaagttaaatctaattataagactactttctagaaagcctgtagacatgcttttaaaaaaggtatctgtaaagcttatgtgaaacctggatttctgtttgtctcttttttctggaggtgaaagaaaagttttattttactctgcttttctagtagtttaatttatgctctcttcatatgtactttgagcaagttcacatttacataaaaagtgggaaagaaggtagtaaacattaaatttctctcatccctctattccatcttgagaaactggagcagcacttagaaaattagtcagcattcctaatttttttcattcagcattcatctttggagagtgtcattactgtattcagagacagcttatcttaaaattgagtcattcactgaggcttgcagtttcttggtttttgccatgatagtgagcctctgcctctcatctgaatggagtttatgattttttagctttgtgtttagagactttaaagaagaatgcactacttgcacacctgccttgtgaaaacgaggaaactgagatccaaggagctgtacaaagttatgcacagcactaacagaattgggaccaggaaaggagtttctgacttagttctgtgcctctggggagtctggacatctcaaaagttagggatttttgcgataaagctttgtcaatttaccagtttctcccagcagaagaaatttgggtcctatttttgaagcacttattgtgaataattaaattgagctgctttaaaaatacacattgattttgattttatttgcttttaccatcctggtagaaagatttgtgattgaaagggagtgtaaaagtttaattaactcttagaaatgacccaaacagatactgatcctagatcacccctccccgcaaacacatcaagaattttcaggaccattgcaagatctttattcctactagatattatgggatttataaggaatcctagcttttgtgaagtttttggtaggaaattaatatataattagagaaactgaattttgtaactgtaggattgagcatctgtaataaaatgcctttttgaaatttctaagtatattttatagtagaaaatcacagatgtgggggttcattataatattttagtttgttcagttagtttcattctatttgataggtgggtatttcaactttttttttgtttttattcttaaaaaatcagtttgtttttgtcagtttttatagtaggcaatattttatatttctgttttgcgtttggacgtgctgattgagtcagtttatgtttattgggcacttccccaattctgaatattattttattaaataaaaaaaagcttactgtgttatgacattctttctctatttttcttttatagccaacacatatctctttatggtacaagctcgaggtataatgttgagagaaaatgtgaaaacaataggtcatatgatcaggctgtacacaaataaaaacagtacgctcaacggtacaggtaagactacttcctgcttaaccccttgtagttacaaagcagtaaaccaaatcttttacagtctgttttgccttcaggtaacttcctgttaaagatgaagaaggtatcttcccctaagcgtcctggtagattattttactgtgcaaatcaagactgttacctattttaggatgtatgaacgtgtggtcacaaaagtgatgaggttttgtacagacacttaagttaattcttgtaaacaaaatatagaaagcagcttctactttttcaattcgtatgttgtatttaagagaaattaaccagagaataatttattcatcttagtaagccatactaccatctctctttatgttcattctagttcctaagttgttcttccaactaggtctagaaaatagttgtttttaattatagaagattgttaatagtgttatggcctttttaaggagctaaaggagaaattttataaaattggaaattggtagctactcctttttattttacttatttatttttttagacagagtctcgctctgttgcccaggctggagtgcagtggcgcaatcttggctcactgcaagctccatctaccaggttcacgccattctcacgcctcagtctcccaagtagctgggattacaggcgcccatcaccacgcccggctaatttttttttaaatttttgatagagacggggtttcaccatgttagccaagatggtctcaatctcttgacctcgtgatacgcccgcttcagcctccgaaagtgctgggattacaggcatgagccactgtgcccggcctactcttgtctttttaaaatgttacctggaagtagaagctccattagaattccaggaggttaaaatctaataggctgaaccaataatttaatgatggtagaattgatgtaaatagatttcactattgtggaagaatgtgaatgctcgtttatggcagggttgccacagtgtctgccagggtattattaggtgttactttaaaggattcagtggggttgtcagttgttgtaccctttatggtctcattttgaacagttaaaaataaagatttaatttgtgttagtaattcttccttgtgtcactgtaaacctacacattctactaagagaaagtctgtctttcagctgtagatgttctttcttaaatgtatgtcaaggtgggtgatagttttagacccttctaaaaattcaagactgtgacatattgatctcaatttaatatcacatgtgcttctataaaatccattctagtcatttgcctaatatgtttatgatgccacaaatcaaaacactcttgttttattttaattttttaaccttgaaggaatttttttagaagaactgcctcagcatagttgatgttttaattctacagtaaaagtctcattaactattctttagcatgaatgagtcttctgaatagtaggtcaattttagaagtttaaacattttaaaagcttctgtaggatttgtgctggttgaataagttgattgtaaaaatgttcactgaaagtttgttcaactgaaaggaaatagacatctttaaattggtgtatttgtgtgagtgctaaaaatttgtgcatatcagcttgttttccctggggtatgaataaggtatatgtgtggatgttgagcttgattaggaggaatgattacatgggcaagacaatctttccccatagtatcctgcaaccaaaaaaaaaaaaaaaggaaaatcctttcctcctctcaccaagtcatagtttcaataaagaccaaagaaccaatgcatacttagattaaagtttgcttacttttatgaaactttgaaaacttttcatagggttcctttactaatggtaaaactgttctcaggaaacagtcattgtatacattagggattaggtttggatgtaacagagacctgcctgtggtggtttaaacacatgaggctttctgttctcatgtgaaagaactctgcaagttggatatctgtggctgttatggaggctccttaaagtaagtcatcacacacttttcattttctgccatctgtcatgtggctccatggttaactcatagtctaagatggctgcttgggtgccattttggtgtttgaacttgggtcagtaggaaggaggaaagcgagaacaaagaagaacaaataaggtacctcttttctggagccttcccagaggtcccacacagtatttcttcatacatttaattggctagaacttaattgcatggccacatgcgataacactgggaaatatagtcttgaccagagtatgctggaactctagtgaaactggcattctgttacctacggggaaagggaagaatggagtttgagtcagcaatgaggctccgccatgttcatttagccaacatttacgaataattattatagttagtatatttaaccagatattggagacacaatattaagaaaaacagtctcctttaatatgaggatctctaggcctctgggagagatggaaacatgaatagttatttataatgcaactggttatttctacatagacttctatagatacaatatccaaaaaagaagataatggcctataaggtgtacaaaaagctaactgagctctagaggggaattgattaatatgcagtggctcatttataatttaacactaaatgataaatagattgtgatagttataagcacatttgatttccaaaaggggtttttaatcctatacctgactttctgtggcatcaaatataaatagatgtatactatttttgtaaataaattatatactctcataatcagatggtgccatgtagcccacagagccaaattatgaaaacaagacgtattcagtgaattcatctaattactgaagcagataagggccatgcaatgttagagtggataggtttgttggaaataacccagcatgcctcctcatttgatgggtacatgaattgaggcccccagacactgccagactgacaagacaagttagtgggaaacagactaggactctcatcggtttctaacacctgttttaagctgctgtttcgcagcaaaataaagccattaaaaggtgttctttggtgctgtcctccttttcctttaagtgataaggtccagtgagaattagtaggggatccatctggcagttttcattctttgtttgccttttctttggttgtgtttctggaagggaggaagaaagcagggggcccagagctcattttatttttatccattcattagatgaaataatgtctaccttttatagcagttgtggtggttcccaaatgcatctgtcatacataaccttttaaaatgcttcctgactttgaaagcagtggttatacatgatggacattgctcacctaacaacttttgtaggaataatgattttgtgggtttttttgtttttgtttttttttgagacagagtctcgctctgtcgcccaggctgaagtgcagtggtatgatctcagctcactgcaagctccgcctcctgggttcaggccattctcctgcctccacctcccaagtaggtgggactacaggcgcccgccaccatgcctggctaattttttgtatttttagtagagacggggtttcaccgtgttagccaggatggtcttgatctcctgaccttgtggtccacccttttggcctcccaaagtgctgggattacaggcatgagccactacgcccagccaattttgtgggtttattacagtaaaatctccaaaagcttaaatcattattggctgtattatcatttgtgaggtgtttatttatagtatgttcctactatgttgtaggtactattattaggtgctagaaatcaaagataatttgatttcaattaaaagagatattcagaataatggccggggtggcggatagactatatacacataatacattgggaagacacaaataccactggacagagtactgaaggagtgtggaggtgtttctctaagtctggcagtgagttgagctccttaggaggtggccaagaatagcagatgtttagctctaaaactttgtattcaatgaagtgaatataatgatattgcgtaacttgaaggcacttaaatgtggttctttaaaaactgataaaagtgatggaatgtttactcttgtgattcagtcattctagcactaaaataaaaagtagaacaattctctctggccctcctgttgccatctgactccccagaaggagttaatagtttgttttgcagaaatgtctagagagccgagcacttctgtgagttggatgtgggttcagagaatcatagcatgtggctaagagaaggagcccaagcattaatgatgaaattaataaattatgcagagtaaggaaatactcttatttaaagttaatgcatgacattaacaaaaggattgaatgaaaatgtagatatttttctgcctcaggattataagaaaatgagccttgtaacgtctcaaggcagatgacccccagggacaaacttacttttttttcttttgtattttaaaatattgttatatcatagttgtacatccaaggacaaccttatttattgtctcattcctgtgaatgtgtagtgtatagtatgtccttagtaaaaattgaagagattcagaaaaattatcatctctatatagctagcccatctttttttctggtggtatgtgcaacaaaagctataatatgaactctgtgtgtgtgtgtgtgagagagagcgagagcgcacactagctaattaatgaagaacttgccattcaatatttattgttttaactgctcatttattcatattcttgcatttttaagtagaactttttatattttaatagtagaaaagggtataatgtaataacagtctcctagctcactcctccctgagtcccaatcctcagagaactaacaatttattctgtatttatctttatgtttctatcctgctgtctcttgatttatcaatttaaactactcttgttatggaagaaagacatttagtattatagtctcaccccaatttttcctatccttatccccaatataattatgtcacaatttaaattcaaatcggtattgttgatgttgttaagagaatgtagataatggtttgttttcctgagtctagttgtgattgttcgttttgtagatctgtttatttttgttgatgttacttgttaactctttttccccccaatttgcagagccgtcttaatctatcgctgattttcccttaggcacatgagttgaccacgctaagggggggtttccaaaattcccatgccattgtcttctctcttccagtgctgcttttgagaagtctgttgaccatcctgatggcagttactgttcatggaccagttttttctggagacttttgggatctttttgtatttttaaattttacaaagagcatcttggagctttgtttttcttctcttgctgggagcagtcctatcagtatggaatatcttacccttcatttctccaaaatatttttatattatttctttgataatttgtcttcctattattttcctttctttttggatctcctattatgtattatttctctctcgtttttcaattctttttctttcctttctatctttctgggagattgctctgactttactacaatgctttgatttgattttttaaattttggcaaacttatttttaagaattcttttttttttcttttcttactgttactgtctccctcaaataagaatgccttatcttcctttccaggaatattgaagataaataagtaactctaaggtgtaaatcaatgaacttgactagacactgtcacaaaactcataacaatagtaatcttaagcagttttggtgggagtgacagaaacccaattcatgcttattgcacttgctgctaccactagcaaggtaggagtccccatagagagagaagccctttttttaaaaacaaaaacaaaaagaaaaaaacaagaattttggtatatatgtagatatatatatttaaagaatcaggccaggcatggtggctcacgcctgtaatcccagcactttgggaggttgaggtgggaggattgcttgagccgaggagttggagaccagcctggcaagaccctgtctctacaaaaaatacaaaattagctgggtgtggtggtgcatgattgtagttccagctattaatagttgggaggctgagctaggaggatcacttgagcccaggaagtcaatgctgcagtgagctattatcatgccactgcactccagcctatgtgacacagcaagatcctgtctcaaaaaaaaaaaaaaaaaaaaaggaaaagaatcagaactttattggacttccttacacttgcttttgcttggtatctttaaatcttttagacatatggggaatacattgagcatgggctaccagtgtagtgtctgtggtcttggggtgtcactgggcatacaaaacaattaatgttcactgaatttctcctccccttgttatttggaagattttccttgtcagacactttccagcactcgcccagggagagtggggaggattgtctcattggggctttcccacttcctggtaggataggccttagcagttgtaccatcattgatctctactatgttggggttttctgggaatgcatttaccttaacaccttactgatgccctgtgaaatttgtaactggggtttccaagcacttctttggaattggaccttctcttgtggcttctgtttcctccttgatacccagcctggaacctttgcccgtcccaacaccctctgcttagcagccgtggcagggcctctttcattcagcagtcttgcaggtggcgtgagtctctgccctgaagtactgtcctgactcctaggcagcatccccaccaactccattgtgacaatgactgaatattgatgttaggtaaaggtgtgcaatggaggtgcttagttttctttggctcctctcacatacttcctatctaattcgcaggattctctcatttccctatggtcagagggtttagcttctacattgtctctcattggagcagattactcaacattcaaagaatatcttcacattttcctaaagtgtctgctagagtttcactttctgtagtacattgtttgtgatccaggagacagacggtagtttaatgagctgtttccgtctctcatttcactcattgcatgttgatgtcattctcttaggccagcttccctacatagcaggaaacctgtgtgtcatggtttctagatttgcgtctcagaactttgctccagaaagggactgaaatgtgatctctctggttccacattcaaaaatcctgagcctgtgactgtctcgtgggtcaggtgctcatctctaatcgctcatagctacagttattagctatttctatgggccagggattgttctcagcaccttacacattttgtcttattgaagtttaaaaatgacagtatgaagtaggcatagatggcaagctacatcgtgtcctgccctgtatcacacagctacagtgtgttggagcaaggatttgaactcaggcatttgactttggtgccctgtatgcagtttaatttgctgactctaaagataatggacctaatgtaataatagctccagggctcccccggggctgcagcccacaggctgggaatgactaacttaaaggtttagaatgagctgtattacaaaagtaagttgagtgggtaaatctcagtttctacagtgtgaggtggtaagaaaacattactcccacccctctgctctgtggatgctagtagcagcacgcagcggtttggaacacccctggctgtgccatagtggaggggattccctggtgtactttcacactccctttagatcgggctcagccaggggagggacgggagcaggtgttctcacatggttgcaagtgggactgccatgtctgtgtgcaaggataagggtgtgctgctctctagatgtctcttgggaaatcatgctgagaggtctgttccccgcagcagtttgctgttctctagttccttaaagataattgattttaagtacttctgtagattgtatattgtagttttctcccagtgatagtgacgtatttcattccagggagaaagcaaaaggccttttttttttttttgtaactcttttctctctttccaagattatcccgaaggcaataattcaagtgattatcttgttcaaacaacaacgtatctcccggaaaacttcacatactcaccatacctcccctgtccagaaaagctgccttatatgcgtaagtcgtcatctaattttgacttaactgtttacttgtgttacaatacagtcataaaaaccacatgatttgagtgcagcaggagcaggtcatgtgcacctgggtgcaaatgtttatattatgcagcatgttatttgaacttttatttatttatttattttttggcaaagcgctttttgaagggggatgattgaaaagctgaagaaaaatacaaagggggaaaatgacaaatacccatattgttcccaaccagttttaaaaactaatacttcggcttacctatgtccaagttcttttaaaacagtgcttaagagagcaattaatgtgtagtctccttttgaatatgttataatgttcctgattaagccagtcctttttgaccaccatccccagtgctggctccccattccttcctcagaagtaacctcacctctactgagagtttgctgagtattctttccggttatgaaaattgttttctacatagatagatgtctgtatagaaaatagatattgtttcaaaggagaaattatgtaaattggtctataaagtacatttcattcttgtaacttgcttttttacatacttttttgagaactacccatgttgttacatatagatctaatttttttcccttaactattactgtgtggtacgtctttgtataaatgtatcacatctcatttacctgtttccccactgatgaacatttaggtggtttcaacatttttgctatcacaaaatagcaaaaaaaatatatatatatattttggtataaagaacaacagagtgtgagttttcctgtgcgtatatgcatgtgtacttgagggttgatggctagtggtggaattgctgggtaggttggctcaggttttccagattttgtcaattgctctcaaaagcagctataccaatttatatccctaacagcaaagcatgaatgtaccactttgatattgatggacttttaaattcttgctaatctgaaagataaatggtttctcgttgtttcgattttcacttccctcattcctggtgggtttgagtaagttttcctatgtttgtgtttttaaattttctctcctgtgacttgctgcatcatgggctttatcagttcctggttggttattgtgtgttggtattgatctgtagaaattctttatattctggcagtggcctgttgtctgctatgtgttttgtaagtatcttttcacattcccaggcttcttgttttgtcttttattttatggaagtttaaaattatgaccttttcaaattttttaataactttacttaggtgttttgcttttttttggtcttaaaccttttcttacccagaggccatacagataaatacctttatttccttctaatgattttactattttgtttttaacctttgtgtgtaatatgtggtagtgataaagctactgtactttaaatatatatatttttaattatgaagataatacattatcattattttaaaaaaaacactatactgtactgtcaacactcagaagccacacggctattattttagcttttttttgtgtgtgtatcttctacccctgccccatgatttttaagcctactttgtacatataggtttgtatcttggatttgatataaagatttaaataaacatctttttgaattgcttatttatccatattctgatgtattttgtatctgtgttttttattcttgacacgagcttttttaattgaggaaattagcctttgcctatcatatttgtaggatttgttttagcttattgttgatagatattatatatcaataataaaaagaaagattgaccttctaatatcatctaaggccatggctttcagtcttgggggtacatcagaatcacccagatcatcttgtcaagccccattgctggtccagctctcaagagtttcagactcagcaggtctggagcgggcctgagaatctgcatttctaacaaatcccgcaaggtgatgctgttgccgctgagccttgggccacgtattgagacccactgatctagagtagtgggcctggtccctggtatttaagaaaaaaaaaattctcaggtgattctaatcttgctgtctctttgctgtaccataataaagaatggaactcagtgatttttgtggttgtcattactttgttattgcagccttgttttcctaaaaatgaatacttttgtctgtgtaatactgaaaccactgggtaatgttctgttgaaatattgattacaataatttcatcttcataattttcatattcaaggtttatagtttcaggaaatctttctgttcttggtttagttgccattttctttaattagtgctttatgagtactaattaaactctatttcaaagcatctgtctgccacttcctcattctggtactcctctcctcccgccccacagcccattgtaccatctcttgtggtgcctgagagattgcgtcgtgcgtggctgctgtgcactgccttttcactgggggtggggaggggtctcagcactactgccccttctctctgcttccctgggatccttgcattcttttataagagaggatcacactagtgtggccagccatcttttcacagcagtccctctcatgggctgccaactttgggtcctgtcccaattttgtgcccaattagtggtggccgtggtggccatggtggcaaggtgatttggtagaaaatacagccacatacagataaggctttagaaaggagccatgggtacagccaacataacgaggcttctgccaagagagccttgcacgagctgcccgacagagcacttcacttgtcctgtgacctccgcaaagtggaggcttagtttacctacctgtaaaacctgggattccaataccatctgcagagtgtggtaaggatagaatgaagcacacagtgcttaaagtttgataggtattaatttgattctccctttccttctccctccttctttgaataatagagccagactttacaatggtcaaggaaatgagacacctaggagaaatgtgtggagtttagaagttttattattagctatgtatccttacatttttttacttaaaaagatagttttcattgataatagagaacaatgcaataaaatacataagtataaaatcttataatagttacacaaaataattgaatatgattctttcccaaataataattagaagggatttgtgtaagaattagatctacttagatgaaaaccattcaagtacaagtaatatttacttatagtcactaaaagtgaagttaaggcttaacactggtgtatttgattattctgttgtaaacttctttgatttttacttagtatagcaatggaaacactggcactggatttctgtaaagataaagtgaatttttcaaactagaatacagataaaatgtgtttcatacatttcagcagtgtttcatattcaatagtggccaattacactataaagcctattttaatatgtatattttatatgaagagtatgagtgaatacttctttcttgtttgttagtatttatagattttccaaagggcaaatccacattcagctttattgcatttatgtaagattctttgtgctaacaaagtaaaatagaagtttcaccttgtctaaggctaaaaattaataagtgcttagtgtggatgttttgattttaatttttatgggtgaggtagaaatggaaaatgtcaattgcatactctgcattagactgaaaatagacttacctttagttttcctatcttttaattcttattcaaatagaatacgtttgcagtgacctttatatattctgttcttactatttgtggaatagttccctttatggtttaaccctgatagtttctatagttgctaaccttatgaatataacaaaagctccaaggacttcttgagatggatttaaataattcaaatgaaaatcagcaaagaaggaaaagataagcaaacaaacgtcagcaaagctcaaataatgctaatgtaacaaactgtcatgcatatgtttattgtaaaaaaaaaaaatgagatgggagccattttagagtcaacaagtcattgatgaacagccgctgtgcagcggtccctgtgttgttcatagaagcaggtacgggagagacaagactgaacgtggtcatgtgtgtggcagcttggagcaggtaacacacttggagaaaggcatgctatgaaaagattatgaggccgggcgtggtggctcatgcctgtttcctagcagtttgggaggctgaggcaggtgggttacttgaggtcaggagttcaagaccagcctggccaacatggtgaaacctgtctctaccaaaaacacacacacaaaaattagccaagtgcagtggtgcgtgcctgtagtcccagctacttgggaggctgaggtggagtatcgcttgaaccttggaggcggaggttgcagtgagccgagatcgcaccactgcactccagcccaggcaacagagcgagactttgtctcaaaaaaaaaaaaaaaaaaaaaaaaagaaaaaaggttatgaatgtgacaaaagggagacagcagtttattttggaagggaaaggacgatgtcagagagaggtgtcatcagaactgggtcttacaagatagctgagagagaacagcatcaccacaagggaggctctgtgtattcccggactggagagtggtcggctctgcccagagagggtgtgttaagtggcgtgtatgggaaatgaagctggctagaagggtcttgtgtaaaggactgaggaatctgagggccttgtgggttccatcattcctaggcatccatgaggtgagcttcagagggagaagagcctgtgagcttacatgcagacagttgatttatgagcctgtatgcatttctctcaggtgacagtgcatgattttcaaagggtctaggggcaaaaaaaaaaaaagcaaaaataaacaaaaaacaccactgctttagggaaatggagaaccatcgaaggctttaggcaggtgaatgatggactaggattgtattttaggaagattattcacatgagaagctgaacaatgggtgagaatggagaaatactgggatcagcaggagaccaatgaggagcttgctgcaggaagccgacgggcaacaacaagggcaagtgccaaggctgtggcgttggagagaggagaaggcacaaaaaagaacctacagggtgccattggccagatgtggcgaccagttgaggggtgagggttaatttccaggtttctgacttggtgaccatgaactgaagtgtgatacagagtaaccgtcgcatttggaggatggggaagttagtgggttccgtttgggccgttttgtttgaagttcaagagggttaacttggggtctgcctttagtaagagatccggactgaacatcagaggaagtgagaggggaagaaggctgagagtgggtccctgagaaaatccgtacttgtgaggtgagtggcggttaacagaagaaggggagacaggaacctagagaagccagagggtggtgtctggggggcgaggcaggaacacatcccagagagacaagactgctgtgtcttgtcacacacctccagacagcagggagagtgaggaactgtgaaagggccactgaatttggtgcagaaaacgaatggagaacacagcaagcacgaattcagtaaaatgattgggagagaagcaaagtagactcttgagaagtgcgtcagaagtgtatgtagactgtaggtgaaatgagagaagtttggtggcaaagggaaggagattggggtaaaggatctggaggaggtggaggtaagggaagagctctttaggaagagatggacttgagcatgttgtaggcatcatggaaagaaaggatggagagaagaggccgggcgccgtggctcacgcctgtaatcccagcactttgagaggccgaggcgggcagataatgaggtcaggagatcgagaccatcctggctaacacagtgaaaccccgtctctaccaaaaataaaaaaaattagctgggcgtggtggcgggcgcctgaagtcccagctactggggaggctgaggcaggagaatggcgtgaacccaggaggtggagctggcagtgagctgagatctcgccactgcacttcagcctgggaaacagagggagactccatctcaaaaaaagaaaaagatgaagagaagagaactgggaaggatgagggagaagcacaagggaggtctccatagagccaggttagaaagtgaatggagacaatgcctcaggttgaagagtgagcatggaaagcctcaggaatgcctcctcccctgaggaagcccgcggtttatttggagatgaggtggagaggtagggtgctcgtgcctgctgtgtctgttttcctagtaaagcaggaggccgtgtgtccctgaggggatggccaggaaggattgagcagcttgaaagggaggagtaagtatttaaaaagttgtcatagggaatgaaaagtgaagtcaactaatcataaattagaaggtgactaacaggttatcctagagagccccccaccccaccctggtggagtcacaatacaaaaaaaaagtgacacttgtttttgctgaaaccttactatgcttgaggcaatatgttaggtattgccacccaaatgatgggattaatctatatgcttacgtgctttctttagtgctgtttattaggtaaagaattggagcatggataattgtcgctgcaaggatgggacctgtagctcaggtgtggcaggttgagggggtggtagataaggtgtttgtcagtgtgtaggtgctgtgatcgggtgaaggtcatagagctgcatttctcttaagtgtgattcagatgatctacacttgttaaaaatgcagctgggggctgggcgcggtggctcacgcctgtaatcccagcactttgggaggccgaggtgggtggatcacaagctcaggagattgagaccatcctgtctaacacggtgaaaccccgtctctactaaaaatacaaaaaattagccgggtatgatggcaggagcctgtagtcccagctactcgggggtgaggcaggagaatggtgtgaacccgggaggcggagcttgtagtgagccgagatggcgccactgcactccagcctgggtgacagagcgagactccgtctcaaaaaaaatgcagctgggatacctgttaaaaatgaagcctctgagctaaaccctagactgcaaaagtcagggttcttggttgcaaaccacagaatatactttatctgatttaagagaaaaaagaattcatgaaaatatattagagagcccagagacaacctgggtggctagagaattaggttgagaaattgagcagccagaacaaggctcagaccgctttgaagcatctcctgctgccacttgtcagggcttaaacctcctaccagcattgctcaggtctggagaccagaagtgccacttcttggttcctgtaaagctagaagcttttgccaccacttcgggtgcatttggtcatatgaccactcctacctgttagaggggtttggagagtgggttctagctttttcctttgaaaggcaggacccaatggtgggtagttcaagccgttgaaatgtgttcagttaaagccagtggccataaacgtgacccatgagcttcaactgacacagaaactttgacaatgtggccagtcagctgcattttaaacaagcacagctggtaattcttaggcacacatcaaaattagcaaaccactttatacagaggccagtgtggatatagcagagaggacttcaagtcttcatggaattgaagagggacttcatgggaggggagtgggagaaggtgaaagagaaagaggctttaatgagagggtgcagtgtcagagttgaaagccagtcatttctaggtgactgtggttcagggtctggacacagagctgggtgtcactgtgaattcactattgtgaatattgctgcaatgaacataatagtgcatgtgcctttttggtagaatgatttattttcttttggatatttacacagtaataggattgctggatcaaatggtagttctgttttatgttttttgagaaatctccaaactgctttccacagtggctgaactaacttacattctcaccaacagtgtataagcgtctccttttcttcccaagcctcgccagcatctgttgttttttcacttttcaataatggcttttcctattggtatttgatgctgtcttatcgtggttttaatatgcatttctctgatgatttgtgatttggagcatttttttttgtttgttggctacttgaatgtttccttttaagaagttagtatcttttgctcattttttttttttttttgctcattttttaatggggttgttttttgcttgttgaattgtttaaattccttatagattctggatattaggactttgttgtatgcacagttttgcataaatgtcttaaagaaatattttagcacctgatggagccagggagtagaaatgcaggtaggtggaagcagggatgagacaggaatcttcctactcattcattcattcattcattctgtgtccaggcattgcccttggcagtggggatgtgtgactaatgctctgtcttatgtttagaatgctcaggtttggttgcttcaagaaaacttgagtaataaatcgtttgttaagcagaggttgtcaaattttataagtcgagaagcttaagtaaagcatttgaaataggcagtgtctagtgttggcttcagaaaggacaggaggtgaccaatggctggatgactcataactgttcagcctcagagctgtgcttaggaggcagcacagagtgtgggagggaatgtcccatcttgtcataaaaatgcttttctagctttggagaggaatttaccctaagggacatttctaggggaaattcaggtctttctctgacactgtcatcagctctttgagctgtgaacatttaaaaccctgagggtaaaacagacaaaagccaacatatccagaattaggttttagataccaaaaaatagatataggctccaagcaaaatgaaatagttatttaaaactattgatttatagaacaaacaactctctggagattatatgccttaaattttacttgaaatgttagaaaaatataaacgtaggtaattcataggttttgaatatttgttattttaagaattatattttaatagaaaaagtaaaatcctaaatcatgtcatgtgatacattatcatccatagcacaataagcctgttgtttgggcccatgcatgcctggctttcccagatgggcagcattgctgcatatcttgcaaattcagcattaggatatagtaaatgtcctacataaccaatggtgcaactaagttaccctcacacatgatagaagcagtttggcacacacgactggaaggtagcttccagctgacttgagttccctgtccttcaccttgaccttctaggtacttggcagcccctccactcttcagacactcagttctcctgctctttcctttctaaccccagcgccaccttcaaaatagtgaaattcagtatttggtaaattatattatttacatttgctgattgtgattacactgctgggtaaatggatttcagtcaacatatttattttctgatctttaaatctctaactgggaaagaaaccacttgtgccagttaaaaatctcagatttatactattacatctgggattaagaacaacaacaaccaatctcagattcaccacagaggagagtgaagattggctctccatggagttcagtggatctcttcagttgcccttgaaatctcagcgagtgaaataaaggggactggcccagttgatggtgtccttctttacaagaaggacattccctctctagcttcattcatagcaggtggttttccgatgccttttgttttgtttttaaagcagtggaaggctttcttgagtgaaacctaaaggggacaaaagagtacgcgaaagagatgaaagtggctgtgttgggggagcctgagtcctcccttctccaaccacaggatccctgagagaggtccttcccaaggacggtttggaaaccacaccatcattagtttatctgcagcatacttcttcctggccactctttttataacatgaccttttcccttcccttcctatgtacaggatcttctccctaataccactccccacaatgatgaatgtttgttcttcctctctctgatcacactttcgctgttcccagtggtggcaatacttgtcctgggaggcctgtcccctacactccccagtatagcgatgttgctcttatcatgggtagcatgccaccaggtcaatctttagccttcaatgagcaaattactaggatttcagagcaaagggcaacaagcacataggaaagctcctgatggactctgaggggtgtggatggggtgggggaggtgcacaaccccgaggagtgtgaacttaggatacctcaggcatggggatagtgatggacagaggaagccctctctattgagggaaagaaataaagcctgtctcttgccagcacatatgcgttggagatggaaattaaactgcaaatgatgctggagaaaactgctgacaataatgatgattacagctgttgaagcaataaagctggaaaaaagacaaaaaatgtggtttaacagtgcagaaagaataccagcttcagttacttatatgaactgcttattatttagcctaattactatcattttagcaatcatgcatactattaaatgtatcagatttatttgtgtaaattttatttgattacaatgttagattctgttctttgtcagctgagtcatgatagtctgtacttatgtttactgatcaatcttacattttacttactctttctctgcaagttcataggtttctctttcttttagatgaatctgacctttctaagattagctagtttgtgtatcttgtcacgctgaaggctgagtgtttggttataaaagactgcttatgttgtcagtagaacaggcaggcattagaagattgcaattctttttctaacttattctgggaagcaggtatttcgatgtaaaatactctagcatgcctgcgtggaggctacagacagctctgcctggttaggatgaagtggggacaggaagagaggccattgtgaaaactcctaaaatatagaatagcaggagcaaagaggctctctagagaggaactgagtgtttttatatgaaattgtggccacatgaaactcagaagactcgaaatgggaaacctcaacatttgttggtttgtattttatgagatgaggtcagagagaagaatttggctggagggcgctccagagcaatttgtacctatttggaagttaacggatgacattaaaactgctaaaagatgatctgtagtttcaatagccttttacatcctgttctaacagtgaagtcattgaagatagcattgctttgaagggatgttagtgatcatgcagctattttaattcagggggagataaagaggcttcttgattcttagttctcttttggggttaacggaagtggttttccattcaagattcattcctgtttcaatggtatacattagaaaagctactagtaagaacacctccagtaatgtcatatatttgttaatttggagaacgagtgcctgttagaccaggaatacctcagaagtggtttttcagttttgtatgccaaggggcctgatatatggtaagtgctcagaatcagtactttgaattatgtttgcaaattccctctcttaagaaatgtcagtaggtaacagtaatagtagctaacatttgttggttgtacctaatgcctgacacggcatatgatccttcacacagatgatttcttggaatggatacaaccaccttgggaggcagacatcactgtcctttttacagaggaggaggctgaggcacagagaggttaaatcattttcccaatagacagaagctaggaatcagttcccagtcaatctgactgcttatttcattgttaagtactgtgccattgtgtcccctgtgttgaaaatgttaaaattaaaaatggtattaaaatatttgaatagttgttaaattgcagtgttaagttataatgacatgcaaacattttccaaataatactaaattattcaatatattacccaaaagcaaaacggtttttaaaaagaatttgattttctttggccgatttaccaaacatagaagggtgaccatatatattatcattgaaactaaaagtgaaagggagcgctattcataattttgtggtggtaacaggagtaaactgtattgtcctggcaactaagatatgccatcaccctgctgattattatttgttctactagatctttgaggcaaaaaatattaaaacaattctttacatttttaatttgtaggaggattcctcaatgtcaatgtaagcgaagtcagttttgatgaaattcatcaactcttctccaaggatttagatattgagccagggggtcattggaggccaaaagactgtaaacccagatggaaggtgaggtaaattcttttcataagcaatttgattgttactgagcatttgaggaaagaatgtgcttgattcagaatacagagacaaatgtctttaagtcttgataaatttaaaacatcaaaagttttgtctttaatgtttactatttataattcaaatgtgatttaagtgttatgtgtgaagactgtaaatgcacctgtgtagatacaaaatagatgctcggttcattctctttgagttcctggtaataaatacgtgacttgagtttggcttggaaaatagatttttttgttgttctgttctgtttggaagagaggctgtgagttccctgcctcctgcagctgtccctaatgattactgacacctgcaagcatagcctcaccagtttctgaattgtgagaactcactgggaggatattaatatcccgattttcagtttgttctggcattggggtcttcaagctctgtttctcagaatccaagattataaagaggctgctcagagatcactgtgggacttgaaaagttggactttgggctcttcttggcttcagaaggcacagcccaagctttctttcagtctttttgatatgtcagaattctattcagtgttttgtttgaaaaactgtaagggggtgggtttgcctctgctgctttaaaaaaattgaaagccataatttaaaccagacttgccctcaaagctgtgaaattggttaacaagtgcatattcatctaatgttactacgtttgagtaagaaataacatttatgtaattccaatgaaaactacaactgataaatcaagtgttatttcctaaaggattgtgatataaccttgatctggaaacagtttatcttttaaaacattagtatacttctagaatatttgtattttcacctccccccacccccaaaaaaaaccactagtaggaaggaaaatcatatgctgttaaactcatgaaaaagaccctctgacttcatctaccatgaactcttcgtgtttgaagatgtgtattatttgtatctgtattcccaacacagagcacattgtcttgtgtaaggtaagcactaaacacagttttgttgaattgactctataaggcaaataaaagcctttttggccttgttacaaatgattcaataaatggtcagctttcttattgccttgaacaagttgtgaagctgcttaaatggattccagtaccaattttagcaaaacatttaattttataattaccttacactatttcccagatcagattcatttaacaaatgaatctcttcatatttcttgattgattttcctcacatttgtagctatatgaaatgcggcccaatttacatacattccaccttttaaaaatagcctgggcacataaattatttttaacacttgggtgctgagtgtgtatattgaatgctaatagaaaaagaagcatactcagtcaccgaggctgtgggatagcatggaggttcatgctcagatagttgtttgtacagaatgtagcacacccctcaggtgtgctctgggtagcatactagtagaacagtttaggataggaaaaatgaagtatttttctcctgtttctagtgatctataccagatggattttaaattttttgtttgttttcttctcattttccaggagacaggtgtatcacatgagtatttcctacttaaagatattagtagactgactataaactacatatgattcagtaggtaacagtatggaaaagagttcctgggaacaaactaattcagggatctaaggttcatacctgtaatcccagcactttgggaggctgaggtgggcagatcacttgaggccaggagtttgagaccagcctggccaacatgatgaaacctcatccctactaaaaatacaaaaattagccgggcatggtggaacatgcctgtaatcccagctactccggaggctgaggcgtgagatttgcttgaacctgggatgtggaagctgcagtgagccgagatcgcaccactgcgctctagcctgggtgaaggagcaagctgtctcaaaataaattattttatttaggaactatatgataatgctgcttttatttcaacttttagcaaatccttctcagaatgtagtctctagttcagaattacacaactaaaggtatgaaaggaattttggagatgattcagaagtgagctgtactcatataaatattatataactatcatctcactaaatatttagttaaatggtttctccccctacccgtccctgcctgcttactgataatgttccattctcatattggaacagtggagagagagggaaataagaaataactagatttatgttaaacatctgtcatcaacttgattcttaatatttgaggccccttttttaaatgagaaaaataccaatgcagttagttgatggcaaattaattagaactgagatctttcaaaactagtaattttggctggccaacctgttgagaccccgtctctactaaaaataaaaaaattagccgggcgtggtggtgcaggcttgtaatcccagctactcgggaggctgaggcaggagaattgcttgaacccgggaggcagaggttgcagtgagccaagatcgcgcccactgcgctccagactgggcaacacaaacaaacaaaaaaccactagtaatttcagcaattcctaggtattcttgaatgctgcaggtttaagtagaagatctgcgcaggttggacaccttctggggcaagcttgtatctaaagaagaacatgagaatgctatgcaggtcattaaaagtgaagtgtacctgtgacattgactttccattcagatttcagatggagggcttgatgaacaactttggtctataacttccaggcttaaagaaccaggcagctgcttgatgctcttgtctacccagaggcctggagtttcatttatagtccaatgtacctcaaagatgagtcttggcctccctgtttcagaactacttgaggcatatggtgaaaatgctgatttttggccaggtgtggtagttcaaacccgtaatcccagtgctttgaaagactgtggcagaaggatcacttgagcccaggagtttgaggctgcagtgaggtgtgatcacaccactgtactccagcctgggctatagaatgagacccccatctctaaaagaaaaaaaatgcagattcttgaactcagtcctcaaacattctgattctattggtgggaaggaacaagaacttgcatttttaaccaagtgcctccagtttgagaactgctcctggaggtactggaaatgaggaggaataggaagatgaaactaaaaacactgaaggagaatgagggcttactagcttctgcttactcagtggcagataactagattcaccttaaggttaccaagcctaaagccatgtcatttagggacagtgtagctggtggtgtgctgaaaatttgaaagcaggacagaaacttggtgggagaaattgatgtgatacacatttttcttgatgttctcctcatggtgtatataggagaaaataagcaagggaaaaaatggtgcatatgttcagcaagatttgtggttttaaagtaggagcaaactgaatggaataattttgcttgatcaagaggtggtgaggagagattcaggaggatgaagtgttgttttatcagaagataatgaccagatattctcggtctccactggaggtgtatcagcaagagagtggctcaaacagcaaattagggcacatagaagaatgtcctgaaacaggctattaagccttaaaataaatgatcacagaacactgagatcttttctagacaaaaaaattgtaaactatggaggacattcttccacaaacacaagaactgatgtgccagatgaacttttaagatattgtttagctttattttaataaaagctttgccttagatttatcacatattcacaatatttaataaccctctcattaaaatttggacatctatttgctgttagcacattaggttagcttatttgaatttgccaagacactggtaatttcttttattaccgtctcagtttccttatgagattaaaagaaaaaacacttgatatttaaatacttcattgaagagattattgtattaggagctagaactttactttttatttatccttatatgttcagctcatcactcagtctaattgtctttaattaatatgcactgtctttaattgggactctgcagccatttaataatttcttccctcaaatatctgtaattggccttaactgcttttacagctcattgacattatgtcataggtggccaactcgtggccaaattcaaaatcaagaagggcaggcttgacttactaagctacatgttatcacatggatatgctttagataaggtcagtggtgggatatgtactcaccatctaacctcttttgctccttttacttttcatagcacttttccatcctaaaagtaaacccctgagctagcttcacagttgttttgattcgggaattccttgaatatgccagccattggcgctgaagcccagcagtaagtccccctcagtatatagttccagtacagttggcagccattgtgcgggggcaggaaggaggtcttggatgttgggtcggtattgctggggtagcctcatggtcctcaggcttctgagccaagagagacgttatggggaaaccaaaaaggaatgggacccaaagttgggctggcaggggcaccagacctctttagttcctaccatttgccagatagatatgctgtgattaattattatcatgaaaacatcagcctcatagcagccattgtctcttgtttttgctatcccatcagcattaagggaaaatgaatgggggagttcatagtttagacatcttcaattttactaaatcattttttgttctctttataaatgaaactttttgaataatttaaaaatttctgccatctatgatcctggtaacgtaaaatacatggttaaatattattttcgtttgatgatatctaatatcatgtcctgattttaaaaggattaggtgcaaaacttaagtattctcaattatttccatttattcatttattaataaactttatttggtataggtaaaattttagtaaatcatggatttaatattctttcacaatattctgttacaaccagtttagattgtatatttaaaaaatccagattatagagtaacacagaggtattttggttagatatactttcactgttgtgtttttttgaaaatctaatgattttggaatttatgatctgtagaaaacttgctttaatttcaattttattagaaaattcacaataataataaagctagctcagctaggaagttgctgagaaaagtaattttgaaaacactttaggtttttcaagggcaaaatctaaattgtaaggagatctagattgtatgacaaagtttgtatccaagaaatagaggatttgaattagtgatgattgatgatcattcatttattcttgtattacactaaaacattttatataaatggtgtttttaagtgttgggtttgagagttccattagattttttatttcatattagaagaaagattaacgtactaagaaactattttcatttccatgtacatgttttttcttttactttttatatgagaacaaatttctctggttgataaagacaaatgtctgtgctgcttacatcatcttttcttgttatggtttgttaccagtttcattttaaactgaatattatcctaccactgaaataaattttaaaatgtatcaaaaacttaattctgcattttgactaaatgaaaaatatattaattatcaaacttcatgtgtattttggggcaatatcatgtatgattgaggttttttgtatgctatggctggagtgtgaagattttggtttctattatatttctgaaaatatctctaggacagagaaaccatgtgtaagatagtagatattcaagtgaaatgtcttttaaattcaattcaaaatccaggaagttattatttaggatctactctaaaaccgagacgttactcttatgatacattcccctcccttacttttcatgcccaattgatagccaaaccctgctagcttacctcttagatgtattgaaaacccatgtacttctcttctcctttatcctcctgttagtttaagctaccattacctgttttctcaacgactgtactaattgcctaactagctccctgagtcaatttttggtcttctccagtctgccctccatattgccaccaaagtagtctttgtagtcaccacatctgatttatcactctcaatttctcatgatgttcataggttaaaggccacaatctttagaaaacgcttcagagccccttctacctctcagctttataagaccatagcagcatgcagcaagggctttttccgtgtttgcttgctgttgtatctctgatgagaaaattcataaggacgtggctttaaaaccatcagaagttttcaaggattgatttttatccttacctctaggatgtggtagatatatttatttacatacatgactattttgttttaaaggtggcagttctcattcctttccgtaatcgccatgaacatcttccaatttttttcttacatctgattccaatgctccagaagcagcggctggaatttgcgttttatgtcattgaacaggtgagaatacttttcatagtggtcactaagtatactagaatctaaactcttagatatggttagattaaacatatttaggattaataaggtaagtctgattcttagtttagtttttttgagacagagtcttgctgtgttgcccaggctggaatgcagtggcgcgatctcggctcactgcaagctccgccccccaggttcacgccattctcctgcctcagcctcccaagtagctgggactacaggcacccgccaccacgcccggctaattttttatatttttagtagatacagggtttcaccgtgttagccaggatggtcttgatctcctgatctcgtgatccacccccctcggcctcctaaagtgctaggattacaggtatgagccactgtgcccggccaaattcttagttttatacttgggtgaaattacattttggattgggcccatatatttcttttataataattgtaatttggtcaaatgacttaatcagcaatcatgtttcactttagtatgacagcctcgttatattttaatgatattctaaatataggattgtcaatctatggtttttaaaataactgtacagcttatatttaccttacaggattaaatgtgtctttggcttatagtattattactttttatgttttcattaggcttatgatgtttatttttgaaaacctctgtaaagtttcatttaattgagaaactgtttattttctaatttaggctacttggcagcatttagactcatgtacagacatctggactcataactggtacaactcaaagttcttttctaaattataccaaagcaccgtacagttaccttggttatattcgcagtgtttaatttgaaaaaacatttcagtttatgacccatgaatttaactacagaaaaggaaggaaagtttttttctttttttaacacaacagcaaagcatagttaattctcgattgaggatttctttgtactgtggggtagttgctggctatccctgaaaatcaatattggattaactttattaggtaatcagagacacctgaatgacagccagttagtaaacctaaaaacaaaaagtagtatacattaaacattttctgtcctgttttcagtttttcattttcaaagtcatctttcttggtagaggaaccttgactgtttttgttgtaggatatagacccagctctacagttggtaagtaaatatgcatccattgaactgacaggtcaaaaaaaaaaaaaaaaagcatacattgcatggaagactaaactatgtgatgcccaagatcccttccaaatttgagattctatgattcttttagaagagagaaccaggtggagaatggaattttaaaatattgtcaaaaaaagcttattcgttttgtttctgaacagatgctatcaaagctgaataaatcataattctttaacatagttaatttaaatagagttgaaatgaccttgacttactttttgtagtctttgtttaaaggctataaagtgtaaatataaagaatttggcctggcatggtggctcacacctgtaatcccagcactttgggaggctgatgtgggtggatcacatggtcaggagttcaagaccagcctggccaagatggtgaaacctcgtctctactaaaaatacaaaaattagccgggcatggtggcaggcacctgtaatcccagctacttgggaagctgaggcagggaagtgcttgaacctgggagatggaggttgcagtgagccaagattgcgccactgcgcttcagcctgggcggcagagcgagactgtatctcaaaaaataaaaataaaaataaaaataaattgaaaaaaagaatttaattttctacattatttctaaacatggatagagtgatgttttggaaacctaaaaaagatctgataacacttaaagaccagttctccatagcagcttgtatcacttttggtattgtcacctcatatttaagtgtatgtgatagatggtaattttctgttaatgtatactgacctttccaattgctttacatcattgccagcacttggtatggtttgtctttttaattttagccatttagtgggtctgtggtagtatcttatttccctgatgattaatgttgatgatcttttcatgcacttatttgcttcccacataccttctatggtgaagtttctgttcagatctttttctcatattttaattgggttgtctttgtttttactgagttgtaagaattatttatgtattttaaatacaagtcttttgtaagacataagttttgcaaatatagtctatggcttgcctttttattcttttgactgttttttgaaaagttttaaattttgatgaagtccaatgtattgatttttgtttttatagcttgggctttttgtattatatttgagaaattgttctgtatgattttctctttcttccagaagcttaatagttttagctcttacacttaggctaatcattgagttaatctttagatatgatatgagctaagagtgaagtttcgtttagttgtttcatcaccacttgttgcaaagactgttttcgccattgaattgctttagcatctttgttgaaaatcacttaatatatacacgtcatatgtatgcaggtctttttctggtctctgtgttccattgactctgcttgtcagtttctactaaaaggtctgctaggctttatttccttagttttgaataggtaagtaacagtataaatgatagacaaagttacctggcttgtattattagatacttttatcttctctcttttggtagaaaatactcaaaaaagtttttttttgagacagagtctgcctctgtcgcccaggctggagtgcgatagcacgatctcagctcactgcaacttctgcctcccaggttcaagcgattctcctgtctcagcctctcgagtagctggaattacaggcacccaccatcatgcctggcttatttttggaaaatactcaaatttttattcctaaaatggttatagtttctccagttcctttattctaaatctgcctttttgttttgttttgttttttgttttgtttctcactctcagctttttacctctgctttttctccgtggaaatgcttggtatttaatataacataccatacttctgtgtgtataaatcattctttaagttttgtgccttatgtactttttaatgtaacaatctgtactgtgaaatctgacttgttttacctaacaagtggaaattctcatctactttcatggagctgtagttgtagatttctagatcagttttactgatctaggaaagtgctagtttcctttgtgtaaacttcaattccccataatgtgtggagaggtgagagagctgtctctggttttttttttttttgtttgtttgtttgttttgtgatggagtctcgctctgtcgccaggctggagtgcagtggcgtgatctcggctcactgcaacctctgcctcctgggttcaagtgattctcgtgcctcagcctcccgagtaactgggattacaggcatgtgccaccacacccagctaatttttgtatttttagtagagacagggttggccaggatggtctcgatctcctgaccttgtgatccaccctcctcggcctcccaaagtgctgggactacaggcatgagtcactgcagcctgtctctgtttttaaaggcatatggtcctgagaattcagcaccagttatttggtgtatgtgatgaaacaatctttgcaaggcaactaaggtctgcgtttttattttcaaaccttttaagtcttaatctcaggcttgatcaatattaattcaggactgtgtatttgatagagtgagattttgagctagaaacatcttcaccatatttgaaatagaaaagtaatttttctgctagacaggtacccagggagtgctaagcagttgaagagcagctcaggaattctagttaaatatagaggatggacatgggttcactgcttctttccaaactcctaaaatgagagtgaaagaagaaaacttttgaaaagttattaaacctcaaggacagaaagtcgtgggtgagagattttcacacgtttcggttaagtcaggaagcagatggagtgctgatgcctagcagaacagaggatgtgcaaacccacatgcttgtagagggtgatgtgacaagactagagtcaatttgctggacacacctctgtctcagtgctgtcacagaaggtaggctgaagcactgcactaaagtaaggagattgtttaaaagtttgactacaaaacagccacattcccagttgctcatctttacttgtactgccaggtcattactctgttgtatcttgtagaaactttttccagtttatcctgtggaaaaagtgtagcaggaagctgctgagagtgctgacgcacctgtgtggtagggcataaaaccggggggttgagtaaatctgcatgctgaccctagggaccccaggccttttcccgtctggccttttgaagccaacagccaggtgtgaatctccccacccctccagctgtggcagggcatagtggtgtcttcgctagagaaatgaattatctccaggaaaaagagtccagatctgatatttgaaggtctccaaaagaaaaggccagcctgtcactttatcaggtccctgcagcccggtttcatttattcaacaaaagggatgtggcagtgaacaaaccagacaagtccccttcttttgctggcccagaaggaccggcagtagtaaatcattctgcagtgtctccatggcactcagggtagagagtggtaagggcaggtagtggtgctcttttctgcagagcatttggggaaggcctctctggggaggtgagatcagagcatcctggaatgatgtaaaggagcacgccatgctgttgtagaggctgtgcactctggagaaggcaggagaatacttggtgtgtttgagcaaagaggtcgatgttgccagagcagccggctgaggaacattctggggaggaaatcagagaagcaaataaggaagtgcagggtgagggcttggattatcctgtgttaggtagattaagtcactcttctacataaaaccttcagatgacactggataaagtgatgttttagaaaccgaaagaaggtctgataacacttgaagaccagttctccatgccagcttgtaccacttttggtattgttacctcatatttcacatttaaatgtatgtgataggtggtagttttatattaatgtatgctgacctaatgtaagtctctcctccgcttaaaaccccccactgccttctggaggttcttaagtagaggagcaacttaatcgctggtgtgttcctctcgacgtccacctgcttgtgtctcttcctgccaggatctcagggctttcataggcaaaggatgagggatactgggaattctaggaaaaatgaccaatgattatgaatcagaaacctatgaacattctcagcaatactgggaaatttttttttcctggaattttttacccagccaaattgacaaatgtgagagtagactaatggcattttcagtccttaattggctaaaagtgtattctccatgggtctttacttagcaagctcttgaagaatgtgcctcaggaaattgagaaagccaaggaaaaggcgtaggtgatttagagaatgaagacgacccaggtgatatgcacacatggtctggagagggcaagggagagttgggcttgagagatggagaaagaattgatagatgatttgatgtgtttgaatgattacatcaattattaataggtgtagggcatatttcttgggccttcagtacaaagtaataatataatagttatatagaaaactgtagttactcccagtttgcaaaagaaaacagttcactcagcactgaagaaatattaaatatttacatagtcctaataatgtaaagtcttgatttaaccaaaaattatgataaaactatattgggagaatagaggtaggggcaggaggtgtggtggtttaactcctccactaccatgataagaagtcaagagacagtgtcttaaagtgaaagaagcaagaaatatcagaactctcatttcctcaaaatatgtagataaataccggaataaatgggaagagttgaaatgtattgctcttggatggagatggattagatatggaacttcttatttcttttataagcctttgagtattatgtccacatttaataaaacatttaataaaaacaatttttaaaaccttaaaagtagtttgttaaagctgatgttgatgtactagtcataacattataatttaactcccttttctttttattttatttcactggtgaaaaaagaggctgtaaaaaataaaatgacttctattacctcaagttagtgcaaggcctaggactaaaaattagtaatttttcactcttgaggcagtgctctgatgatgactacaatgtgtgtctcatttacttctatcgtaatcctttttttaatatattttagaaatggttttgttaaatgttgctaaaacactggtaaatgctctttaattttctttatatgcagaatgaaggttttttattgccagtgcaccttaatatatgttcactgataaataaaggaaaatggttataatatagggagttgggttctgtgtaataaaattgtattttttgtcccttaaaaatgcccttaatctttatcataagcaataatagaaactattgcccatgtactttaatgtattttctgtaataataaaggaaaatggttgtaataaaggaagttgggctttgtgtagtaagttccaattgttttttgtctaaaatgttcttggtatttattataagcattaataatagaaagttagacctccttggtattggtactttagagaagggtcactgttgagtcacttccagtttcctcttctcttagtcttgacagcatatggaaagctccactaacaaaataaaacttatattatttttaatgactttttttttctcgccacaagtaatctatatcctgatgtatttgaagtagagcagaaatacaaattatttaaatgtgctgatgtaccaatggactagatactgttttcttctatgttattaaattataaaataatatagtaagtaaatttaaacagtgtatttgaaaatcctgaagtatatttattatttgtctatttcatttgggtctaattattgtaatcatttgatcatgatgcaacaagtttgaaaaataatagaaaaaagtcagatgggggccgggcgcggtggctcacacctgcaatcccagcaccttgggaggctgaggtgggtggatcacgaggtcagtagttcgagaccagcctggccaacatggtgaaaccccatctctactaaaaataccaaaaaaaagaaaaaaaaaaaaaaagatgatgaagtgtgagtacatttctatttttttctctcggtctgctccatgaagactggcacacaaccttttaaccgtgcgatgcttttcaatgtgggcttcaaagaggccatgaaagacagtgtctgggactgtgtaatcttccacgatgtggatcatctacctgaaaatgaccggaactattacggatgtggagaaatgccacgtcattttgctgcaaagctggataaatacatgtatatgtaagtagtgtgcactattcctgatattgtacgatataattgcacagtcatagcattgaaatggtagcagcgttatgtccctaaatctgagagaactcaagaaccccaagaatatcatctttaactccatcgtgtcctcctggggagccaggacacagagtggcttttcgttcccctgggtgcttccttacacagaggtttgaatgtggtgtggtgggaaagagagcctggtttctgtggtcaagcacacacagatttaaacttgggttctcacacttacagttccaggacttataggttagtcacttgcatctctgaaggtgtattccttgttcactgggataatagattccatccatagagctgctgtgagatcacatgtgctctgtgcctgctgtgtggtaggtgcataactcatcttgactcctgcctgctctcccccagtgatggtttggagggccacaaagccctctcttctgctgtttatcttcttcctaaggtgtgcattcttgacctgccctttaataataaaaaaaaaaaacccaaatcttttccttctctaattggagataatttaaaatgaacagttatcagagctgagatagtaacttaaaaggacatgaaagaatgcaagtctaatatgggaaaaggatcacagttttcattggcctaatgggagtagagagaaaatctgtttgttgcttagggcaggaagatgttgcctgtgtcacagttttgcctggtgctaatctagagtacagagaagcaaaaagtctgacacaagcaggaaaagaatgcttgtttctttcttcttcttcctcttcctcctccccactcctcctccccactcccgctcccctccttccccctccccgcttccgctccccttcttccccctccccccttcttcctcttccttccttccttcctgcttctccttctccacctcatccttctcctcctccttcctttttttttgctggtcattgttatcattagaaaacctttttctttattacctctgtatctgaactttgagtatggggttaccttgaagaaggccatcaaggttcacaatctggttctctttttcttttttttttttttttgagacagagtctcgctttgtcgcccatgctggagtgcagtggtgcgatctcggctcactgcaagctctgcctcccgggttcacgccattctcctgcctcagcttcccgagtagctgggactacaggcgcctgccaccacgcctggctaatttttttgtatttttagtagagacggggtttcactgtgttagccaagatagtcttgatctcctgaccttgtgatccacccgcctcggcctcccaaagtgctgggattacaggcatgagccaccgtgcccggcaacaatctggttcttaccacttctggaaacttgatttcagtcagtttgctagaatcacattagatccagggtaaccgattttcacaaaaaaaaaaaaaaaaaaaaaaaaaaaaaaaaaaaatcataaagggcatataaactaagaattctaaattaatttattgttaaattctaaatgaatttgttgtctaaataatttgttgttaacttgaaaatatcaatttctaataaaatacagttgacccttgagtaatgcaggggttacagtggtgaccacctcccccagccaccggaatgcagttgaaaatctagtataacttttgactccccaaaagcttaactactaatagcctactgttagccaaaagccttaccaataatataaacaattgagtaacacatattttgtatgttatatgtattgtataccatattcttaccataaagtaagctagagaaaagatgttattaagaaaatcataagggagggaaaatatatttactgtccattaagtggaagtggatcatcctgaaggtcttcatcctcatcgtcctcacgtggagtaggctaaggaagaggagggattggtcttggggtctcaagggtggcaaggtgaaagaattgaagatggaaaaggaggcaggagaggcacattctatgtaacttttattgaaaaagaaattgtatatcagtggacttgtgcagctcaaacctgtgttgttcaagcgtcagctgtattcatatccatctagactagtccctggattggttaggcatcttggacgtttgtagagaaattagaatgtagctctaggagaatggcagtagatcaaggcctggtctgggcagtgcatagacttcagctgtgggatgaagcctggtgaagcgtccctgccccacagtgatggccacactactgctgaccagagaactcagactctcaggtgtagtgtctctcccacttttacagtgtaagataaacactgcaagagtttgacttgttgggttttgttttctcttctttagtttatctgttataccttcattttacctaataactttccattattcatatagcacaattgattatttccacttagagcaataaatggaattgataggcttgctgatttatacatgtcaataagcacacagacacatttattcatgtttccctatctgacgatctcaggtttttcctaaactactagcctgggcaagaataatccatctgatgtgggaagtacacggtgccaagaatgcttattggccctgtggaacccccagctagtcttactgtaataccagaacactaagctcccaagtgtgagccttgagaggtctcaggagagtatggttgtctttaggatcagtgttgctgttaccatcttggagtacctttgacctaggatgagggcaagactgctttctcctacaaccctaggcttccatgaaagaaccagtcttccctggtctgtgtgccacacaagaccccagctggcaaacagcacgtccttctcagaatgtgaggcgagtgtctaacaaaaagttccctcctctgagacagctttgctgtggttgcagccaggtttccctcagcttgatttttgggtgctgtgcatggtcacgttttctctgctctggcatctgctccccaggggcgtgtttcagtccatgggaatatattcaggattgcaggtctagggatgctgcctaaatgtcagaaagccaatctatacctaaacacacagtttagctaagtaaaaatatagtttagaaaagtttaaaaacattgcatcgtttgacacattccttggagtatgagttaggaaagggtaaggaaaataaaatccaaacaaaaatagttatttctgtaaatatcaatgcattgaaaatgaatatatttgtaaatatccatgaatattttgagagtataattccaacagataagatcattataaaagtaggtagctagacaattaaatgctagaattgtcttttgtaattgatatttatcctgctctatataataaataatgcgtttataattcagttaattttttcagtgttactagtttaggaacatctgacatgcattgaccattataaatatatttaatcatgtttacttttgctgtgaaaatatacaatttgggggcactgggttttgagccttacagattttattttgagtcttatttgtatactaaatattaaatttaggtttccataagtgctttacatttaacataacacatgtacatgtacttgtttcactagaatataaaaatgttttatgtcttggtgtactttacattttctaacataattgtctatatagaatataagggcatattttgcaaagcacataaaagactgaaaccttcatttcacatgggaaattattatgattttatttttagaatactgtgtctttcttttctagtcttccatataaagaattttttggtggtgtaagtgggctgacagtggaacaatttagaaagatcaatggttttcctaatgccttctggggatggggaggagaagatgatgacctttggaacaggtatgttgaggtacaaattgttcactaatagaatttttataaatcttatttatattaggtaaattgtagtacttatccattccaagaacattctttgggatgggatatgtttgaggtttctaaaccctgttttatatttctctttttttttcattaagtctgctttctgaaattattggcagcatataattagagcagcggtccccaacttttttggcaccagggaccagtctcctggaagataatttttccaaggacccaggaggatggtttcgggaggaaaccattccacctcagatcatcaggcattagattctcataaggagcatacaacctagatccctcacatgtgcagtttacaatagggtttgtgttcctctgaaaatctaatgccattcgctgatccgacaggaggtggagctcaagcagtaatgatcgctcacctcctgctgtgcggcccagtttttaacaggccatggacctatactggtttgtggcccaggggttggggaaccctggattagagcattcttttgtgttttaaaattgaactcacataacccattttcatattttatttctctatattttcatttccatatatggcattgtagagttcactatgctggatataatgtaaccagaccagagggagacttaggaaaatacaagtcaattcctcatcaccatagaggtgaagtccagtttttaggacggtaagttgaatgtcatcttcagataccaaggtttccaaagctgttgaataaatgaaaggtaaataaaaatgcattgaaccccaaaaaagctgctgaagggaattttcataatggaagggaagtattttttgctgaagggaatctttacaaaaggaagcatttttgatgcttgtttttaagagatatacgtatatatacattaataaatacacatatttacgttaaagagcccggttaactatttatgtaaaagtatttacgtaacataaagcataatgttttatttattaaagatgtctaattgtaaaagtgcaaaataattttttcaggtggcatttcttgagtagtaaaattgctaatttagaataatggtttagagattcttaaattatgcacaagaaccagaaattgtaaagggcattaagtgctttaattataagatgaccttgaacacagtccttatcagttttcctttttgaacatgttttgttgcttttttgttttttcctctaaaactataggtataaattactaaggtattccaaggagcgtcagtacatcgatggactgaacaatttaatatataggccaaaaatactggttgataggttgtatacaaacatatctgtaaacctcatgccagagttagctccaatcgaagactattaaaagaagtggctgtcgtggcaaggtagaccacaatgctggatcataaacttggagcgcgctcttagtggaggtcagtgattggctgtgtcacagtgcccttttctctgagaagagccagcagtccacagtgtttacagagtgggactatatacagtcacccttctctcacccgtcctccctgctctgagacacacccctgtggcgagcaccgcagaaacgggaagccactacttaagatcggaagttaagagagctccctccgaagagaaaatttttatactaaaatctataatttaattcaagagaatgcttttatttccgtttaaacatattttgtatatatgtgatataaattaatgtgtgcaaattgtttaaaaattagatgtgttgcagttttgcatgtaatcggttatacctttattggacttttatagacattttttatttgcatgaaaaaaactcactaaatttacatcactaaacaaaggttaacccttgtgtgaaatgaaggaactgtcaataattgacagccaactaatacagtaaactgttatactagttttgagctttagacctcagccttttgtgtggaagaagtcacagctttcttaggctttaaaggaaaagaaggaaggacttaaatagcttttcttcctaccgggattacctatgtttttccttgcttgcaatctcatctgattttgctagaaatcacaaccatattgtttatgcatattgcatgagtattaccaagaaaaatcttaaaagttgtgatgtgacatgatataaaggatctctttatgttaaatgtctttccatgtacctctggtgtgtcagggattttgtgcctcaaaaaatgtttccaaggttgtgtgtttatactgtgtattttttttaaattcacggtgaacagcacttttattatttccagttcagaagagccaaaaaaaagtatcttcatttaaaaagaaatcaagtcagtttttttaaaagaatgatctatggaagaaaacccaatagtacttataatatacaaatgaattatactattagataagaattaaatattctatttttataaagataaatacttagtagataaaaacaaattttaagtttagttttcagacatagaatttcacttttggaggggacccttgaatgttagtttcattcaaactatattttgtttttttcacttttaagagattatatctctggtgttaattactaaaattttctttctaaaagtataatttaatagaattatcttaaaatacatgatcagtattcagtgcgctgatattataatgtcttctatatgtagtatctaaaagcataatttaatagcattgtcttaaaatacatgatgagttatttggtgcactgatgccataatgtcttctatatgtaatatcttacatgtttgcatgagtgtcagggctttgtccagttatcttcatatgactgttctctgaaaaaaggtcttactacctgatatcaagtacatatcttaattttggatgaatttttccacagtaaagccgaacagtattcttttttgaaaattagcaattataaagattgtttaaaatatcttgatattttcacaaattttaaacaaaaaattaaatatctataaagtgaatgttcaacaacaatgatgagcaatagaaatctatatatgagaaacgtttggataatatttgcctcaaggattgtttacctaaaacagaactatggttatttatctcagattgtaagttttattttgaagtgtcatttttatggcaatattgataacacaaatgaccacaaactaaatcataaaataattgaatccttacactttgagaaaatggatagcttctgtgttatgataccaaacaaaatattttcatatttatttcttagaactatttccaaaatatttatatttcagtttttttatggtactcgaaaaatcaaaccttctgaaaattatgatatttgtacttcatttgtgtattagttcattttctgtttctattacatagtttttaaagtcaatgaaagagattgagaatgttaacatttgttgatcaatgtggagctgtccacattcggtatcttttcatttttatatatattttacagtttcaagaaaacttagtactactagtatctgccttattttcttaagtctgatgttaatttttgtttcaggagtgagatataaacattttgctttttttcagttttgaaatatagtttgtcatcctgtgaaaaccacctcgtttgctttttgtttgtttgttttgcttttttagtgtagacctaaaattatttttgcctataaacagtgaacttaatatgtttctgtgagagtgacagagctgtgcccgtttatcttcattgtattaattattacataaagattaacaaatacattgcaaatgcaaattataggatgtttggaggatttattaatgagcatgtattgattgcctattccatatccagtgcaatgctaggtatgtctatggaaggagtattattacttcatttctaaacaaatgaagtcaagcaaattgagatctttctgaaattatgaagacatcttctgataacttatctgttgtatttcctagtctcaaagtcaagaaacccgtatatgtggacctagggctaataggaggtccctatggcactaactgggaaaattacatggtgcttttcaactacagaaagaagtaatgactaatgggcctgtctgtagagaagaaaaggagaagagtacacatttgctggaactatatataattcacagtggagatagttaattctttgctaaaactagggttttatgagtattttttaaatctacatttaagtttttgtttttgtgaaaagttattcagtaagaaaactttataatattaagtagatacagttatgtattaaaaatttccttatatacccttttgccagccaagatactgatattttaaaacaaaatggaaaaatgtccaatacaatattctctttctggaggcttcctacaagtgaaagcagattttgtcattttatttggcctttgcttgtctttgatatatttctttatgtgtttttcaaatacatactgttgtagatttattgtcttgtatttgcaagtatgccggttgagagaactaaaatggttatagtattgtttatcagaaagaggaagtgtacttaagattattttatttatttagatgaaaggcttctacataaatgcactgaaataaatgctagtaatttcttgtatcccacttctttttttgcttctcatggaaatgtttgtacttttttatcattgtcttttatgaaatataatgttctaaagactttgtgtgaagatgtaattattttcctctcaggaacttttttgggttacctgggatttttgtttgtttgttatcctaaattttaaatgaattattgatgaatatcttggttgacaatagggttgcaatataagcataaggtaaccacagcttaaatacaggtggagatcaccttattccttttatctcaaaaagtagtatttaagtatttttcattagtacaacaattagtaatctattatatcaagataaatatttaagaattcattttagcataaattttctttttcctgcacaacttcaataaactaagctggtgtgttatgctcaatttactacttgtttttcaggtatcgatgatttttaaggcaaagagccaaatttcaaaaatacctagggactagatttgtatttgagactagattgtaagatcatgagttttatcaacttactagttgtgaaatgagttgtaattactctatgtataatatgatctatagggatattgtcactgcatgtcataactaaaaccaatcattaaaatcataatcatttaaagccgtgaaatttagtcagcttagtctgccccactatggtactaatgtgccctctggtgaaaacatagtaactccatttaatgatcatatatatatgtgtgtgtgtgtgtatgtgtgtgtatatatgatcatatatacctgatattctatatacacacacacactgtacacacacacactttttgtgctatctttagacaaagatttaaggtggttgggtatgttctggaccaaaattttatttagagaagtctgttcttaaggagcatgtactgtattgctcttgatttaagcgacttcagaaaagtgatttgccgctcaactatgcaatgaaaaggaaaaaaaacggtgtgaaaaataaaacttgcatctttctcaacacattccgctaacagattttggttgcatgcccttgctaatacagtcttcccaattttatcagtttaagtatgtgctctggaggatcttgagaggtatcagacattacctaccctcaaggagtttacatcctctctgtgt

SEQ ID NO: 12422 - DNA, 81384 bp, Human
ctagaattacctcttctgagagtattttcctggcccctgctcccaatatgatctagtagccactctcctgtacccctgaacaaacgtgactattcttccattgcaaggtgatggcagggactgtgtcttacttgtatctctttatctttagagtatagggcagtcctggaacatcttatgtatataatgagtgttgaatgaatgtatgtctgaattacagtttgtaacatttataaaagaattcatcatctctttgtagctggtgttttatagaagtgtaaaaagtccttaggacttgatgtttcttcattattattattattattattattattattattattattattactactacccccccaccccccctttttgagagacagggtcttgctgtgttacccaggctggagtgcagtgacatgatcataactcactgcagctcaaactcctgagctcgaaggattcttctaccttggcctcccaagtagcttgggagtacgccatcatgcccagctgatttttaaatttttttgtagagacagagcctcactaggaacagcccaggctgttctcaaactcctagcctcaagtgatcctcctgcttaggcctcccaaactgctgggattacaggcatgagccactgtgcccagctctgtttcttcattaaataaagttgggaacttggccactcctggagagtaagtggccactttacttttccccttttggagaaagcttgaagtccagcagaacagtaagccacttaacctggcagttgcaacacattaattaacaaccttttatttttcttttggaaaaaaattgcaaatctgtagagacattgagaaaatagtacaataaatatatgctctacacctgagttcaccagttggtagcattttgtcacatttgctttaactttttatatgcatacataagctcatacatgcatatgtgcatatgcacacatttttttcagaagcatttgaaagtaaagttgtagacatcatgatgcgaaacctctaaatacttcaatatacatctcctgagaataagcgcattatgcataatcacagcactatgattacacttaagcttaacatttagtaatatctgatatacattccatgtttaatttttctcacttgtctcaaaaatatctattttagcactctgatttttctattcagaatttagtcaaagttcatgtattgcgtttagttatgtctctaatctagaatagcccctgcttttttttggtccagatcagttattttgtagaatatcctatgttctttcagcctgaagaatctaaagtgtgtgtgtgtgtgtgtgtgtgtgtgtgtgtgtgtatttggagacctcatctctaaaaaaatataaatgttagctctgtgtgtgggggcattccgctgtggtcccagctcctcctgaggctgagttgggaggatcacttgagcccaggagttggaggcttcagtgagccatgttcatgccactgcactccaacctgggtgacagagtgagatcccaactcttaagggatattctagatttatcttcttgttttctcttcagtagattagcaagaatattatataggaagtaaatatcttacattgcattaggagcctggaactgtaggttgttctaatattggggttgctgagttgagacatttggtaaagggatgacctgctagatcttcctcttatgcagcaaaattacaaatgtcagttgtgatcaacatgtaatttgtggggtggtgcattgaatatgtgttttgactatcctcttcaacaaccctttcacctgagggttttagcatccattgatttccatgtcatgattatgacccaaatatgactgtaatcaacagacctgctaaacagagttccagattctttacggttctttttgtccttacagtatatctctcaaagaatgtatcggagtacttttccgttggttgtgttttcagtacaatgtattattagaattatttgtttgtgtttgtatttagttttagggtttgcccatttttcatatatatatatatatatatatatatatatgtatatattttttttttttttttcttgagatgaattctcactatgttgctctggctggacttaaactcctgggctcaagccagcctcctacttcagcctcccaagcagctgggaccataggtgtgtgccaccatgcccagctagataatttttttaatacgtaaatgtccaaaatataaaaggtgtactcaggcctcagtcctaccccttcatttttattagtttctggtttactcttcctatgtttttttttttgtaaaaatatgtgagtgcatatcaatttccctttattaagtagcataatatgtcttggaagtcaattcatgggttttgctcaccttatttttggggaaggtaaattttgttgacatataacattaaaatgtgtacatgtaagcaaaaagcttggtgaatgtttagaaaatgaatatatctgaataaccagcatccaggttaagaaataagatgaccagaagccaccttcaactctcctgcactccagggtagccattctcctgacttttatgttgtagattagctgtgcctgtttttgtattttatctacatggaatcataccacatgtgttcttttgtgtctggcttctttgtgtcacataaagtgtgagagattcattcacgtgggtgcatgcagttctagtttatttattcctgttgctgtatagtattccaaaatcggaataggctacaaatatttaatctcttctgagttctttctagttttggactataacaaatgttttctcattcttttttatggtctcatggtactcatccatgggagtgagtataaaaatgtattcaaccagtctcctttggatggtcatttaggcttttttccctagtgtttttctactacaaatattattgcacaagattttgaataaacttgtgcattatagtatggaacatgtttttaaaagctttatgaggaatgagagtaacagaacattttggggggaaagctaatctttttggcagtgctgctcaattggtggaaaggaatgactgagcttttcttaggaacaggttagtgcagtaaaactggttaacttacagtattttgggttcctctcagaaaggaggagggggctaatgcaaaataaagagaagggcttgaaatccatctccatgcctcctggagcacagccaagttcagaaaactctatattgtctcaacttattattattattttttaaattcagatatttattatgcatcctctgtgttcccaacacaccattctagccactgggggtacagcattaaaggaagtaggcaacagccttgccctaatggagctcacattcttatgggggacaagataaattttaaaatatgttgtatgttaagtagaaaaccaaagcagaggagggtgattggtgtttgggtgtgagtgtgtgtgtgttgtatgtttgcatatgttgggggtgagatacagattgtaaaaagtggtcaggaagggaatggtttcttttctggttctgaaccctcttttagcttaccaagccaaccacagcaaacattaaggatacacattaaggttcagtgagaaaggaggaggttttcctgttagaatcagaagcagagaggaagaaaggcaccattgtgtggccaagaggtggctgaagggcaggaaacccagtccttcgcccccggaagctgtccagttaagccatggcccaaggctgctaacactggcatctgaatggaaatttctaattgtgtagacctgaatggggcttatttttctcaactgaattatggttatatataagagatccctcctcctagatatgaggctggataataattacattgtctcatgaaagtgtaaaacaaattattagtaagtgtgaatttgtgttaaatgttgtcgcatttaccacactgcattgtaatttgttgaattttgtctatacattactcatctattcagcgttgccttatgcatacttggcctccagtgccctcgtacggtgcctgaaaagcacacagtgaaggaggtgctcagtagagactcgttgaaactggaggatttaaccactgcacaccaacttaaaattgttttttttaactgtgattcagccactgttgcgcaggaccatattattagaaagtactgctttcagaattttcaaagttagctgggtgcggtggctcacgtctgtaatcccaacactttgggaggccaaggcaggcagatcacctgaggtcaggagttcaagaccagtctggccaacatggtgaaaccccatctctaccaaaatacaaaaaattagctgggcatgatggcaggtgcctgtaatcccggctactcaggaggctgaggcagaagaatcgcttgaacctgggaaatggaggttgcagtgagccgagacgcgccactacactccagcttgggcgacagagggagactctatctccaaaaaacaaaaagaaaaaaacaaagtaaagctcatcaaaatatatgcagcaactcagttcacctctctggttttgatttctctaaccatatgaccttgggcaaattaccccctggaggacttgacttcctaatctaaaataaacactcaagatgatatctacttcacagagatgtgaattttgaatgagataatttagattgaaagcaacatgtgtatgcatatgtacttcctactttaggccagagccatggcctaagtttattaacaagactgctttttttgttgttgttaaccaaacagcatctcactgttgcccaggctggagtgcagtggcacgatcatggttcactgcagccttgatctgagtgagtggctgggactacaggcgcacactaccacactcggctagtatttttaaaatctatttttgtagagacgggattttgctgtattgcccagctggtcttgaactcctggcctcaagtgatcctcttgcctccgactcccaaagtgctgggattacagatgtgagccactgcgcccaaccggtaacaagacttttaatagagacacctgaaaggtcctacagtttgatttgtataaccaactacatgagcattgcacaggagaagggcaatttagcatctctaaaaagattaaggggattttgcttctagcaagcttgatatgaattagtaataggatgtgactgctgtttaccaacaacattcagcaaagattgattgattgattacctaaccatgtaatggacgtttaaaaagtctattcatagaaatatccaaaactgaatttcccaaagtaagttctgcagagactcacttgatgttctggtttgggaaatggcaggctaaataactaaacatctctcttctgggaatttctgggccttgagttattgtgcattgtgaatctccaaaaaggggcttgcttttacagatctttggtaacaggtggaacagggctgctggtggtttgtgtgtttctaggctcatcctattgcatctggacaactccgttagtgtggtcacaactctttgtcaagtgtagacaactgggccagtatgcagagagcgcagcctggatggggagtgaggttgtgatgatgaagttgtgatgatgaagatgtgaagttgtgtgaagttgtgatatgggaggggcacacatagaaggggcctgagtgggagagggtgtctggggaaggttgagagagaaccagtgggcaaaagtgactgggccagcctggccaacatgctgaaaccccgtctctatgaaaaatacaaaaattagccaggcatggtggcatgcacctgtagtagtcccagctacttgggaggctgaggtatgagaatcacttgaacccgggaggtggaggtgcagtgagccaagactgagactctgtctcaaaaaaaaaaaagaaaaaaagaaaaaacaagtgactgggaaacattttgtacccaaccaaagtaggttttctttgctgatggccatattttccctgttgactctgtgttcttggaggtcatagttccccagtagtgggaagcattcgatgatattggtgagtgttccttaaaatgccatccaatcccaagttgtggatttgtgattatttccttttgtttggcaatctttactccctcagtttttatttttttagcattgtgctagttcctttcgataattagaaaaaaaaatactatgtggtttacgttaatttattagttgaatgacgagactaacacgagacagttgttagtgaattaagtcaacatggaaacaaatccaagttttgatagtctgtaatagaccatcacagaaactggagaaggggggagactgacacggtactgaaagcttcctcaagaggtctgtgaactggggtttgaaggattaatgggatttgcacggcagaaagaatagaccccttgctgtagcagcagctcagggataaaggcaagagacgtaaaagacttttgagcagtaacagtgtggataaatctgtaattaagaaaggtcaagaaagatccatctggcagctttgtgcaggagatgaagatgtgagagctgtctccttaagagtaagcatttaagccatgtgggtgcttgaaatctttcagagagaggttgtggctagaacatggatgagtgaggtataaaagcttagtggttaagagcacagacacacctggttcaaattctagtgctctcagttgacctttgtgaagatacttggagaaactgaagcctagaagttgtttgtaaattggatagtattacttgcctcttaggataattatgaggattaaatgcagtaaggaattatgtaattaagtactcaataaatgttgcttatatttattatgtggccagagttccctagagcagtggttatagaagtgtggtccttagtccagcaccatttatcacctgcgagcttgttacaagtgcacattcatgggccccactcagaccagatgcatcagtctgggtagtgggacctaggaaacaggcttcttaaaagcactctgggggatgggtgggaaacattagagaatgactgccctagaggaatcctccagttgggatgcaaagctaagaaagggagagtgtttaaaggaggggctaagcaactgtgtcctttgcagtgcagaggaaaggaggtagtgagttcttggcggcaccttactataagctttacacaagattttcaataaatacaataaaagctttacacaaaattttcaataagacaactggtttagtaatatgttgggatgaaaggaagatttcagggcagtgggaacatactgcacagcccaaatgattaaaaacaacaacaacaacacaggactgaattagaaatgtgatattagatgaagtttaagtcttaggtttaacaagtatttgtggactgcccccctactgtgactggcagtgtcctatctgctggaaatagagaatgaggtgttactcctgctttcagagacttcacacagttatacttttttttaataattggaagctgtcttttttccttaaaatctttcctagctactagagaataaacacaatatctgatctattctccgacggtgccagaagttaagcatagggctgtctcccaatcaatgcaaggccgcatttgaaactgctccctcatttcggaaagcattctgaacactggtcctttttgcttattattttatggcttgggatataccttaagagatgatttgaaatctttcgaaagatttcaatgtccctgtttaatgttggccacgtggggtttttgacattatgctaacccaccccacctctgtcattcccagtataaagcaccaaaagcactagcttgaaatacagtgacttctaagcttcgtccattattccattcagtcattgtttgctgcgcattatgtacaggatactgctttaatagtgatgaaacctaatgtcagccaagtgttttgtcaaagagccggaatccacatcccaaggccagatgtattgagtgtggaggaggcactggggcctggtcccgaggttagccaagcggttagatgaatccacccccagacacccacaaagtttagatttgtaaatgttccacccctgtaacacatccccctttcacaatgacaaaggcaatttgagggaattagagtgactggttaagaaactatgttttacaatctcactgtttcttgaaaatagatggcatagcagtggagtttgcaagtagaatatagggattacattttgacgtgtttgtgagcttctagttttgtatcatagagagacttcaggaaaatgcaagtggagatcactttccaaagaagacaagattggcaggttaatctgaacactcatttgttaagagcatgttttaattgaccttggactgtgctctttccctattgctttggacttttgggctgggatgggtggatagtgaggactgcaaatagtctttcgttactcctttttctttccaaatctcccaagggtaagtgattggagcctcagtctaccactttgaaaaggttgccaagaccagaccgtggcttcagaccatggcttcagtgcttctagcagtcagagagtcagtggtttcttttctctatgaagaaccatgaactaattctgagaaggtgaacttaaagagagcagaaacctttaaaaaaaaaaagttttaactaattcataaaggtctttcttctgatgatcagagtgctagaatacagattgggtatttggagaagagatggaatatatttttttttaagttgatgctttttctagaactgctggatattgacagaaattcctctaagctctactagctacccaaaagatgttggtgtcctgaaaggtatggaaaatagagttatggtcatgtagggttttaaaagaactaaaagaggctttaaaagtccaaaaagaaaaaaaaatccatagctatgtggtgtgtttttttaaatgattgcttctgaatccacctctttttcccctttttgctttctgcagtgaacacctacctcttcatgatgcaagcccaaggcattctgatccgggacaacgtgagaacaatcggtgctcaggtttatgagcaggtgcttcggagtgcttatgccaagaggaacagcagtgtaaatgactcaggtatatttttagtaaagaggtggtctgattagaatgtctcctcccaagagaggtaaattcggttgcaataattattttcaatgggaaaagcgcattgtaaaagagggatttggctgagttttactttactgctaaaaaagctcttgccaaatgaatcctcgttcatttttgttaacaatatgactcagtctgtttgtgttgctataaaagagtacttgaggttggataatttacaaagaaaaaggatttatttggcttatggttctgcagactattcaagaagtgtgatgccagcgtctgcttctggtgagggcctcaggctgcttccactcttggtggaaggggaaggggaagcctgtgtgtatggtgagaggaagcaatgtggcaggtgagaggagggcagggccaggctcttcttaacaaccagctcttgtgggagctaatagaggagaacctaccgcaacagcagcaagccatttgtgagggatctgcccctgtgaaccaaacacctcctgtaggccccacctccatcattggggattacatttcagcatgaggtgtgcaggggacagacatttaaactatagcataatacattaagagtgactggatgactacttctttttttttttttttttgagacggagttttgctcctgtcatccaggctggcatgcaacgggtgatttcggctcactgcaacctccacttccccagttcaagtgatactcgtgcctcagcctcctgagtagctgggattacaggagcatgccaccatgcctggctaatttttgtatttttagtagagatggggtttcaccatgttggccatgttggtcttgaactcctgacctcaagtgatctgcctgcctcggcctcccaaagtgctgggactacaggcataagccactgtgccagggctctttcttttcaactctttcaaaaactgaatacaggaaggaagtaatacttccacatgattaagtgggactctcttgaggcctctctagtccagccagggatggtttttatttaaaaaatagattctgagatttcatcttactaaggattcatgattcgcctcatttctgtaactgaggactaatgtgctttctgggtttgtttgggtttttttgagatggagttttgctcttgtcacccaggctggagtgcagtggtgttaatctcggctcactgtaacctccacctcccgggttcaactgattctcctgcctcagcctcccgagtagctggggttacaggtgtgcgccaccatacctggctaacttttgtatttttagtagagacggggtttcgccatgttggccgggctggtctcaaactcctgacctcaggtgatccgcctgcctcggcctcccaaagtgttgggattacagacatgaaccactgtgcccgagcttttttttttattctcttgagatggcatctaagtttgtctcccaggctggagtgcaatggcatgatcttggctcactgcagccttgacctcccaggctcaagtgattctcctgcctcgtcctcccaaagtgctaggattaaaggtgtgagccaccgtggctcattttttgtattgtttgtagacatggctaatttttgtattttttgtagacacggctttcaccatgttgcccagtctggtcttgtactcctgagcttaagcgatccacctgccttggcctcccgaagtgctaagattataggcatgagccaccatacccagcctcctatggcttcttaatgatttcgtctaagcccaatattttaaaatacttacatttaaaaaaaaattctccctctaaatcagtcctctcttcttctctaataagttacaagatttttggaagttcactgtcgaatgtgaaattgctttgcaaatgttgcaaatgcgaattattctgtggcgcttagaaaatcaagagaaagcattgcctctcttaaaagaattgcctctccttaaaagaattgaccacatcctaatttatcagtttcctttgccgtccactttagcaacagaggactgtagttagcaaactgataaacttttgatactttcttgttggcaaagaacaagtgaatgacatttcagagctttttagacaaattgtggtcgcactgggtcaagttacctgagctctgaaccatacctgggagaggaaaccctgcagtttccgtcttgcatgtggtggtaggttttgcacaatccgcacacacattctcactcgactcatgtggctctgtcagttaaggcagaattttatgctgtttgcatttttcacacatagtacatataatcttggggaagatggcgcagcttgatcatgtgactctttccctaaaccctgccaaaatcctgcttctagttaggtgaagaaacgaggcagtactgactgcccttccagagcgctctcccctgtatagcactgagtaagggaacatttgtgtcctcatgacatttatccagtccagatgtcatacttctgcagtgttagatgaggctggaatatctgtctctctgggcatttggcagtactggcagttctctcagaagttagaggggcatgcagcaggaccccatttccacaccactgccggtctggcaacacaggattgcgctacttcctgagttgctgtctttgaaaactgagtacagaggtgagtttcacccttggagggtgtatccagtgacccgttattattgaacttggtgtacttttattctcaaattatcatacacccaaataccttttccttgcatctctctggttagaacaatctattttttgttaaacgtgtttatttctctaatagattggaagtctgtgccatcagggactctcttactgtttattagatacttgacttacatgatttcatgtagtccctcacaagaacccagaaggtagctactgtgtccccattgtagggataaaaggaacaaggcacatggaagtcatggaacttgatgcagcagcagggttagggtttgctgattctctgactccagggcctgtgccctgaatcgcagtaatggcttcattccttttgtcatctttgtatccttagtaccttatacactgcctcgcacataggaagcacttggtaagttatttttgtatgcatgaaggaatgaatttaacaagaaagcacgtcttaagtgttgtagcatgtttctaaggaggtcaccatcttgtggagctgctgtgtcactggcacatctttggcgagtaagtacaggttgagcatccccaatcagaaaataccaactccagactgctccagaatccacacatgatgaaaccttgagtgccaacacgacacttgaaaaaaatactcaatggagcattgcagatttcggatttttagattggggttgatcaactggtaagtataatgcagatattccaaaatcctaaaaaatcagaaatctgaaacacttctggtcctaagcatttcagataaggggatactcaacctgtactgaaaagaaaatagcatttcactgaaagtgtatttaatgaaaacccatcattcttcttcatttcaaagcagttgtctacctagcacagtcagagagggtattctgggcccagcactgctgagacagccaaatgactgacacctctggcccgaccacttctgcctggagcactgttggcttaatggtggtaacctggattatgcaccatcctctgctgaaataatgctgaggcacatacccacattcaggcatctgcattaggccaagcatagctcaaaagcccagggtgacatttaagtcatgctggttttctttaagtttaaaagcaacatggtgattagtgaatgaaaacagacttttggggatggggtctgtgaacctggaaataaacctgaagtggtgaccaggagaagcttcctgttgtcactgaaagccattggtttgtgagattgtgaatctgcagagtgagtaaagtcatgctggtgtgctttgtaatctattaatggagtgggtcatcttcacctctttctcggtggttttagatgtccagtctgtagtcttcgatgtggctaccctcccagtaggtagtcatcctttaatggactaactcttgaagaatgctaattctttatatttcacagatatttgtcccagtggcatctttctagtatatataaatttccatatttttttcaagcagagaggcaagtgtttggtcttttctcaaatgggaggggaaagtggtgattcttgctggggtccattggtcagcactttcgattccttctcaactggatttggtaacacaagggagaaggcaggtttttacctcctccaggtattagggtagcaataccaagcttagctatacattggaattcccaaggacgtttccaaagtactgatgtctgtgcctgactgctagcgattcttatttaattggcctgaggtatagcctgaatgttagaattttgtttgtttgtttttgttttgagacagtcttgctctgtcacccaggctggactgcagtggcaccatctcagctcactgcaacctccgcctcctagattcaagtgattctcctgcctcaacctcctgagtagctgggacaccaggtgggtgccaccacccccggctaatttttgtatttttagtagagatgaggtttcatcatgttgcccaggctggtctgaaactcctggcttcaagtgatctgctcacctcggcctcccaaagtgctgggattacaggcatgagccaccacacccggcctggtgttaggatttttgaaagcttcttagatgattccaatgtgcaaccaaggctgctgaaccactggtgtgaagcaatgctgaataagcagttgctgttggacagaaatgttggtctgcaagcccatgatatcagtagccatttgaacctgtaggtaggagtctgttgttttcccattttctatctatctatcttcttttttttttttgagacggagtctcgctctgttgcccaggccggagtgcagtggcacgatcttggcttgctgcaacctctgcctcccaggttcaagcgattctcctacctcagcctcctgagtagctgggattacaggtacccaccaccatgcctggctaatttttgtatttttagtagagatagggtttcactatgttggccaggctggtctcaaactcctgaactcaggtgatccacctgccttggcctctcaaagtgctgggattacagatgtgagccactgtgcctggcctgttttcccattttcttttttgagacaaagtctcgctctgttgcccgggctggagtgcagtggcgggatctcggctcactgcagcctccaccttttgagttcaagcaattctcctgcctcagcctcctgagtagccggagctacaggcgcatgccaccgtgcctggctaattttttgtatttttagtaagagacacagtttcaccatgttggtcaggctggtctcgaactcctgaccttgggtgatccatccgccttggcctcccaaaatgcagagatcaccgcgcccggcttgtttttccattttctaaatgtaaaagcagctgccttctttgcccttcaagaacatgtccaggtttgaaatagattagatttaaattaaaaagtaaaactgtggctgtagaaattcaacaggcttgtttttctctcagcattttcctcattcagtaggtacatgctttagaagagtaagaagttatatttggaactccaaggggataaggtataaccccacccgttgctggacagctagcaggggagaaaaacaagggctcctcacgataactgcacatagttttaccaggtcgtgagcaattaatttcctctgtctctttcattttaaaaggcctctattgctactgaaaagcagactttgtttgtttgtttgtttatgatggagttttgctgttgttgcccaggctggagtgcaaccgtgtgatctcagctcactgtaacctctgcctcctgggttcaagcgattctccttcctcagcctcctgagtagctgagattacaagtacctgccaccatgcccggctaatttttgtgttttttttttttttttttttagcagagatggggtttcaccatattggccaggctgatctcgaactcctgacctcaagtgagcaccccaccttggccttccaagtagactttattttaattaaagttttatttaaaaatttttaaacaagaaatcaggaaattaagccacccctcccaagatgtagagtaagtttctggaagatttttgcaatagagttgttgtgtatttgaggattcttaaaacagtgacatattattaatttagtaatcagaagaaaaataaatgctttttttttgtttcatgctaggtgctaccaggcttactgtatcattgtttgaaggaagtagaaaggaatttatctatcttcaaagaaactccaaatagtagaatcattagagttagtgatatcttgtctcttgcctcatgttttttaaattctagtttcctgattaggttctagctctagggcttgggtcagtcattgaccagaatgattattatcttcgtttttgttgatttgtttatgaaaatatacttagtgtaatacttttgggaatttcattgccttctagtgaatgtattgactgtgccaatacatgtttccagccagcgtctcttgccacacatgggcgtatcacaaacacaggcacattttctattacttgtgaggtcttttaatttttttctaaaggagaataatttcatctattagattcatccagagtaataattaggatgaggggttcttcacatagatttttgaagtagttactaccttcagaagaagattcaacccaggccaggtttgcatgtatgagctgagctcagagaatttctgtgtaaatattatctttaaggttctgtcttggttcatgtttttgtttttgtttttttttaagataggatctcattctgtcacccaggctggagtacagtggtgtgatcattgcccaccggaacctcgacctcccaggctcaggtgatcctcctgcctcagcctcccgagtagctgggaccacaggcgcgcaccaccaggcctggctaatttttaaaattatttgtagagacaggttctcagcatgtttcctgggctggtcttggcctcctgggctcaggcaatcctcttgcctcagtctcccaaagtgctgggattataggcatgagccaccccacccagcctggtttatgtctttatataaattagtctctactattctctataaatgcaggcttagtgtttttcaggaaagctactactgaaaaggacagaaagcattctgttccttcccttgttaagacacagttaaaattttcaagttgcctctcgttgaattttgccccagagtacttgcagagtaggcagcgcagagtaggcagccgtgtgcatatataaaaggattcaatgtgttagccatttgattcttggaaacctgctcatagtgctttttcaaaaatatcttagttgaagattctagaattctagggtacaaagtgaatttgaacaggatgttttaattttcatagaatcagcatggatccaaaaggatttaatattctgtgaaaaaaataaaaacaatacagtatactggaaggatctctcattcagagtttagttggagctctgtcatgcattagccagggctcctggtctgagttctgtgtatgttgttccagttattcatctgtagaaaatgaggttggaggaccctcctcctactctacaagtacagtcccctaggaaaaagacatctgccatcacactcttcatatccactaacgtgactctaaaggggcatacatatgtgagggtttttaaattataaacccttgagaatgagaacacaaaaggagaccacagcaaaaaaccttggtaggtagaaagcagaagaaccactgataaaagacttaacaaacccaagaaaactgactgctcaaagcagcaacaggagaaccagcaaccaccccaggatcccccagaagctcaggaactagcaatatgggaagtaggagcaaaggtggcaactaaaataaagggagattgaaagctgttaaaaagcagtcagatacccagacccatttccccatcctggcaagagctggagacttaataaccccagagatggcaaaacagaggctcctcaacctggggatacctggcatgaccacagtatttgaaaagatggggattacatatgccccagcctctttctcttctttcttagtttcaggatgtttatagtcaggactctaccattctggcaggagattcgagtggatttctctggagaatctggtcagaccaggagaaaagacccaaagatattgacactggagataccaataagagaaaaatgactgcaaacatgaaacaagaatatagtaagaaatgaacattcaggaaacaagagctcttcaaagttaaaaaatatgatagcagagatgatgattaaaggaaggttgagtaaagttgaggaaatctcttggaaagtagggcagataaatggcaagacggaaaactggatagaaaagatgagacagaggactgggaggtctcacatccaactcctgttctgtattctccagaaaggcagcacagagtacagaagggaggaatcatcaccgagagaatacctccccccaagcacatttggcatggaagaaggccagaagctgccacacctcctctgggaggatgaagttgagagaatacctaatgtatgtcttaggaggaaatgtcttggtgaaaggcgtagtgttgaattagaatcattgcatataaaactgagcaaacagaaaaacaagatgcataactttccacatttctcagcgacgactagtacttaacagcagcatcgtaatacaaagactgaagattgtcctaaccacagctatgatatgtgaccgatgggagactggggaatggaaggggatcgtgtggcaggggtggcagaaggaaggggataagtgggaggtcggtaggtaagactgaaaacagaaacatcacgaccagccgtagaggctgacagaggtgaatactgcatataaatgctgagatacttggccaaaagaagggcaagtggttcctttagaaaacagaaatgagaggagggcaactgctgtttttaaaattacatttaattacagttgactgtaaactgagtgctgcatataaacctataaaatcaataggaataggaacactggttaaaatctgccatttggctgacatttttattgatgggttcacatttttagctgcatcaaagcggtagtccagagtcctgtctccttctaccaagatgatagctaagagaaagacttacttggtaggcatctgataattgcacggttgatcacacataccagtctgatcgacttttttcctttacctccctagattatcctcttgacttgaaccacagtgaaaccttcctgcaaactacaacatttcttcctgaagacttcacctactttgcaaaccatacctgccctgaaagactcccttccatgagtgagtacagctctggcctgtcttcctctgcttttaaaatggataaaggggagggcactcttgatctctctgtctgcctgcagagagaatataaatacctccctgccattggaaacagggtttgtgaaagttgtgctcctggctcctcttcaaagcctgctgcaaggttgcctgtgttcttgggtgccattttctacctttcctactttttcactcttccctttgcccttgcctgtcctttgtaacttgggttctgtttgaacttcctagagaaagtatgaatacagtcattcatagcttaacaacgagggtactttctgagaagtacatcattaggtgattttattgttgggagaacctcctagagtaaaattccacaaatctagatggtgtagcctgcgacacccctaggctgtatggtatggcctattgctcctgggctgcaaacctgtgcagcatggtactatacagtaattgtagctcaatggtaagtatttgtgtatctaaacatagaaaaggtacagtaaaaaatgagatataaaagataaaaaatggtacagctgtgtagggcacttaccatgaacggagcctgcaggaatggaagttgctctggtgagtcagtgagtgagtgaacgtggagtgaatgtgaacgtgaaggcctgagacatgactctgcactactgtagactttatgaacactgaacactttggctgcaccaaatttattcagaaaatatttgtctgtctttaatggtagatgaaccttactattatacctttctactttctaaacttgtgaacttgtaaaaagttttaaaaaaaactgcagccttgaactcctgggctcaagcaaccctcttgcctcagcctcctgaggagctaggactacaagtgcctgttgtcaatgcctggctaattttaaaattattattattacttttttaagaaatggggtgttactatgttgcccaggctggtcttgaactcctggcctcaaacaaccctcccacctaggcctgggcaacacgctgcagtgtgccatgatcgtgccactacactccagcctgggcaacaaagcaagaccctgtttcaaaagggtaaaataatgatttaaaaatatagtataataaatatataaaccagtaacatagtttattatcattatctagtataatgtactctacataattgtatgtgctatacttttttatttttgagagggagttttgctcttgttgcccaggctggagtgcagtggtgccgtctccgctcactgcaacctctgcctcccaggttcaagtgattctcctgcctcagcctcccgagtagctgggattataggcatctgccaccacgcctggctaatttttgtatttttagtagagatgggaattcaccatgttggccaggctggtcttgaactcctgacctcaggtgatccgcccacctcagcctctcaaagtgctaggattacaggtgtgagccactgctcccagccttgtgatacacttttatatgactggcaatgcagtagatttgtttataccagcatcaccagaaacacttgagtaacacaacaatgctatggcagctatgtcatcactaggcagtaggaatttttcaactccattgtgatcttatgcaaccaccgtatatgccatccgtcactggtgaaaatgtcaaagcacatcactgtataggcagtcagctttgtctttttagtataaacctctcactgattgtagtgcttgatcttagaggtgggggtctcactatgttgcccaggctggtctccaacttcagggagcaatcgtcctgcctcagcctcctgagaagctgggactacaggcatgagccaccatgccttgcttggaagttattttcttaacaaagtgctagttaaaacaattcttagatctttttgttcttttttttgaatctcgtgtaagctaaaacaaggacagtaaactcttatacctttcctatacttttaggcttcttaatatggttccccacttctttttttaaaattgtttttttttaagaagtgagatcaagaaaaggaaaatcttacatttgcaaagttgacttttatgcacaaatatagtgaaaatagggaaaatgttagaaatagtcgtgcatggtatttgaacatattctcatccatatatgaataattaattataagtatgtaagttgtgttggaagccttactgtttcatttgcatgtctcaccacacatatataggttttccctttaaaacctgcatttgtctgcatctagatgtaagcttagtttgggaaggctgagatttgtgtatcagaaataggcgttgacaggcctaaaactaatgttattagttcattgtttcagtagcatttattgattgttactgtaccacttcctgacttaagtcagagatgaccagcattctgagttaggacataatcactcagggtcctgacccactggtgaatggattgagagaggtagtgtggctgcacttgcatcaggagcaaacctgacatgactctaagctcagctgcttttctccttcttctcagaaaagctcagctgcagccaggtgcaggggctcatagctataatcccagcactttgggaggccaaggtgggagaatcactggagctcaggagttcaagaccaacctgggcaacatagtgagaccctgtctctatttattaaaacatattaataaacaaaacaaaaaaaaaagaaggctgggcacagtggcccacgactgtaatcctaacattttgggtggcccaggtgggtggatcccttgaggtcaggagttcgagaccagcctggccaacaaggtgaaacctcatctctactaaaaatacaaaattagctgggtgtggtggcatatgcctgtaaccgcagctactcaggaggctgaggcaggagaattgcttgaacccagaggcagaggttgcagtgagctgagatcacaccactgcactccagcctgggcaacagagcgagactgtctcaaaaaaaaaaaaaaaaaaaaaaaagctcagctactgttttacttaaagttttcatttctacctggcccctgacagaagcagaactctaaagtcttaattccttgatttgcctcttcaccttgaaaatagtgaggaactgaaatacggtgagatggaaagcagaggaagggacttccatccttgctaaaaacaaattcagctgaaaaagcattgcgctctccagagactaaaaccccaggcatagggaaacctatcattttctgacctcttaatcccttttccccgtctctgttcagagggcccaatagacataaacatgagtgaaattggaatggattacattcatgaactcttctccaaagacccaaccatcaagctcggaggtcactggaagccttctgattgcatgcctcggtggaaggtagggtgtgaagtcacagccaaaatgctgagaagcccacctggggtttgcctttggtccgaatcaccatgggattagctaaccatgacattttgtcattttcatcctaccattccatgcaaatgtagaaacattttagaggaatgggtttccacaaggactctttttgtagatacagaaatttgcattattctgatgaccgagcaagaccctttggtcttcccaccaggaatattaacaaagcaaggggatgagggcgttggtggtctctaatgacccatttgcagaagtcatctacagagtcagtgcttcattcctgttctccattggttactacaagattagtggattaaaaagcaaagttacctggcttgacattgagatttagtttttttctgcctgaccatagtcagaagacatcagtagttttcgttaagctgtgaccccagctgaagtccattctttcaacaagtatctattaaaatgcgtattctgtgccagcctcgttaagtgctgctgatgcagcagatctggaacacatcagtatccagcccatcgctgggaaataaaaacagttgaataaccagcatttgtacattgcacattgtaaggggaaatactgttttgtgaagcttgttttaattgtaagtttatagatgtatttttgtcacagtgtagaatgtgtgttttcctatgagttatggcctagaataaattataggcctactatgtactataagatatggtatatgtaagaatcacattcatctaggtccaagggccaacttgccaacatagatctttgtttagagaaagctgaggacaagatagccagcctcccagaactcccatgggttggtcagcaattcatcaggggtgtcctgctaaggagtgaaagctgagagtcctaactgtgcttcttttgctgtaatccactccaggtggcgatccttatccccttccggaaccgccacgagcacctcccagtcctgttcagacacctgcttcccatgctccagcgccagcgcctgcagtttgcattttatgtggttgaacaagtgagtagtcctttcttttcctttcttttttctcttctgagacagcagtttaggttgctgcaagctaatccactgttggtgtgaagagccaataaaactgaaatcttaggatcgagttgcctgaggtttgaagggggagcagagagcaattctgtgctcctggtttgagatgtctgttgcccagtactgggcacacttgaatccaggagagagctttgttggctcatgaacaaaggcctcttgtattatggttttgttggtgcctgcaggctccagacccaggaagttccccttaagataaagagctgcagcaaggtacagcacagaggatgtggccttggagtcaagagacctcagtgcttgtcatgtctgctgttaatcaaccaagtggcctgggacatttgcaaacttctctaagcctgagggtttggttttgttttaatcttaaaaatattggtagggaaccagatatagaggtcacaaactgaagaagaccgcatggcaaattcagtctgtaaatctttttttttttggtcctgcatatattttatttgcctttagatggaacatgactgtcctactgtggttttctcttgccgggcctactttatatgtttacattactgacttggcttctgtaggcattttgaagtatgtgatccttgaactagaggtgctatatccatagataaacaaaaggttgacagatttccctgaatacactgatcgtcagtctgagggtcttttgcatgctcacctctctctatgggcacacttttgagtctcacagtctgagttgctgttaagtggtcaccctggagcttgccttatactggagtgagaaaaaagctgagcaccactgttcagcaaggctgggcatctgggaaatgctaacggtctatctgccggtcctaagttgggtattttgatagtggcaagggggagtcaatgtagctgtaacactaattaggctgttaactgatttgaactggtttcttcatgagccactgaattctttgtccataggcttgagtccctggcatgctcagtgactgttgtcttagttagatcttaaaaataaaacaagacaaaactaaaaaccactctttgtactagatttggtttatgaacagttagagattggttgatgtgctgaagagcaagtggtaaggagtagaaatggtagtgttgtctcttccctttgtggagcggggtactcttctaaatgctggtacacggttgcatttctgccttcagtagccttgggagagagaagcttgcgtttgctatcacttacatttttaaagaaattggggccagaggtccagtgactttttctttttcttttttttggagatggagtcttgctctgtcgcccaaactggagtacaatggtgcgatcttggctcactgcagcctccgcctcccgggttcaagctattctcctacctcagcctcccaagtagctgggattacaggcatgcgccactacgcctagctaatgtttttgtattttcagtagggatggggtttcaccatgttggccaggctggtctcgaactcctgatccgcccaccttggttttccaaagtgctgggattacaggcgtgagccactgtgcccatgccagaggtccagtgacttctgagccacactgtgagttgatttgtggtgttggacctggttacactagcccagtgatcttttccagttggttctaataaactcgtctttaggcacaggaaagacagcaaagattttccttcaagattcttttaaagataaagttctgtttcttttaggttggtacccaaccctttaatcgagccatgcttttcaacgttggctttcaagaagcaatgaaagacttggattgggactgtttgatttttcatgatgtagatcacataccggaaagtgatcgcaactattatggatgtggacagatgccgaggcattttgcaaccaaattggataagtatatgtatctgtgagtatcatttcttcttaattaaagaggttaaatctgaaaggatggtgagcgatgtgaaaaggaaatctaattagctgcaacctagatgcccatcaactgatggatggataaacaaaatgtgtgtatccatacaattggagcactgtttggcaggagaaagcaatgaaatactgatacgtgccaaaacacggatgaacttcgaaaacgttacgttaaagaagccagacacaaaggttgtgtatcatatgattccaggtgtctgaaatgtccagaataagcaaatctatagtgacagaaagtagataaatggttataaggggctaaggaggataggaggagcagggggtgattgctaatgggtgcaaggctttgcgggggacagtgatgaaacatgttaatatagattgtggtcatggttgcacaattcagtgaataaactaaaaccattgaatgatatactctaaatgggccaattgtgtatgggtatgtcaattatatctcactaaagctattaaaaatcagtttgcaaaaattaattttgctaatttgatacattcatatggttcaggtcaggagcacagagagcactgtttttagtcctcaaatgagaaccttctagggaaaacagttaccctgtaacacacagatgattgatgtcccacatctcctcctaggcttccttataccgagttctttggcggagtgagtggcttaacagtggaacaatttcggaaaatcaatggctttcctaatgctttctggggttggggtggagaagatgacgacctctggaacaggtacctctgccgttctttcggtgtcttctagaaatgctaccttagactgcagaccaatactatccgataggaatataatgcaagccatgtgtgtaatttaacatgttctagtagctacagtttaaaaggttaaggaaaaaaatgaaattgaccagctgtgatggctcacacctgtaatcccagcactttggaaggccgaggtgggaggatcacttgagcccgggagttcgaggccacagagagctgtgccactgcactctagcttgggtgacagagtgagacctgtcttaaaaaatacacacacacacacacacacaccacacacatccaagtttttagaaaatatctttaatcttaatttaaaaatatcttaatatcttaaaaaacaaactgtatatcccaacaaagcagctattttcatttttctcctttgacatgcgaaaatcaacaaattataatttagcaattttttcttctaataaataatacgttcattataaaatacaaatgagtataaaaataaattacccacaacaataagtaacatgttaccatttcattgagtttattttgtgtttaaaaagtggcaagtgaacagtaatttaaaatctctgtgtgtcagtttttaaaatcacaaatctcaggattgtgaggattaaatgatgtaatgtgtatagagctctggcatatctgatatgtgataagctctcaataggtgttactgtttttattatatcaacattaaatactctgtaaacaggatcttaagtggctccatttaattcggttatatagatgtactgtaatttatgtaactatttcctggtgtatatttagaatcttttccattttccactatttagagtgtgatatagtagataattcttttgcctgttattcctatttaggaaaaattcctataagcgaatgtagtcattttaaggctctttttttttttaagctctgtcctttaatggatgcaaatagggtttttaaggcatattataactaagtgcccctcctgctaaaggttctaacaaaacttttcacttcaccagtgttctctgtactaaatgcccatttcattggaaccactccaaactgaagggtggaatattagtgatatgtctacatagatttagctgcgccatcacataaggcttgtactgtacaagcttgggtgaacaatcctgtgtgtgagtggaataaagtaatatttttatggagtaagtaaacagtaacctcataaggaacaaatgcaaaatactacctggtatctgtttcctttgtagcttggcttttgaaaagtatgtgtttgttgttaattacaaggactattttgctaataaaaattcaaatgataggctgagcactgtggctcacacctgtaatcccacctcttcacaaggcctaggcttgaggatcacttgagcccaggagttcaagaccagcctgggcaacagtgagaccttgtctctacaaaaaataaaaaaaattagcctgttgtggtggcacacgcctgtagtcccagctactcaggaggctgagatgggaggactaattgagcctgggagattgaggctgcactgaaccatgatcacctcactgtactccagcctgggcaacacagtggaccctgtctcttaaaaaaaaaaaaattagatgatacaagtgtctaagtattaatccccattttgattctattttattccctggaagtaaccatttctttccgtacttttcttttcttttttgagacagattttctttctgttacccaagctggtgcaattttgctcactgcaacctttgcctcccgggttcaagtgattctcctgtctcagcctcctgagtagctgggattacagacctgcaccaccacgcctggctaatttttttttttttttttaagtagagatggggtttcaccattttggccaggctggtctcgaactcctgacctcaaatgatctgcccacctcggcctcccaaagtgctgggattacaggcacgagccacctagcccagcctattttttccgttcacataaaaactttaattcagttaaaattgagttttaactcagtttttaagaaatgacacaatgagtcagttaagcgggtgagagcttttgctgtgtgtgatttccagggtaagcttgtaacatgtcttgtaggctttggtcactcctgggctattaccgttgtatctaaaagcctgttctcttggtcttggacagagtacagaatgcaggctattctgtgagccggccagagggtgacacaggaaagtacaagtccattcctcatcaccatcgaggagaagtccagtttcttggaaggttggtggaatttatctctgtctcttagaagtatcccctatactttcatgtccggatatcttagagcatattacagccccttctcctactccccaccccgaggccctgttctgacagctgtttgacagctgttgcatgtattctaactctgaggcagaacagtgtggggatcagaccgttggtgaacattttcaatagtaagattcttcgaaggaaatcacttgtcctatgtcttcagccttgtggtctccacagtagcctttggggaatttgggaagaaacagcttgggtgaaggtccctgaggtgacagagcagtggcgccctttccgcaggctcccgttccgaatggtgtcctgagcttctgtctgggtggctgcagttgctgtgttaccttttctttctttgtgtgtgtgtgtgtgtgtgtgtgtgtgtgtgtgtgtgtcttttctaaattgtggggaagactgtgctctagacaaccaattctaattgctgaaattctgttttcatgggagtaaaatggcactgaatacagagtatgaactttctcatctgttgtatttttaatgctttacctcccacttccccactctctgaccttgggcaagttacctcacattattaagccttggcttcctcatttgctagcaggggctggcgtgagcattaaatgaaataattaagtgaagcacctggcatgaaacacaggaggtgtttctgaccacagcactcagcctggcatagcagaattggccgtgcgcccaccttgtgctgcagaagtgctgccatgggttgcgtcctctgctgtgggacgccctgctccatcctctggctgcagaggcatggatcctcactcagagccacctcttctctgttccctccctaaacaggtatgctctgctgaggaagtcaaaagaacggcaagggctggatggcctcaacaacctgaactactttgcaaacatcacatacgacgccttgtataaaaacataactgtcaacctgacacccgagctggctcaggtgaacgagtactgagaggagagaatgtacgtttgctttacccaccgccaccaagaaagcagtccgatgagatttttttttggaggggggagggtctacacagcaagagaacagaaatactgtgtctcatgaaggatcacagagttcagggggaaaatgtgacagcacacgcacaaacgccttcactggatcagccgctggaactgagggagtgagcttggggacttccttcgtcagcactggctttctgttttcacaagacagacgtctgtcccgctgctctctccccatctcctaccccacatcctgtcttagccgcagtctccagaacccatgatgaactgtgatctgccgtggtcctgccgtggtcctgccgtggagcctgtccctacacatgaccttggagcctcttggccttcagagcagaggcaaacccaccacagggcagctgcgttttaggaagagcaaatgaaactccacaccattcttctagatctctggtgttctctttggtttcattttttttaaaaattaccttctttgggtggggattgagggtggaggggagggtgtttgggaaagataaatagacataaatatataacaatcacttcttgaagaagtataattgtaaataagccatgtaaaatgcctttttaaaatttaattttctagctggctccaattcaaattgaggatttatgtattaggccacttacttggttggcaagtgcaggaactcagttaaaatgcagttgaagaatgtcatctcccgaattgctgtcactttggcgagggagtggatatagggcatgtcacaaaagaacaaaataacccgacctttattgctgggagctggcttctgtccctttcttccccccccccacgagtcttgcccttgacttctgctctggattcactcttccctgtcggccgcgcatgtgctcatcccactctccgctaagcgggaggctgctgttagagcaggctgcttcctgcctaaagcaggcccttcggggctcgctgcacacacatctctggctctccaggcttcgtgttctgtcttttcatcagcatggcggggcggggggcggggggcgggggtgtgtatgggaatccctccccctcttactttttctcttgtggaacttggccacagtttctgaacaatgtgcctacattaccagctggcttcagtgattcctctgtgtccctttttggtttctggaaagattctttgtcaacattagtaactgatacatagaaccaaggagcactcaaatagggagccaggagccagggagctggtgacacttgtgtgctgtggggcagctgggatccaggtaagaccggattgaagctttgaaattagactaacaaagctccagacagcaagagcccaggtgcactgctcacacccccacctgcattttgaagtcatattattttttgttttgttttttaagacggtctggctctgtcgcctaagctggagtgtggtggcacgatcacagctcactgcagcctccatctcctaggctcaagccattttcccacctcagcctcccgagtagctgggactacaggtgcacaccaccacacctggctaattttttgtatttttagtagagacgggggtttcttccatgttgcccaggctggtctcgaactcctggactcaagcaatccgcccaccttgacttcccaaagtgctgggattatgggcgggtgtgagccattgcgcccagccttgaagtcatgttctaaattgtatttgaatttgtgcctctttgtttttccccaaaccaaagccctcaaattgtagtctctgtcggcttctgcagaattctggaaaatgccagttttcctcccccgcccttgttttccataaaacatatttatatattgtgatgaggagtactttctgaagagtacttcgtatttttttttaattgccttgtttgccttcaacttccttgattttcatagtttacatgggtgtgtgtaggggtgtgtgtgtgtatgtgtgtgggttagggcttttttcgttgcatgtgatggttctgtggacatatgatccccacaaactgtgggagtgattggccaggccttgttttttttgtttgtttgtttgtgtttttgttcttttgaagaatagagtggtatttagaaaataaattgcattgcaaagctcttatcggctcatatgagagagcaggttcctgcccttgaaaatgccggtaagctatagcatatgttttttaagacttaagcatttcatgctttaaaataccttcacaagtgaacattacacacagaagttcatttggttttcctttgttttatggtgcatatagcaataaagacccccctccaccctgcaacccccatcccccaccgggcctttgtccctgccttggcttttctccccttctcattctcctctcccctttcctcactgaaggctgtgagttgctttcaatgtgacaacactatgatgtcatttggaaggatttgccaggacagactgattctgagtcctgggtgccgtatgtgtatgcggcagtgttgtcaggcgatcttgtttgaagctctatgttgccataattaccatcaagtacacactgttggcaaaaggctaacacctgactttagaaaatgctgatttgagaacaaaaggaaaggtcttttttcactgcttaaagtggggtcactttgatacctttgcggtcatgtctgtgtctgatgagtgtagaatctctggatgtgcactgtcagtcatgtgtccaccaggcctcgaatatcatatgggaaatgtcatagttaaaaacgtacagccaggcccgtgtgctgttaatagtgtgaaattgtcatgttaaaaaaaaaaacaaaacaggaaccaaatgtgaccttgtgcatatattggtagctgaaaatcttcaaggctactgatgggtggccccttaatcttgtctttgattgctgtgtgcagggaaaggtgtccccgtttgttcatgctgttttggggggtgggggggtatttgcaagaatactcattttgacataataggtcctcttgtcagagatcctctaccacagacattaatagctgagcaggagccacatggattgattgtatccactcaccattgacgatggcattgagcgtagctagcttatttccatcactacgtgtttttgagcttgctcttacgttttaagaggtgccaggggtacatttttgcactgaaatctaaagatgttttaaaaaacacttttcacaaaaatagtcctttgtcattacattatttactcatgtgtttgtacatttttgtatgttaatttatgaatgattttttcagtaaaaaatacatattcaagaaccaaaccttggtggtcatttctctttgtgtaggacagtttgggtccttgggggtctttcctttttcctttcctttcctacaggagttcaacttaaggcagctcagctgagctctgggtcttgctggggtaaatactgcctgacccgtgctgcaggtgaacgggctgagtaaaaagctacgcagtgtaacagaagcagtcctccactgtgctgcccaggcatgcccacgcttgggttttctttcaagaatcacccaggtggtaccaagaaagttgcataagacacttgagtgaggggacttgggggtgaagggggtggtgagggttgatggagtttgattccagaaggttctctgggatcagtgtagggtttatatgccagattctgctcagagattgtcatcatggcttctatgtgttgaatgtttgccactcacagtattaatagtgtcagatgccggggacataataatagagaaaataagacaggatcagtggactcattaaacttacggtccactggggggtatgattaaaattgtatcctcaatacctggtccaaaaggggaagctgcaggtgacgagtgcatggtagggtgggcattccagttgggaatgtagggaaggtggaagcaagtgagctagggggagacaaggagcgtgtggcacacagctgcagggcagggaggaagccagcgtggctggagtagagggggcaggggggcgcacagggggaggagtttgcatttcatccttagagcagtggattcaagagttttcagcaggcagggctgcgtgatgcgattcggattccatagcaactttgagagatggctctggttgcagggagaacgagcgatggtacagaagcagaagagaagcaggggcgagtgagatgggtgcagggacgacggaggaggggagactgggagatactgaggtcgtgctcccaggacctgccaggggtgatggggatggaggactccacctaagctgctggcttcccacttgcacaggtaacagggccattccctgagatgggggcactagagtcagaccagattggcgggatagatacgagatcagttgtgactgctgagttcagggagttttgagacaacctggcagagacagcagggtgggggctacaggcagactggggggtctttgggtggaggaggttagtaaggacccagcagcgggtgagattgctgggggattgagaacaggaagcatagagtaagagaaggcagcagccttggcccagcctctgagaacctggttgagaaaaggaggatgagtgagcaggaggaggggtgggaggacaagcaggccaagagggagagtggtcagccgtgctgaaggcagcagagaagcgatacaagaggaagagggagaagcagtgagttggcagtggccaggtgttggaaatgtggcaggagccgttttgctgacctgatggggtggaaggaggagatagcagcagagtgggtgtctcttggatttcctgggaaggggtggaaagaggaggtcagggccacaggaagcgcgggaagctgggggtgggaggtgaggtggggttgggttttggttttcccacaagagaagcttgagtgtgtttcttctgaaccacagggaatgtctgagagagcacagctgaatacgtacaagagaccaggtgatctggtgggaatgtccctgaactactggcaggagatgagattcaaaccagaaaaaccaaacagaaggaacgaggagctctgtataggccatcccattggcagacacacaccccgtgaagactgttgttgctgtggaggtcagagatcccttccagccagctgctggaattgggattcagcagaactgattcctggcactaccacgtcctccatactctcaacattttttttttttagttttcagggaagtccagtaataaaaatagttcctatttattgagtacttgctatgtgccagggcctatgctaagtgcattgcacaccgtgagtcctcaacccttgagaggcgggcactgccccttgttctggagcacggcttctccacattgctcttgacaaatgggggagctgtcctgctcattgtcgggtgttcagcagcacccctggcctcctccctctaggtacaaacccaaatggaacagctactctagacaaactgaagccacagcttgcctgaggtcacaaagctagcagctgagccggctggggacatttttgccccagggaagacgctcttaacccctaggctgcttctgctgacccaactcttttgcatatgtgctctaaatagcttttgttcacagagttgaaaagtctattctaaaagtaacatgtgaatacgtgcttgctggaaaataagtgttaaaccactcctttaatattagcagtttgactgatgtctacattttttagtttttttgagacggagtctctgtcacccaggctggagtacagtggcacgattgtagctcaccacagcctcaacctcctgggctcaagtgatcctcccgcctcagcctcctaagtagctgggactacaagcccacaccaccacgctcagctaatttttataatttttgtatttcttgtagagatggggtttcaccatgttgtccagattggtctcgaactcctgggctccagccgtccttttgccttggcctcccaaagtgctgggattccaggtgtgagccaccatgtccagccattggctgatgtccagatctatacctgtatacctatatgcatgcttaggaaaacaaaggcatagtttaaaaaccataagttgtcctgtaattacttttgttttgttttgttttttcttaatgtttctggagacctcttttccgtgaatgaagagctccctcaaataaagcccagatgttacctccttggagaagatttgatgagcacccagtctgaaatgccacctccctgtccctgtccccccttaccctgttttattgattcacaatattctcactctgaatcgtactatatttttattgttctttgttcattggctgtcaaccccactaaaatataatccccatgaaggcagagactgttttgttttctgctctatccccagagctaagaactggtcttagcacatagtagttgctcaataaatatttgttgcatgaatgactgaacctatcttattatttgaattgtgacacatggtaatctcttgtgtggatgtatgtaatttagccattcccctcctaatggacatggaggtagtttccagttttccactatcacattatatgcaccacagtgaacacagatgcacatcaatccatgtgcacatatatgtgtaggccaacttgagagagtccaagaaatgaaattgttggagcaagggatacacacccacaccacacacacacacacacacacacatatatatgcacacatgcacacacaaatacatacatatatttatttgtttatgatataaggtctcactccgtcaccccaggctggagtgcagtggtgcgatcatgggtcactgcagcctcaacctcctgggctcaagctatcttcccaactcagcttcctgagtagctgagaccacaggcacacacaccacacctggctaattagtgtattttttgtagagacagggtcttactatgttacccacactggtctcaaattcctgggatcaagtgatccacccgccttgtcctcccaaagtgttgggattacaggcgtcagccatcacgccccacctgcacattttaaatgttgaaggagcctaccaagttgtcctacaaaaaggcagtatgaattaatccttctaccatcagtgaatgatcatgctatttatatctttaacccctggaattaaaggggattttgtgtatgatatggtcaggaggggcggtctataatttattttttccaaatggattgctaattgtctcaacagtatttattgaacaatcaataatttccccatgtcttacacattaaattctgtagcaagattcttccatttcattgagctatttgtcttattatgccttacagttttaattatgatagccctgtagtatgtttttataagacaagtttatctctactttctatatcctaccccaaattttgtaaacatttatagaagtgtaatatacatacagaaaagtccataaatccaaagcaaacagctcttttgtcagggtgaacatacttacacaaccccattctcatcaaaattttcagccaggcataggcaggagggtcacttgaggccaggagttcaagaccagcctgggcaacatagtgaaaccctgtctctacaaaaatttaagaaaaaattagccaggtgcagtggtgtgtgcctgtagtcccagctaccgacgaggctgaggctggaggatcacttgagcccaggagagtgaggctacagtgagccatgattgcaccattgcactccagcctgggtgacacagaatgagactctgattcaaaaaaattgtttttcttggctatgtttatgtattttctcaatccggtgagatttattttgtcaagttatatttaaaaatctatttaagggccaggcatggtggctcatgcctgtaatcccagtactttggaggccaaggcaggaggatcacttgaagccaggagtttgagaccagcctgggcaacaaagagaccctgtctctatattttaaaaaattgctttttaaaatctaggatcatgactgacattgcactaaattaatgatctgggaagacagcatctttagcatctttacagtattaagctttacctctagacttaccaaattcttttgctgaggtcaggcgctgtggctcacgcctgtaatcccagcactttgggcggatcacctgaggtcaggagtttgagaccagcctggccaacatggagaaaccccgtctctactaaaaatacacaaaaaaatagccaggcatggcggcaggcgcctgcaatcccagctacttgggaggctgaggcaggagaatcacttgaacccgggaggtggaggttgcagtgagctgagatagtgccattgcactccagcctgggcaacgagagcgagactctgtctaaaaaaaaaaaaatgctagtttcctcctaacctggtaccctcgatgccacagtaccttgcaggtgggctgttcttaataaatacagtcactgagtaacaattcagatttaccatcacatgcaaactagctgtaagggcaaacggttaaggaggatttatgccgcttgtgaaatgcaacctgctagatgctggcagaaaactttccaggcaggctacatgccatgagactccttgaggaagcacagccctgagtacttttctcactgctccaagacacaccttttctctgccaccacgcccgccccactcagcaccctgctacgactagatgtgggactgacaaatgccactgtttgacttatttctaggacaatggtgggtggcagtcatgtaggagagaggtctctgctgtgtagggaggctcggaggtaaggaataggtgggagtagggtatacatcttccactgtgaattctaggaagagcagggcccaggagagatgatctgctggttgcacttctacagccaacaactccatggcctggggaagtcacttcacttccctgcaacttcatttccttgcagtcagatggagagacagcactttgggaggctgaagcaggtggatcatttgaggtcaggagttcgagaccagcctgaccaacatggggaaaccccttctctactaaaaatacaaacattagctgtacgtggtggcacatgcctgtaatctcagctcactcaggaggctgaggcaggagaatcgcttgaacccttgaggcagaggttgcagtgagccgagatcgcaccactgcactccagcctgggtgacagagcaagaccctgtctcaaaaaaaaaaaaaaaaaaaaaagccaagaggacagggctcagagagcttccagatagctgaacacacggaggtttgtaagaaggtgaacaagaactcatccacgtgctgggagggtggcatggggacaggctcaggacccttccagacctcactgtgtgtgtctcatctggctgtttaactgcgtcctttaaaagaacctttgtcataaaccagtagacataaaagtaagtttgcctgagttctgtgagctgctttagcaaataaattaaacccaaagagcgggtttggagctgatcggtcagaagttctggaagcctggacttgtgactggtgggaaggaggggacagtcttggggactgagccctcaacctgtgtgacccgaggctatcttcaggtagacagcatcggagtggaattgggggatgccccgctggtgtccactgcttggtgcttggggaaaaacagacacacatttggtcatggagatgttctgtggccaggtgcactggctcacacctataatcccagcactttgggaggctgaggtgggcagatcacctgagatcaggagttcgagaccagcctggccaacatggtgaaaacccatattgactgaaaatacaaaaattagccaggcgtggtggtgggtgcctgtaatcccagctactctggcggctgaggtgggagaatcacttgaacccggaggcggaggttgcagtgagctgagattgcgccactgcactccagcctgggtgatagagtgagactatgtctcaaaaaaaaagtctttagtgttgattgctgtagtgtgagagcagaggaaaaacagttgttttttccaccgtcacaggggccgtatgcagtctctgtcactcagctattcaacttctcaattctgccctcatagctcaagcagccccagacaatatgtaaacaaacaggcttggctgcattccaataaaactttatttacaaaaacaggtgggtggccgtaatttgccaacccccgagtttggctgaaaatcaatagaaatgtgaacggtgacggaggattacgaacagggaggcaaaccaggggaaaaataacaatgtgtcctggctagttcatcgctatgtaacacataatagcaataacatggaaggaaatcaaaccccctgaggacacaagagtggctaaacaagccaggctctgtcaacacagaggaaaaggaagtgccacaaagtgacagattacacaggaacaagaaatggcagggctgtgagtgaagactgcaagtgaagaaaggacacaccacaagaaggacgcgctcattacaacagaaccctgggctgggcggcacggtggctcacgcctgtaatcccagcactttgagattccgaggtgggaggatcgcttgaagccaggagttcaagaccaacttgggcaacatggcaaggccctgtctctacaaatatatatatatataattagctgggcatgatggtgttacgtttgtacttccaactattcgggaggctgaggtgggaggatccaccactgcactctagcctaggcaacagagtgacaccctgtctcaaaaacaaataaattttacattccttggtcctcggacatggctaaagagatctagggcaatagagacactacatttttgtgtctgtcaatccgcctgatgacagaaatagaatagagtctgggtgcagagggtcatgcacgtaatcccagcactttgggagactgaggcagaggatcacctgaggttgggaggtcgagaccagcctggccaacatggtgaaatcccgtctttactaaaaacacaaaaattagctaggtgtggtggcgggcacctctaaccccagctactcaggaggctgaggcaggagaatcgcttgaacccgagaggtggaggttgcagtgagctgagatcgcgacactgcactccatcctgagcaacagagtgagactccatctcaaaaaaagaaaaaaagaaaaaagaaaagaaacagaatagaagtaaaacagtttagtactgaaatgaactgttgagaatcttagctgccccgtccctctctaacatcatatatactgtgaagtgctgttttcgtcttgttttgttttgtttgtcttttctttgtctttcttcccaactgggacaggggacaaaggacgctgttttgctccctgttccatctccagcacctagtccagaattcggcatactgcaggacagaaggcaaggggcagatgctcaaatatttgctgagtaaatgacaatgaaccttctcaatctgaagattccagatgtaggaagagccagacacccccaggctgaacccactcagaagctgggtgctcttggtaaagtcacatttctcttatactgttttctcatttggagaagggaggtggtaaaactttccgcatgaagttattgtgaagaggaaatgcagcaacatatgtgagttaccaagaacaatgcttcacacacgacaggtggtcggtcaatggaagctttcatcatggcagcttcactgcaaagcaccgtctataaatctaaagtactcttgctatttttgttgtctgtttttttttgtttgtttgttttgttttgtttttaatgagacaaagtcttgctctgttgcccaggctggagtacagtgtcgcgatctcggctcactgcaggctcaatttcctggtctcaagtgatcctcctacttcagcctcccgagtagctgggactacaggcatgcgccatcacacctggctaatttttaagttatttgtagagacgaggtctccctatgttgcccaggctggtcttgaactcctgacctcaagtgagccccttgcctcagtttcccaaagtgctgagattacaggcatgagccaccacatccaatcctaaagccttaacgcctttttctttctttcttttctttttctttttttttttttttttttttttgagacagagtctcgctctgtcacccggactggagtgcaatggcgcgatctcggctcactgcaacctccaccttccaggttcaagcgattctcctgcctcagcctcctgagtagctgggattacaagcgcgcaccaccatgcctggctaatttttgtattttttttttagtagagacagggtttcaccatgttggctaggctggtctcgaacttctgaccacatgattcacccacctcgacctctcgaagtgctgggattacaggcgtgagccactgcgcctggccaaagccttgttcttaagaccgacctacaagagaagtaactgggagccaagattgccaaccttgctggtggcaaggccactaacattcctgttgacagaataatcagtggaaccaaatacaaagtaataaaccacatattaagatttgtttgcctatcattgagaaatttttcttttttcacactttttggttttagatccactgactaataaaaatatagctgcagtgtcataagttggtcacagctggaatgtatagtccagatttctctcagcaaaataattttttttttttttgagatgaagtcttgctctgtcatccaggctggagtgcagtggtgcaatcttggctcactgccacctctgcctcccagattcaagtgattctcctgcctcagccttccgaatagctgggattaaaggtgcacaccaccacacccggctgatttttgtacttttagtagagatggggttttgaactcctgaccgcaggtgatctgcctgccttggcctcccaaagtgctgggattacaggcgtgagccactgcacccggcggaactagcatttgagttggtgtcaggagctgcctgtcaggcctggggtgtcccagtggtcagtgacagcatcaaggccactgcagatataaatacaacataagtaaagacaatgggtttattagggtaaagtggcttcaagaaaagcctcctatcccaggtggccatagaaactcttttttttttttcctttttgagacggagtctcgctctgttgcccaggctggagtacaatggtgctatctcacctcactgcaacctctgcctcccaggttcaagtgagtctcctgcttcagcctcctgagtagctgggattacaggtgtgcaccaccatgcctggctaatttttgcatttttactagagatgaggtttcaccacgttggccaagctggtctcgaaatcctgatctcaagtgatccacctgccttggcctcccaaagtgctgggattacaggcatgagccaccacacctggcataaatctgtagccactgtttattgtgctcgctttacagatgaggaaacatgctcagcaaggaaactctggtctagtgagagtttgtaaatggcaaagtgaagttgcaaagtagagatgtttccaagccacattctcatttcataatccaataaaattcagaataaattatcaaaagcaacctcaaaattttaacttcttgaaaaatagctattatttctaaatggcccctgaatcagaggaaaatcagaaccaacatggaaacttatctagagtcttaaaaagcagacactgttcataccaaagtgtgtgagacatagctaatgctgcctacagaggaaaatgtatagccttaaagacgtctattatttttaaaaattgaaaacaaagtggattaagtatttaacttaagaaaatagaaaatataagaagccaaaaggataggaataagaaattaaaggtaaactatgcaattaatgaaatagaaaaaacaaagtagaagtgataaataaagtgaaaaaggtgttctttaaaaagaaagcacctgaagacagataaatcctgacaaatctgattgattaaggcaaacagtaaaaagagcaagattagcaataagtaaggagacagaatcatgaaatcattattaagccattcaacaaatagataacacctacaacgcattggtttctggtttagaggctgcaggtaacagagttgaacaaggcagatgtgattcctacccccacggagtttattctgatggaaggagacaggaagtcaactagtaaagtcataagatagtttcagacagcgagaagtggtttaaaaggaaggtaacgtgcgaggaatgtggaaccactttagatcggataaccagggaatatccctctgaggaggtgacgtgtcagatgaaacttgaaggacgtagagtcagccatgggaagatctgagggaagagaacgtcaggcagcgggaacaacaagagcaaaggccctgcggtggaacacagctgctgtctcaagaaaaagagaacattgaacgtcatgatggattgttataaaagagagagagagagaaagggctgaagcacagtgaagggagaggtcataggcagaggcagggatcactcaggattttattctgagtgtgttttgttctgggaggccatttgagggtttcaagcagtgaagtgaagtgatctgatttctgtgctgggagacctcctgtggctttgggttcctggtgcagattggactctgttggtgaagggccaagcatgaatgctgagctctggggaggatcttaaggctgcatccagatgagaggtgatgggttggctccaggcggtggaagtgaagaggagtggacttcagtggagactgtagtctgccacctggattctccttcaggacagaggctccaggattcgccttcagccaaggagaatcgccttgcctaagactgcctcctccataggggcaggccacctccaacgtcgggttgacatgggggtctaaggaccccatttcatggtcctgatgtaggcaactcagaagggctgttccagcctctgagctctggtgaggcctctggtgtgcctgcattccagccccacatcactgccccccacaccactctacccccttcacaggtgctgtgcgtgagagcactccccagtaaaccacctgcgtgcccagctctctgagtctgtttcccagggaacccaatcaaagacgctgatcgatcagaagagcggtacaagtagaacacaccactcagtggcaagtcctttctccacagatgatgactcagggaaggtcccagagcctctggcaggtcacagaacctctggcagagctgaggtgaccccaagctctcctcttcacagctctgctcctcttccacctgcaaaccaagagtcacaatggaagggcccaaggtctgcaaaaaccaaaagtgtgtcagcaggacgggacactgaagaagtgccactcttagttgtgggagtctttgtggctttggttgcaattacgtgggagtgtgctttttagtctgacactgtgctgctcttataattggaggatcaggtcattggcattcaaatcagtccctcccgagagacactgccagtctagtttctggtaagtttcaattttcctgttgctgcagagccccagctttacatacttttgaaaccttggccaggagcagtgacctgaaacagtgaaactgctctcctattctaaatttgaactgttcagccctctgggtctgaagcttcctgcttttcgcttgctggctttttggggcagagtggggctgctttcacttgctcactcgctcactcagtcatgtatttattcatcagacatctctgatgttgctgaccaagggctcaatgtctagacagagagatgaagatgaccctgccctcaaatggctcatgcccagatcaaggagagagatggttaactgatccacttcctaatgcttcagtatgaatgacttatcttctcacttatcactcactgcacccccactttggaatcagttcagaacgctttgaatgtcccagaggagagtttgctgtctattccataggcagtgggcagccaagttaggttctggagaaggagagtggcatgattaaaggtgtactttaggtttgtttatctggttgcatatccatccatccatcccccatccatccatctatcccatccatcccatcctctcatccatccatccatcctatctatccattacccactcatccgtccatccatccatccatccatcccatccatccatccatccagccatctatcctatccactcatccatccatccatccagccatctatcctatccactcatccatccatccatccatccattccatccatccatttatccatccacccatcccatctatccattacccagccatccgtccttccatccatccatccgatcgatgcatccatccatccattcatgcacccatccatcccatcggctcatccatccatccattcattcatcccatccatctatccatccatccatgtcatccactcatccatccattcatctcatccattcatccatcccaaccatccatcccccacccacacatccattcatccatccatccatctcatccatcccactcattcatccatccatcccatccatctcattcatccatccatccatccatcgatccaactatccattcatccatccatccattcaccctatccatccatcccccacccacccattcatccatccacctattcatccatctattcatccatcctatccatcccattcattcatccctcctatccatctcattcattcatccctccatttcatccatccattcatcccatccatccatcccatctatccatccatctcatccatccatccctcatcatccatctatccatccatctcatccacccatccatcatccatctatccaactacccattccagctattcattacccatccacccatccattcatccatcggttcatctcaaccatccatttatcacatccatccattcatcccatccatctatcatccatccatcccatccatcccatccattcattcatccatctcatccatccatccatccatccaatatttattgagcattttctatgtgccaggcactgtgctgtgtgtacctggtttccatctaatgcactgaacaagaaagatattaaatccctgccttcatgggaccaacattctggggaagagaggtggatagacaataaacaagtcaacaagtaagtgagctcccgacattgctgagttatgaagggaataaacaggatgatagggttgagagtgaccagggtgaagggtgaggtccttcaattagatgatcagggaagtgatctctggaaaggtgatggttgagctgggctttaaaagaagagaaagaggcagttataggaagagcagaaggaagagagttacagacagaagaaacagcaagtgcaaaggcccctaggcaggaaagaacttggcttgctggagaacatgaaaggaagccaatgtggctgaataggaagggaggagggaaggctggagaagaagatggggccttgtaggccaatgtgaggacttgggagtctttggaaaggcagccagaggccactggaaggtttccagcaggcaagtgacatgttttgatttatgtttctgaaagttcccccggcagcatgggaagcaaatgtagcagcaaaaaaaaaaaaaaaaaaaaaaaaaccccaaaaagaaacagcaaggaggtcaagggtgaggacggtagcagcctggaccagggtggtggccatggggttacagagaaatggaaaactcaggacaaattttggaggtggtgggagggaaacagaggacttgagaatgatacgtcactttgatgcttgagctacagggtggtgtcactgaggaacaaagactggagagtgcggagataaggaaggaggaatgaaataagtctttgtggggaaccaggctgtgtttttaggatatttcaagtaggtaactcgacattcaagtccagagccctggagagagatcaaggatgctgttgggagtctgagatgtatcagaacacatgtttgtttaaagccactgagttggagctgccagggaggaggaggagaggcagggcccatggagcatctagtgtcaggaatagaggctgtttcaagaaggatgtttcgagaaggagagggaggtcaatagtgtcaaacgttgctgagaagtggctctgagcacaggatcccacactgggacttggcagcaaggatcacaacaccaagagccatttggtgacacaggggatgaaggcctgctcaagggcaccgaggagagggtggcggtgaggagagggtggccgtgtagagagggtggtggtgtggagagggtggggtgtggagagggtgatggtgtggagagggtggggtgtggagagggtggggtgtggagagggtggggtgtggagagggtggggtgtggagagggtgatggtgtggagagggtggggtgtggagagggtgatggtgtggagagggtggggtgtggagagggtgatggtgtggagagggcggggtgtggagagggtgatggtgtggagagggtgatggtgtggagagggtggggtgtggagagggtgatggtgtggagagggtgatggtgtggagagggtggggtgtggagagggtggggtgaggagagggggtgaggtgaggagggtgcagggtgaggagggtggcggggtgtgaaagtgggtgggggagtatgcacagcttccaccagaagttcagccttaggtgggacggaggaccagggtgcttgttggaagatgatgagggtcaagagagtacactgtgcgtttttttgttcttgtttttgttttgttttgtttgagatggagtctcactctcttgcccaggctggagcgcaatgacgaaatctgggctcactgcaacctctgcctcccaggttcaagtgattctcctgcctcagcctcccaagtagctgggactataggcaggcaccaccacacccaggtaatttttgtatttttagtagagacagggtttcgctgtgttggccaggctggtcttgaactcctgacctcaggtgatctgcccacctcggcctccccaagtgctggggttacaggcatgagccactgcgcccggccacgttgtatgtttttttttttaacacaggagatcccgggaggaaaagaaactgaggctgcacaagacaggcaactgggttccagtagtaccaattgtgtgctcactctctgtgtgaccttgggcacgttatagggacattctgggcctcaggttttacatccctagaatgggctcctcgggccccaggtgacttacatgttgaggtgagctcgtcctgggtgggagaggtccccaggacagggcaagctccagcacagagccagcttctgtttgcgattgtcccaggctgtccccaaggaggccatcaggccccaccagtctcacgttactgcactgacaatcctgccttgctctgaggttcacaatcagacctggctggtcccttgaggctcagtcctgaatgctgcactttgctgggggggttggggggggattagagctttagagtctgaggggcttccaggtccaggcagaggctctggaatgacaaggacttggatttcaccctggctctgccacttcctggcttggggaccttgagcaaggactttacctctttaggtcttagtttcctcatctgcaaaacaggaatcaccatgcatcatgatcatcacccgctattgagaagattaagtaagagaatagctgtagaatgcctagcacatattaagtgctcaataaatgctagctggcttgccctatctatctgtcttgcttatagaaaccgagttctgcttaggaggctctctcttcttgtgtcctgttacctgggtggagcctgggcccctggggctctgatgggcagccttgtcctccgccacacccacaagagtctagtcctgtggggcccacagccttccccactgtctgcacttacctgtcccgcctttctgccctccggtctaaactcggtatcagcaattggccaggattctacccagcacaaagggaggggcactgcggcctggggcttgcacgagacagcaggtgcaccgcaggccagggagggcaggggacttgccagaggccacacagcacagggaggagggcagatttgggggtagtttgtcactctggcttctgcaggacatccagctcatgtggcagtggctgtgcttggcagctgctgggcagggcactaaggacggaccctggggcggctcctggctgccggaggttagctctgggccaggcctggtgactcagcagacctactgatcagggcctggtcgtgttccccacagtcccacggtgtaggtccttcatgcctgccaacacccagtgtcacctagaggtcgtagggcagagcttagcagatggggagcagtgctggctccagctggcattgttctatcccctccagccctgcagatcccacagcccaatgggctgaggctgaatcctggcactgtctctacgtagctgtgtgaccttaggtaaatcattcaatctctgagcatcagtttcctcatccgtgaaatggggataataatgcctatgctctttgataggaggatttaaaatgcaactgtctgggcatggtgtctcatgcctgtaatccaagcactttgggaggccaaggcgggaggatcgcttgagtccaggagtttgagaccagccctggcaacatggcgagaccctgtctccacaaaaaatgaaaaaaatagccaggcatggtggtgcgtgcctgtagtcccagctactctggaggctgaggtaggaggatcgcttgagcctgtgaggtcgaggctgcagtgagctgagattgcaccactgctctccagcctgggtgacagagcaacacctcgtctgaaaaacaacgacgacaacaacaacaataacaacaacaacaacaaaccaatcaaacaaacccccccccccccacacacacacacacacacacaaccaccaaaccctctggaggctcccactgcacttggaagaaagcgctattccctactcgcaaggccttgagaggtccagccggctcacctccgcggggcctcccctccccgttctccctttgttttctctactccagcctctctggcctcctcactgctcctctgtctccctgagcttgttcccactccggacatttacctttgctggtccctctgtatctaagtccctggaggtacccagtgctatgtgggtgaagggcaaaataaggccagcttttagtagccagtttctcattcacccattaatgcatttcttcatttaaaatcatttccctgagcacctactatgttgcaggccccgaggtaggtgctggggatgaagctgtggagtatcctagttatatcaactctcagggtaagaggggctgacccttgactaccaaaccttcagtggctccctattgtcccaggccaaagttcatacttccgatctcagaatgcttgcttttcctatgtgggtccaggtggctgtgttagtagctctcagagtccctgaggccattgccactgctgccgaattttttgtttgtttgtttgtttgtttgtttgttttgagatggaatctcgctcagtcacccaggctggagtacagtggcgcaatctcggctcactgcaagctctgcctcccaggttcacaccattctcctgcctcagcctcccgagtagctgggactacaggcgcccgccaccacgcctggctaatttttattgtatctttagtagacacggggtttcaccgtgttagccaggatggtctcgatcttctgatctcgtgatctgcccgtctcggcctcccaaagtgctgggattacaggcgtgagccaccgtgcccggccgctgctgaattgttttacattctcagggtttctgctcctgccgcccccgaccctggcacctggctgcgctcacacaaacatacaggggttgcctcctattcctcctggctcttcctggccttgctcacatccaccttccccccagagcctgggtgagtgttgatgctttctcagtccaacatcatttatttattttgagacagggtctggctctgtcacccaggctggagtgcagtggtgcaatctcggctcactgtagcctcaacctcacaggctcaagcgatcctcctacctcagcctccttagtagctgggactataggcacacaccaccatgcctggcctgcgtcatcgtttaaggccctcagcctatctgtcattctttgtagaaatattctctcatcaggacctcacatcaaccccatagcctagttaggttgatcttatccctgtttcacagatgaggaaaccaaggcacagagaggtcaagtaacttgcccaaggacacacagctagtacaggggacttgagcccagcaagctgatcccaggtctgcgttcttcacattcctgctctgctatcttcactattcagctgggcttttccagaaatgcttcctgctatcaggctgggaacatgccctcatgcgtccccactgcccgcggagggaggcccagctcctgttcgtttatagccactctttacctgctggctctgcagacctccttcagtcgggaggcctgcgctttccttggcctgctcttctgaggctgccctccaaagccctggaacattctataatcccagtgctgggcgcttcacagtcattgccctgtgtagggctctcattatccccatcttacagatggaggaacagaggcttggaaaaaggagatcatatctgccccacactggaaagcaggagacctgtggaacccaggtctgtctgaccaaacaccccagccatgctcacctgacggtcctcatgcttagtgtcgtgatagccgaccatgaaagttgactactatgaccgaccaccactactgaccgccacagatggccactccagccagccactatagctgactgctggaactgaccacctgctcttaaacacctgctgaatcaggcctggttcccactactctacccaggcagtctcacaccattgctggaaggttgcttctatttttcaccccattgtatttatttatttatttatttagactgagtgttgctctgttgcccaggctggagtgcagttgcgtgatcttcgctcactgcagcctcaaccttgctagctcaagtgattgtcccacctcagcctcccgagtagctgggactacaggcgtgtgccaccatgcccagctaatttttgtattttttgtagagacgaggtttcaccatgttgctcagctggtctcaaactcctggactcaagcgatctacccactttggcctcccaaaatgctgggattacaggtgtgagccactgcacccagctttcaccctgtgttagagatgagggaacttagggtctgagagggagcatgacatgaccaaggtcactctgctagcagggggcagggctagacttagaaccagggctgggggactgcaaaagcctcacacagctgccctgcatgtcccagtgaccaggccacctgcatttttgccccaccccagggaaacttgagtctcctgagaaggtctggcttttctattgtccccacccaaagctccttgggagttgacaagagggagcagccttgggcttccggcttgggtgccctggacttttcccatgcagctgtcaatgggcctttgtgtgtccaggctgcctggcccttgtccacaccacatggcttcctgatgacttggggcgctcggccagcagctgtgtgtggcctggggacccatcacccactgggcaggacgctctaaatgccttaaggcagggacttgagcagcccctaggccttcgccctgacttttccctctgccaggaaagacctttcttcaaattctgccatgatcggcagcttctatccttcaaggcacaactcaaatgccaccacttcaaagaggtgaccatctggctcactggaagttgcactctaagagggcaggggtttgtctgctgggtaggggagacagacaataaagaaggctaggcagagtggcataatcccagcacgttgggaggcagaggcaggaggatcacttgaacccagaagtttgagactagcctgggcaacatagtgagaccctgtctctactaaaaaaaaaaaaaaaaaaaaaaaatagccgggtgtggtggtgcacacctgtggtcccagctacttggaggctgaggtggaaggatcacttgaacccaggaggttgaggctgcagtgagcctagattgtgccactgcactccagcttgggtgacagagcaagaccttgtctcaaagcaaaaccaaaaacaacaacaacaaaaacccaaaaatgtaataagttaacatttcaacaagatcctttcgggtcattgaatggagcgtgtctaggacagggtctttctgaggtggtgacatctgaacagaaacctggatgaaaaggagaaacccccgtgagcccctgcggagcccagacgcaggcacacagtaggcgctcagtaaatgaatgtggctgcgcaggccatggctctgactgccgtgggggcgactttcccctccagggggcgcctggcaatgtctggggacagttttggctgtcacacggcgcgcggggggaaggaggaatgcaacagactccgagtagtcggaggccaagggtgcggctaagcgtcctgccccgcacaggtagcccgcgggatgacccggtccccgcgcgtcctgggtgcggctcgggcgctccctggcggctgcacggggcattgcagcagtccccgaagagcctggcgatgggaaaggtccgtccctgcagcgcccgcgtggtgacaccagcagcagcgtgataaccgcaccgcgagcgtgtacctgtcaacacgagggtaaacccaaactccacgtccacactgccaggcaactcagggtgaatgcatccgcaacccactcctcatctcccgcagaaacctgctctgcccacagccttcttagccttaagggcagccagctccaccctccccagaggctcagggagtcattcatccccgactcctctctgtctgccaccgacatgtcccatccaccagctaatcctgtctgttccaccttcaggatacatccagactctgtctccccactccactgccccgccaagcccagccgccatcctgtgtgcggtcacctcctccccgagctcgcagcctccaccctgggtcctaacactctggcctcctggtggagtgattctgcaagggcctaagtcaggccaggctcctcccctgctcagaaccctccatgactcccagctcactcacaatgagagccaaggtccctcaatggccctcaaggcctaatttaaaattgaaacacactccagccccaccctctcagtcttctgtgctgctttttttttttttttttttttttttttaagacagggtctcgctctgtcacccaggctggagtgcagtggtgcgatctcggctcactgcaacctccacctcccaggttcaagcgattctcgtgcctcaacctcccgagtacctgagaggcacgccaccacgcccagctaatttttgtatttttagtaaaggcagggtttcaccatgctggccaggctggtctcaaactcctgacctcaagtgattcaccagcctcggcctcccaaagtgctgggattacaggcgtgagccaccgcgcccagcctttttgagaaagggtctcgctgtgtcacctggactggagttcagtgacacaatcacggctcactgcagcctcgatctcgactaggctcaggcaatcctcccacctcagtctcccaagtaggtgggactacaggcatgagccaccatgcccagctaattttttgtgtttttagtagagacagggtctgtactatgctatgttgcccaggctggttccaaactcctgggatcaggtgatcctcccgcctcagcctcccaaagtgctgggattacaggtgtgagccaccgtgcacagcttttactctatttttatatacagcaagaatcaccaagtgccatatattttacttatttgtcttgcttattgcccatcctctctttgtgaacagctgctgggggcagggatgggctgtgtctttctggtcactggcatctctccagcactcagcactgtgtctggcactcagtaggtgctcaacgaatatttgttgaatgaatggatgggtgggtggatggacggatggggatggatggatagatggatggatggttggatagatggatgggtaggtggatggatgggtggatggatggatctgccaatagcagcatagcggtttaagagcacaaatcccagcctcacattagaactttgggggttctggttccacctccaccacctacaagctgtgcaagcttggatgggctagatgacctctctggccctcagcttcccaacaggaataaaaagaacacccaccttgtgttctgacagcattaaaccccttaatccatgtaaatccacagctgagcctgggctcaggcacacagtaggtgcttagtaaacatatgcagatggacaggtgccagggcagtggttctgactgctctggggtaagcagtaggtgctgcatagggacaagtgtcttactttagtcactgttcccagcctacctcctcccctctccactcgctaaacccctgaagggtagggatcatgtctcagtcatctttctttgcacatagtaggtgctcattaagtgctggcattgagaggaggacattgatgttggaggagtgcctcctgtttgccctgcaaactgagaggcagattctcctaccccaccttacaggtgaagaaaccgaggctcagggacccctgagagcagagggaagggacgtcattctgcagagtgaccagcagggggcgagcgggactgctctgtggctccgaggacccagcggcaggtgcactgctctgagagtgaacgctgccttacattttgcacggtaggcacctcgcttttctcaccttagtaccagccctggtcggaagggccctgtcacaccaggacacgcctttcttctgccttgcatcgagcgcttatgctctcccaggcgctgtgctaagggcttcccacatatattagctcatgtggtcttcatgacagcagatgtgcggcaggtcctgttactgccccctttctgcaaaggtgatagctgagtccaggagaggtcactagccagaggtaatgccgttccaccattgcatgttgcatgtacgaaggcagatctcatgccttcggatcacatgccatgattgtgtaaaaacatgtgtgtggactcgtttgcagaggggtgcatgtacctgcatgaaagaagggaagcagacatttgtgaccaagaaggtggacagtggcagagcacaagagtttgtctaagttattacatccatgacctttccatgtcagagaagcggggagctgggggagcccagaaaggcagagcttggctcagcctcaggggatgctcctggggcagagggggaagcccacctgatttttcagggaggaatcatggttaccagatggaagcaagaggacatttcgggctggaggaacaaagtgtacaaaggcccaggggctgttcagggaaccccaatggctgagtctggctaaattggagtgaaagggaggagggaggcaggatgaggcagacatatggcggagcttgattcactgagacttagaggtgaaggcagaccatggggtcagatgcagggcacgtaggacactgtgaagtcccagaaaacggtcttctacctcctgcgggaacttcaaagggctatcaatgttcccctcttccagatgggcaagctgaggctcggagaggtgggacaacttgcccaggtgtcctgtacatggcaggttgggatttgaacctactctgggaacttctgcactttgctgctttttgagaaaacaccatgaactcagaacaattccatgaattctgaccaaatgaatgaatgtatgggtgggtgggtggatggatggatgggtgggtggatggatggatggatggatggatggacggacagatggatgggtggatagatggatctgccaatagcagcacagtggtttaagagcacaaatcccagtctcacattagaactttgtgggttctagttccacctccaccacctacaagctgtgcaaccttggatgggctagatgacctctctgggcctcagcttcccaacaggaataaaaatagcacccaccttgtgttctgacagaattaaatgcaacccatgtgcctggtactgggctgagtgtcttctcagcattgttttattgaattctcagagatcatcataggaaggaggtgttattattttcctttcttttacaggtaaagcaccatgactcagagaaggcaagtgacttgcctaaaatcacagggcccacagagtcacagccagaatgcaagcctgggccctcagatctggagtatgccctcttcaccatggctccaggcaccaaaactccaggtagctttggattttgtgctatctgtgttttattttccttaatatatattttaaacggactttctgcccacatttttctttaaacctgtttctgcagaggaaactttatatcattagcaaacatggaaaacctatatcatttatcatgaaaacagttatgaaaataaggctgggtgccaggcacgatggctcacacctgtaatcccagcactttgggaggctgaggtgggcagataacaaggtcagtagttcgagaccagcctggccaacatagtgaaaccccaactctactaaaaatataaaaattagccagctatggtggcgcatgcctgtagtcccagctacttgggaggctgaggcagaagaatcgcttgaacccagaaggcggaggttgtggtgagccgagatcatgccactgcactccagcctgggcaacagagtgagattccgtctaaaaaaaaaaaaaaggaaataagaaaataaggctggacatggcggctcacgcctgtaatctcagcgctttgggaggtcaaggcaggcagatcacctgaggtcagaagttcaagactgcctggccaatatggtgaaaccttgtccctactaaaaatacaaaaattagccaggcatggtggtgcacacctgtaatctcagctactaaggaggctgaggcaggagaatcacttgaacccaggaggcggaggttgcaggttgagctgagatggtgccactgcactcaagccagggtgacagagtgagactctgtctcaaaaaaaaaattatgaaaataagtacaagaagtgctaaaaaatatcatgatattcttgccagatgctcttgcttgcacagtcaggagtcaggggcctgtgagaactttgttagaaagaagagagttcggcggctcaagcctgtaatcccagcactttgggaggccgaggtgggcggatcacgaggtcaggagatcaagaccatcctggccaacatggtgaaaccccgtctctactaaaaatacaaaaattagctgggtgtggtggcgggcacctgtaatcccagctactcaggaggctgaggcaggagaatcgcttgaaccagggagtcagaggttacagtgagctgagatggcaccattgcactccagcctggccacagagcgagactccgtctcaaaaaaaaaaaaaaaaaaaggaaagaaagaagagaattagcgaggtgatggggagatgttagcggcagggatttttttttttttcttgaaatgctcagagcagctgcaagagaatccccataggaagaacttctgctctgtgatttcatgccctgtgggacctagaataacccacagacctcgagtgtggcagcagctgggcaggccactcaaccccaggtcggatccttctcagctcgcctggggctgtcccaggccctgcaacaaagtccttgtccgaatgtactgggtgggtgggggtatcctggcagcagagccctgactatgccctctcaccctctgctcctcgctgacagagttccctcaaggcagggtatacagctggcactcagccaggcctccagagcctgggctgcaaagattcagtgtttggtggctggttttatatatttatttgagacggagttttgctctgttgcccaggctggagtgcagtggcacgatcttggctcgccacaacctccgcctgccgggttcaagcgattctcctgcctcagtgcccggcccctattttttttttttaatagaaaaatgttccttgcaccaccaactctttcctgggcagggttgggaaaccatttccagatgggaaataattttagggaagagaaacagctaaaattacaggccattctgctgccagctctcgctgggatgagccagccatggccctagaactttcccaaagtggggtgggtgggtctgggtggggagagaagccaggatggactgttgagatgggatgtccctcgggctgtccatgttcaggcctcgtgagcatctccgaacagccttggcggctgcttctgggggctgctcgctgatatcaaacactcacccatcccccttcaattctcatcacgacccgtgagggcagaagcttggaaacatccctggtgtagcctcaggatccagctgccgttttacagaaaatcccaaggacagaacgtgttgaaccatgacacggtgctgtcatcagcctaacccagacccagggatctctgcaggttaaacggcccaggtactgcgcaggtaaattgtaaggaaaagaaagggatggaggaggaatagaaactaaaagagacatcaagtttttaaaaagtgggcaagataaagtatagtgtctggggctgctcacatggttggtaaaacaagaaagaaacacaagtgatatccataacacttagggtagcagtgacttttgggaggggcagggctttgagaggacagggttctgcaggggtttccaggggtggcaggcaaagttacatttcttgacctagaggtggtcacaaggctgttcagttgccttataataaattattaagtcacgtgcttatgctgtgtggtttttgtatctgtatctgttctatttttcaaaaaaaaaaaatcccaagtttaaaaaacaacaataacaacaaaatatcccccatgcagatgaagaacgtggggcttggaggattgaagtgattcttccatgcggagtgagtggggagctggaatctgaaccagcttataagccacagcctgtttattcattcaacaaatatttgccaagccccagggctgtgccagggactgggctagcagcgagtgagagagacatcctgtcctcatggagcccagaggctcagtagtcagccaggttagagaaccgtgacaccctcctgccagggtgcctgccaggtatcttggaggaactgcatcttggggatagatggctgagctcacaggatttaagtgaaatctccaggggctaaaagcagatatgagttggaaattgcagcctgacccgatgcctgaggtagggtttgcctaccatgggtgggatcaaagggacttttaaaaagacttctaattttgatggccaggtgcagtggctcacgtctgtaataccagcactttgggaggccgaggcgggtggaccacttgaggtcaggagttcaagaccagcctggccaacatggtgaaaccccatctctaccaaaaatacaaaaattagctgggcatggtggcgggtgcctataatcccagctactcgggaggctgaggcaggagaatcgcttgaacccgggaggcggaggttgcagtaagccgagatcacgccactgcactccagcctgggcgacagagtgagactctgtccccaccccccaaaaaagaaaagagaatccaacttgtacatctgaacttgagctcagacatgtaaattatccccttgttagccacaggttcgacctcactttcttcttttttttttttagacagggtctcgctctgttacccaggctgtagtgcagtggtgcaatcacagctcactgcagctttgatcccccaggctcgagtgatcttcccacctcagcttcccaagtggctgggaccacaggtgggtgccaccacacctggctaagttttaaatattttttgtagagttgaggtttcgctgtgttgcccaggctggtctcgaactctggggctgaagtgatccttccaccttggcctcccaaaaggttggaattatagaagtgagccattgcatccagccgtcacttgctttaaattaaaatttttaatcaaacaaggaaaagtgaacccaggttggcaggctgagcccatccctagctccagggatgagcacttggccaaggcctgaccgattagagttcagcatctggtggccacagcaatcggtaacagacgggaagtgacccaagccaggcatatgggcatcttcccaggaactcttctaggtgtgcagggaaagaggctatatttgtttgctagaactgccatagcaaaagaccacagaccgggtggcttaagcaacacagttattatctcacagtgctggaggctggaagtccaagctcgagatgccggctgtcagggttgatttccgtcaaggcctctctctttggcctgcagatggcgaccctcttgctgcctctgcacacggtcatccctctgtgcatgtgcgctcctgaggtctgttcttcttataaggacaccgggcagactggattagggcccaccctaacaaccatttaaacgtaaccacctctttaaagaccccatctctaaatgcagtcatattttcaggtcttgggggttgggacttcaacatatgaattttgagggaccacaatttagcccataacagaggccttctctttccactgaagttgctattcaggatgaaagcaggccttgaaatatttccatgacaacaggatgcccagaggtgggctggcacagggtgctccctggatgaccccttgcaggaaggaggctgcctacctggggctgggacataacttcactaccttcctagggccatgaggaagggcgcctctccccagagtggcaaaaacaagaacatgcagttctggcatggatgtggggaaatgggcagtctctttcccttttggcagcccctagcaataatagaaccatacatcatcttttgatacagcaatttcgcctgtaggaatctctttccccaaacctactagtgcatgcttacaaacacacgcacctgtggggttgctcagcacggtggttttgtaatagaggaggattgcaaagagcattaagggccatcagcagggcccttgtttattccatctggagaattcattacttggggtcaaagcagcttcgctgcttcccagctgtgcaggcttgggaatgtgtctgggccttgtggagaaatgaggtaatgagagcacccacctctaacgtccttgtgaccagttgatgagctactgcatgcgggactcttgggatgcagcaatagtttcctgtgtgtgcacaatgtgcttttactttttaattttgattacgatttttctttagatgaatattctgcatatgtatacaatgtgcttttttttttttttttgagatggaggtttgctctcatcacccaggctggagtgcaatgctgcaatctcagcccactgcaacctccgcctcccgggttcaagtgattctactgcctcagcctccagagtagctagaattacaggcgcccgccaccacgcccagctaatttttgtatttttagtagagacagagtttcgccatgttggccaggctggtctcgatctcctgacctcaggtgatccacctgcctcggcctcccaaagtgctgggattataggcgtgaaccaccatgcctggcctacaatgtgcttttagctgagaggaatggcatcatgcaaagaccttcctactcaacgtatggttccagatcagcagcacaaggagcacctgggagcttgttagaaatgcagcatctgggctggtcggggtggctcgcacctgtaatcttagcactttgggaggccgaggtgggtggatcacttgggttcaggagttcaagacgagcctgggtgacacagtaagaccaggtctctacaaaaaatacaaaaattaactgggtataatggcatgcacctgaagtcccagttacttgggaggctgaggcaggaggattacttgaggccaggagtggaggttgcagtgagctgtgatcatgccactgtactccagcctgggcaacagagcaagactctatcttaaaaaaaatgcagtgaatgcagcatctgagtccccaccccaaacctaggagccagaatctgcattttatcatagtccccagggccccagtgtgaacatgggcacgttcgagtttgagtaacattgccactgaccttgttctgaaacaattggaaattggtgctcccttttccctggggttgctgagctggtgagaataaagctgggagtggcaaggggcaaccttggtcacatcatgacctggagagtctgtgtggagtaaaagagatgagagccagaggtagtgcatctttgtagacattgatttagcatctggatccaaccatgcctgaagcctatctctactcctgcttttaccagagacagttgacgtaaattctcatgacatcagccaatttgagtcagggttctgctatatttttcatctgatagagccctgcctaagatacccactgtatgggctatggaacttccttgccttcttttcttttcttctctcttttcttttctcttcttttcctttttttgagacagagtttcactcttgttgcccgggctggagtgtaatggcgtgatcttggctcattgcaacctccccctccggggttcaagcgattctcctgcctcagcctcccgagtagctgggattacaggtgtgccccatgatgcctggctaattttgtatttttagtagagacggggtttcaccatgttggacaggctggctggtctcaaactcctgacttcaggtgatccaaccacctcggcctcccaaaggccgagggatcacccagaagacaggaagacccaggccacagagagaatactgcagatatcatgagccacagagccctgagccactgacctgtctcccaggtcttggcttgggcctcttccagaagcagacacttagagagtccaagggcagggaacttagcggggagctgatcgcaggaagctctgagagcagaggggagggggcagctggtactgctgggtgtctagatgagcaggttatcagttgggcagctggggctccgtcctgctggggcctctgggagtgggtgcagagtccacctcagggttgctcctccccaggccccaggaagctggaggatttaccaacacccccatccagcaagcataggccagagaaccactgcaggaaaacagaaacctctcccctggacgtggtgccatcagcccagagctgccagatccccaggcctccatcctcatctggattgaagcagccatccgcctggaaagggcctgtctgcctggaaagaaacttcaaatgcggctttggggggattccagagactgtctgttcccatctgtgcaagagggacactgagtgttcaaaacctaaggaggcctcgctgtgaatcaggccagagcaggggctcacctgggaggggggtctcctgacattgtgccggcacctgctggcctcacctaatgcctggccctgcctgagagcagaccaagggaagatgagactagaactttaggaagatcgctctggccgctggatagagaagggactgttgtggggaatgggggacgagggtagagtcagggaggcccaggaggggttgttgccactgtccatccatgcagtgaggcccagaggggtagtgggagtgagggaggctgggtttgcaactctggggtgaagggacctccattttgttcagtgatacgccctgcccttctctatcccatacaagctgtgtgaccgtgggcaaattacttcacctctctgggccttagttttctcatctgtgaaatgggggcatgcttctctatacccacctatatctagagggtgattgtgggattatgagttaacacgtatatagcacttggcctgtagtaagtgctacagagtgttggcctctgttcttatgatagttattgttactgttagtattagtattcttattatcgtcatctccctccaaatttcacaccagtgaatccagactccaggcagccatgtaaatctggggtttaactcttgaaactgagtatgtcatccacttatcttgctatgacctcaagagtcccagccccagatatctgagaccctcgtaccccctcccagtgctccaggacctgcctcactgaattcctgaccctgatcgcagtctaccctgtcgggctggggcacttgggccgtgtcacctcagtgtgggcctagacaagggagctcatggcatgtcctccctcctgtttctccctgcctgtgcgtctgaccctgtcagttgaacctgtgacatttgctcctacaactggccacttctctgtctctatggccaccactctgtccaggccacctctgcaactataacagcctccttgataatcgttgactcaaaagggaggttttgtgttcaatttcctttatttatctatctatctatttgtttatttatttattatttttagagatggggtttcgccatgtcacccgggctggtcttgaactcctagactcaagcgatccacctgccttggcctcccaaagtgctgggattccaagcatgagccactgtgcctggcccttgtgtttaatttcaaatcacacagcctgttgcacaagttcgaataatatagaagcatatctaggccgggtgcggtggcttacacctgtaatcccagcactttgggaggccaaggcgggtggatcacgaggtcaggagttcaagacctgcctggccaagatggtgaaaccctgtctctactaaaaatacaaaaattagctgggcattgtggtgggcgcctgtaatcccagctactcgggaggctgaggcagagaattgcttgaacccaggaggcagaggttgcagtgagccaagattgtttcactgcactccagcctgggtgacagagtgagactctgtctcaaaaaaaaaaaaaaaaaaaaaaaaagaagcatatctaaacttaagaccttttgttaactctggaaagatgttaatagtagtgatttcaggggagtggttagggacaactggtttcatatcatttgcatttcattgcttagattttgtgacaagtgagcattgcttttatattttaaaaattatgtttaaaacataggtaagacatttaaatgggaaaaaattcaatgacagaaaaaagtatccaatgaaaacgagtgtctctccccacccttaacccccaggtttcactttccctaagcaatgctgcttccagtttcccacgggctctgccactgaaagtctgtacgtacgaaaacacacatgattgtatgcactctttatttacatatatagatgcatgttacacccagtgtcttgcagcttgctttttttaacctaacatacctatcattctttctaattcatcacacatacctgtgttgtcctttttcacagctgcatagtattccactgcatggccggaccatattcattaatagttattttcttactgatggccctttaggttgtttccagccttttctgttataaagcaatactgtggaccaggcacagaagctcacgcctataatcccagcactttgggaggctgaggctggaggattgcttgagcccaggagcttgagaccagccacagcaacatagagagacttcatgtttacaaatgaaataacaagctggttgtggtggtgcgtgcctgtggttccagctactcaggaggctaaggtgggagggtcactgagcccaggaggttaaggctgctgtgagctgtgattgcgccactgcactccagcctgacagagcaaggccctgtctcaaaacaacaacaactacaaacaatactgtggtgactgtctttgtacatagtgtggtgtgtgtgtgtgtgtgtgtgtgtgtgtgtgtgtgtgtgtgtgtgaatgtatctgtgggagaaatctctggaagtcagattttataacagatttgtgcattttacattttgatccatatgaccaaactgcactttgtagaggttgtaccaatttattctcccaccaacaatgtgtgagggtgcctgtttccccacaacttcatcagcaccatgtattgtgaactttctgatgtttttgtcactctaatagatggaagcaggtgtctcagtatggtttcagtttctatttttaaatgaagagtgaagcagagtaccttttgcttgttcagtgaagcatagtgtcattggccaggcgcagtggctcacgcctgtaatcccagcactttgggaggccgaggtggcggatcacctgaggtcgggagtttgagaccagcctggccaacatggcaaaaccctgtctctactaaaaatacaaaaaattagccaggcgtggtggtgggcacctgttctcccagctactcgggagtctgaggcaggagaatctcttgaacgtgggaggtagaggctgcagtgagccgagattgtgccactgcactccagcctgggtgacagagtgagactctatctcaaaaacaaacaaaaaaacagcaacaaaaaaccgtagcatcattgtcacatgtcaggaagctccattgtaaaatataaaaataatttaaaacaaaataaacatataataataatttaggccaggcgcagtggctcacgcctgtaatcccagcactttgggaggttgaggcgggtggatcgcctgaggtcgggagttcaagaccagcctggccaacatggtgaaactccatctctactaaaaatacaaaaatcagccaggcgtggtggcgcgagcctgtaatcccagctactggggaggctgaggcaggagaatcgcttgaacccgggaggttgaggttgcagtgagctgagatcaggccattgcactccagcctgggcaacaagagcgagactccgtctcaaataataataataatttaaaacaaaataaattattttgttttgttttctccttgagcctccataccgaggcccatgatatatgtccctggatgtatatgtgtccttgtgaaacaagcagaattattttatgatgagtgttctgatttgcagagttctcctgttcctcacttgctttccccggcgttctgtttcccagatctctgcctgtagctgtgcatggccaagtgtctctccccatgctgaaaagccacttacttcatttctctttctttctgggtgagctgttgctcatgtggaacatttttggggtggaacatttttcagtcatgaggaaacttggaccctcagtcggtttcctttgaagccagggagacacgtggggctggagggagggcaccccagctttcctgtgactcatctgggtcctgctgggccacacaggcagttcccacatggcaggaccacgcctgggcagccccctgcaggcactgctggcctagccttgggaggggagcttgtaggggttgtgaggggcgctcagagagagggctcatggccaggactgtcccctttaaagctgccggacttcaggccttctctttggggctccccgacacagcccagggcccacccctctttgtgggcacaggatgggtgtggaagggtaggggctaagtcacagctcttcagccctcagcatctcagctctccccgagtctcctcatcagtaagacggggaggaccactggggtagctgagtcacctttcctgcctccctttggcggccacaacattctactccagcacccacgcagtcaccaagggtctactgagcacctgctatgcaccaggcattggacatacataaagcagcaaaccacgtgccttcctggagccaacgcctggtgtgtttggtgtgtgtggtcagcagactcatgcgcccttccccaagacgtcctcatccctggaacccgtgaatgtacaaggttacacggccaaggggaatggaggctgctgagcagtctccttgagctgggggagacgaccctggattacccagatgatgacatcgtgacccagtgtcatcacaaggggcttagtgcaggagggaagcagaggtgttgcaggcggagggatgcagcatgggaaagatggcctcgccgttgctggctttgaagatggaggttggagccgtgagcccaggaatacaggtggccttgagaagctggaggaacggattctccctgtgagcctctagaaggaacgtggtcctgcccacaccttgattttagcctgctgagacccactgtgggcttcagccctccagaactgtaagctcacacattcatgttatttccagctcccaagttcacggcgatttgttacagcagcaacaggaaagggaaacacaaataaacacgtgtaacatatgtgtcccaccatcctaagcacagcagggtcaaaggaagccagatggaggctaaggactgtgggggatgtttgcatttttaaacagagtgaacaggtagggagggtctcacagagaaggcgacattcaagtagaggtctacagtaagccatctgcataatgggtgaagtgaaccaggcagagggaatagcgtgtgcaaaggccctgaggtgggagcagggctgctgtgttcagggctgagcaggcaccattgtgcctgggtagagagatcaagaggggacagagggaggagagcccatggaggttgtgggggtgcgggtcagatgagggcctggtgtattagaagctgctggacaaatgcattccaaggtcctacgagccatgcggggacagagctcccagcctccaatggcagagcatgtttctccagaagcagggcttgatccgccctgttcccagctctgcccaggcctgctgaaggggtttgcacgtccctgaagtaaggaaggggtgtgcttaccccctctctgccaccagctcttaccttctaggccagcccattgcttggaatgttttcttcatcccagtgcctgatacagcctggtcctggcaggaagcggaggctgcagtgcacccaaacagagatatcgtgaccttcctgtcaccctggaactgccaggcctagaggagaaggcggcactgcctcccttgggatcagggctcaggggttgccctgagcttgggcaacagggctgcagccgaaggagaaaggtcactgtttcctcttcacttcctgtgctctgtgacctggggctggtggctcaccctctctgggctttgatctcatctgtgccacgagcagttagatgaatcatgagttgcaaagaaacggcctgcagccacatcccgtccacagatgtgtttaaatgttttaaattagttgccaatacttagaaattgggaaacttcttgtaaatctctatatttctggtttttcttgagaaaccagatatggcagtgcttgtgactagagctgagtagcagctgcctccgtccccacccagctccctcggtggtttctggctcctgcctggcttttggagtctatgagtttgcaaccctgggctctagaggcccttccagctcggatttcactaattcatgcaacagaaatcctttgagtgtttaacatgtgtaggactcagagataagtctgttttacagatgatggaagggaggctcagagaggggttgtgacctgccagagtcacacagtcagtggcgggggctgcatctgagccacactggcaatagatgatcgatccaaaagggctttagccaaaattcattgaatactgactatgtgcccagtgccagaccacagcccctaaccagacagacaagatcgtgacttcctgggccgatatggcagtccctggagccgagtgatcaacagataaatatgtaatgacacctgggctagctgggaaggtgcagatacaacctggggtggtcacagggagggagggggcgacattagcgcagtttcctaaggaatgagggtttgaggccagactcggtgtggactcccttcctcctctcatgtctagtatggatcctttggcaagggccaggagactggaaggggaatccctccttgtggccgattttccactaagacggtggtgacgcgtggctcaggagccaggctgcccgccagggtgtctgctgctcatccaccatgcgacctcagacagggacttaatctctctgcacctcagtctccaaatctgtaaaatggagtcaatttgagtgtctagctcacaggggcgtggtggcaggatgaagtgaattacaaattctagtaagtgagtcacctgggacattgggctgtggtctacagtgaggtgtgatccctgaggagagaaagagaggctacaaagatcagagcgtgtccatcctctgaaggactggtcagggattaaaggactgtaggagacgtgggacacgtggtaggtaaaaaaaagcggccgtgtgtgctgtgtagtccgatctcatggacaacggtgggacttgaaccactgctgactctacctgcaggaattttccacctcggtggagggtgggactaacctccacaggaggctgggattagtatgtggtcatctatcctctggtgaacccagccagcctgggggcacctgggcaagggtttgaggaggagggaggaaagtggaagggagggaagacggttgtgcctggaggcgcagaaccctgtgtctcctggcagggaggagctggggttcttggccatttctgagcaaacaataatgtcttcccaatacattgcaggctcaccactgccattctctgtgtgcctgacagagacagagatgcacaggcctttcgccctccacctcctctctctctctctctctctctctctctctctctctctcacacacacacacacacacacacacacacacacacacacaccccacccggatgcatcttcacctctcacccccttttaatgtcccaggagttcagccccagctcagcctgctggttcaatgcaggaagaaaaaccacaagtttccattttgtccatacagagaagggactggggcctcagtagagaggcagtgccgaagccccaacccctcaccccaccgccttttgctccccatcatccttggatctcccaggagaggaattatcccagatcagaagaagatggaagcaggaatgagggagggtagaggctgagagacacctgtacagtcctgctctgtccctcacctgaaccttgcaggcaggtagtgagccttcagtaaatgttacatggatggatggatggactggtggatgaatgggggtagatgggagaatagatgaatgggtgagtgaatgagtagatgggtgagtgggtggatgaatacataggtggatggaagaataggtgaaatgagtgggtcaatgagtagatgggtggatggatggatggatgggtggatggatggatgcatgggtagatggatggatggatggatggtgggtgagtggatgaaagggtggatgggagaatagatgaatgagtgagtaaatgagtggatgggtgagtggattgatggacagatgaatgggtgggtgggtgaatggatggctggataaatggatggatggattgatagacaggtgagtggatagatagatggatagatgggtggatggaagaatggatgaaatgggtgggtaaataagtggatgtgtgggtgggtgggtggatggatgggtgaatgggagaatagatgaataagtaaatgaatggatgggtgagtggatgaatggatggatggatagatggatggacagatggatgaatgagtgggtgagtgggtagatggatgattaggacttaatcctgagaatactggacttggaggaaaattactgggtcattaggatcctgaccacagagtcatccaggccaacttcacctcctctcctcctggttccctcaagcccaaggatcttcagggagaggaatctcctcagagcaggaggatagaagtacaaggtagaaagggagcaggtaagggatgagaggacctgtgggaacatgggtctggacgaacaataacccagcctctgtggtatctggctttgtacagctctggagtcaggcagccggggttcaaatcccagctctattgcctccttgctgtgtgaccttggacaagttacttcaccttcctgggcctctgctttttcattggccaaatagggtaaaaatagtacttccatgagctaaaggttgttatgaagactctgtgggaggacgtgaggcattttgcactgggtgtgacatgctgttagtctcagtaaacatcagtgactattatttcatgcttgtcattgttccatgtgctttctataaatgagctcatttgattctcttaatctatgaggtgtgggctagtattttttccattccacagataagggctggggaggagtccttggatggctcaactggaaggaaatctccccagacagctgctgttagcaggaagggagtttggatctggggccttccacagggtctgcggcaagtgggtgttgggatgaattggagaaagatcattgagaaagcctcgggttggagttaacttgtcttgaacacctctctgacacctgccaatctcctttttaagaaagacacaacagcctcaggcttaaattttttttttcaagagagtatcgattttctaaagcctcaggcttagaaactacagtagcaatcataccctgtgagaatttgataactttttcacatcttcatggaatttatatgcatagggttttcctttctttctctctctctctttctttcttttcttttcttttttttttttttttttttttttttgctatttatagcaagtatgtgctgatactggctttctgtttctagtgatattgtcaagattcctttaaatgagtttctttatataaaaagaaaaatgctaagttgtaatagaacagagggtataaagatgtggcaaaaaccaaactgaacacacacacacacacacacacacacacaaccccagagatcatggaaaacagtttacttagcacatgcacgcagtcatccaaatcacactggctctcattcattcattcatttacatgtttgttcaacaagtacttacagagcacctactatgtgtttgtacacagagaacaagataaagtcctcttcttatggagctgacaacaacccggcaaagaatcaaacagaatcatttcatcaagtcacaagtacaatgaaggaaactatgagtctgttctcacactgctataaagaaatacctgaggctgggtcatttataaagagaagaggtataattggctcatagctctgctggctctacaggaagcatggtggcatctgcttcctgggaggcctcggggagcttttactcatggcggaagttgaaggggaaacaggcatcttcacatggctggtgcaggaggaagaaagagagaggggaagtgccgcacactttcaaacaagcagatcgcatgagaattcactattgggatgacagctccaagggggatggtgtgaaaccatgagaaaccgccctcatgatccaatcacctcccaccaggccccatctccaacattggggattacggttgaacaggagattcgggcagggacacagattcaaactgtaacagaaacacacatgtgagagagacgtgtaaggagatttggagaaaaggcctcctttggctggggtggtcggggatgtcctctctgcggaggcgacatgtcagctgggacttggttgataagaagctggctgtggggagaccatggggaaagacttggcattaggaacagcaagtgcaaaggcccagtggcaggacccagcctgaacgtttgaggagcagaaagaaagtcagtgtggctggagctgagtgagttgggggagagtgggaggagaaaaagtcagagagggagcagggaccagaaacctagggcctcgagaaacatggggattatttttttacagggatgttagacattactactatcttttaacaatgggctggaggaacccacacagatggagaaagggtgcctcaaaggcccaccacgagctcttgggatggcggtgcagctccatgcaagtgcagctgagggtacctgttgaggagtttattgtcctaagcaaggggatttgaaggaaggaatggggggctgaggccagctgctgcccaggcacccgggttcagccccttgaaagatctccttgcttcagggagccaggctgggactggcttagcccatccatcttaaaaaaaaaatattttttgagataaggtctctctctgtcgcccaggctggagtgcagtggcaccatcatggctcactgcagcctccacctcccaggctcaagtgatcctcccacctcagcctcccatgtacctggaactacagatgtgcaccaccacatctggctaattaaaaaaaaatttttgcagagaaaggtcttgctgtgttgcccaggctggtcttgaactcctaggctcaagtaataaaaaaattttaaatcatccaaataactcatggagatattctccttttaatacattaaaacatcatatgtgaggctctgaagtccccacctgggccccagcactcccagctccccttgtcctactttctcccatagtttttagcacatcttccgtactgatgtcttccttgtttgtttcatgtctgtctccccagggagaatggcagagccacaataggaaggtattggcttgttttcttccctgctgcctccctagcacctggcatggtgtctggaacatggcaggtgcttaataaatatgtatgaaatggatgaatgaatgaagtcataaagaatgagaactctctatccccattccagtccttccttgtgccccaggaagtaactcatcttacctctttggaatttgctcttctacatcttatccccatggttctcaaccagggcagctttgcctctcaggacacatttagcaatgtctgatgacattttggttgtcacaactgatgggggcgaggggtgctactggaatcatgccggtgggatgttgctaaccattctataatgcataggacagccccttagcaaagaattgtccagccgtaaatgtcagtaatgtcaaggctgttgtttagatcctggaatgttgtactgctgttaatggggaggtttttctctgctgacctaaaaaacctccaagattggttactaagagagaaaaacaggcacagaatgacgcacacaatatgataccatttatattttaaaacgcaccaaaaaaaaaaagccctttgtattttccacaagtctatataaacgtgtgtgggttgagttgggtttttagctcttgccacaaaagcaactgggaactgaagagagttggacgggatggtctccagcatctctccagcccggatgttccctgaatccttaagtggagcaaacacttgctaaaggaagcgccatctctaagaaggcagggagaccagggcgagacttagcagcgggagggaagagcagggatggcaggaggtgtccagaggcagggacacacactgtgtgctaaggccccaccactcccaggcatggctcccagactggcggctgctgcgttgcctgggagtgcattggagaagtagcatcccaggcttcaccccagacctactgagtcagaatctgctttcccacaagccctcctggtgaagaatggcttttggcttaaaaacacccagagacactttttttttttttttttttgagatggagtcttgctctgtcgcccgggctagagtgcggatctcggctcactgcaagctctgcctcctgggttcagcctttctcctgcctcagcctcccgagtagctgggactacaggcgcccgccaccacgcctggctaatcctttgtatttttagtagagatggggtttaatttcaccgtgttagccaggatggtctcgatctcctgacctcatgattcgcccacctcagcctcccaaagtgctgggattacaggcgtgagccaccgcgccctgcccagagacacattttttatcttacaagagagaagagtggataaaactgcatttctctctgtttccacatctctcttaaacatcttctaacactttttctgctttagtggaggaacaaagaaggaaaagaaaatgtaaacacacaagtgcgtgcgtgcacccacacacacacacacacacacacgcaacatcaacgatgtcatgtacaatccaagtgatggctaacaggcacgtatttctttaatgagcaccatttccgatgaaaaacatacttcaggctccgtgcaattcttccaccaagatttgcaagctctggggtcatcgtaacctagaggttagacgtgatgctttggacacatgaacaacagtcttggcagtaaaaccgtttgacagcatgatgcccttatgagttccatcatctggagcagaacccatcagatggagcagagcctgtcatttttggtagggagcggagcctgctgcagcttaacctggcaggaccttgactttgattactgagctcattcaggagctgccttcaccataaatccatcttctctatcggcacaaagtcaggccttttatagcaaccatctgtataaacaaagtattcttgtgtctaaaaaaatgacttcttctctggataagattttttttttttgaaacagagttttgctcttgttgcccaggctggagtgcagtggtgcaatcttgactcactgcagcctctgcctcccaggttcaagcgattctcctgtctcagcctcctgagtagccgggactacaggtgtgcgccactacatccgcctagttttgtatttttagtagagagaagttttcaccatgttgtccaggctggtctcaaactcctgatccgccctcctcaggctcccaaagtgctgggattacaggcatgagccactgcgcccagccttttttttttttaaacagagtctcgctctgtcacccaggctggagtacagtggctcaatctcggctcactgcagcctccacctcccgggttcaagcaattctcctgcctcagcctcctgagtagctgggattacagatacccgccaccacacccggctaatttttatatttttagtagtgatggggtttcactatgtcggccaggctggtctcgaacacctgacctctggcaatctgcccgccttggcctcccaaagtgctgggattataggtgtgagctaccacacctgtcctctgggtaagattttttgacttaattttcccttcacctccaactcccttgcttaaaaatatcaagactgagccgggcatggtggttcatgcctgtaatcccagcactttgggagaccgaggtgggcagatcattcgaggtcaggagttaaagaccagcctggccaacatgatgaaatcttgtctctactaaaaatacaaaaattagccaggcatggtggtgggtggctgtaatcccagctactgaggagaccgaggcacaagaattgcttgaacccaggaggcggaggttgcagtgagctgagatcgcgccactgcactccatcttaggcaacagagtgagactctgtctcaaaaaagaaaaaaaaaaaaagactggaccaaaaaaaaaattgtaattttattccccatgtctcttaagaaaacaaaaacatattttgaattctacgcctccctgagtgagatggctgtggtggcagtggagctcactctggaaggctttagatgccaggatgaatgtttattcctggcctctgactactttctcctgacctctgacctctggcctgtccccttcctctttctctggattctgtctccccaaatttcttggacccacctccaaagccccactccccatgcaggaaggaaaagagcattcacaggataaatatttagcccaaaggtcttggagagtgtttttgggaggctcccggcagtggggctccaggcatagatgacctcacccagcttctcctaacagtgccaccttggtccttcttgcctgccctccacgtcccatctccctcagtccctctgtccagggcaaatggtggtagcctctggagggggatttggctctctcataatccccatcatcgcttctacaaccacccccaacaaacgctcacgcagcccatctgcttagcaggtgtttccagctgccccttcggaaaagaccactgtccccaagacccccatatagaccatctgggcctgccactgcatagatgtggcctccttcacggcaaaggttaacatccggggctccgagtcagacctgagttcaaatccggccacttcttagctgggagactgtgggcaaagggctttggctctctgagccttcaattccctccttgtaaaaggagaataaagcactggttcttaactaggggtgattttgcctcccgggaaacctctggtaatgtctggagacagttttggttgtcataactggaaggtgggagtgttaatggcatctagtgggtagagtccaggggtgttgttaaatatttgacagtgcacagcacagccccttaattaaggaattatccagtacaagtgtcactagtgtcggggttaacaacccctgatgaagtgctacccacactgtcgggtggttgtgaggatgaagatcaggaagcagctaacacggggcctggcccacgctaagcacccagtccgtgactgcgaatatgggttttatgatcaacctcttttggtttttttgctcatcctcttctctcctgccctagaccaactccagagagcttctttcgcaatcgagcatacaagatcggcaccacctggcacggtgcaaaggagccaccccacccgtcaccatgtccacaccctagccacagacctctccccggagtcccactgctgcctcctcactggcttccctgcctccttgcctgccctcctccattgctttctccccactgctgcccaagggaatctctaaaaaccagtgtttttgagcactaggagggctctggatctatgtagagcactttacctacattatcttattgaatccttagaacaaacctttgaggcaaatgctaagattgtttcattacggaggagagaaaacaggctcagagaggtgtcgtaactgacctaaaatcacagagcaagtaagtggcagagctgggatttgaaaccaggtttgtctgagattagaccttataagtgggatgttagctgcatctcctactcactaaaacagtgggtgtgcttcagaatcccctcagagggggcctgctacaatggggagccacatctagggtgga

SEQ ID NO: 12423 - DNA, 60376 bp, Human
  misc_feature (1)...(60376): n = A,T,C or G
agagaactcatgaacttttttttttttttaagttgttgttgtttttgtgagatggagttttgctcttgtcacccaagctagagtgcaatagggttatttcgggtcactgcaacctccacctcctaggttcaagcaattctcctgcctcagcctccaaagtagtggggattacaggtgcctgccaccactcctggctgatttttgtatttttagtagagacgtggtttctccatgttggccaggctggtcttgaactcctgacctcagggtgatctgcctgcctcagcctcccaaggtgctgggattatgggcatgagccaccatgcctagccgaattgttatgttacacatctggaaaaatcactgctgattattttgtctaatttattaaccacataggaaaaaattaacaatatctgcaaagaaagctaatgaaaggggggaaaaaatgaggcaattattagcttcaggaaataccaaaagaggctgggtgcagtctcttttggtatttcctttattattttatttaaaaataaacttcttcactgtagagaaagtgtaaatcaaattatgtgggagttttaatgggccaggcctgagaatagcacacatcacatttaattggccagaacttggtctgaactgtaaggaaggctgggaaatactgtctagttgtgtgtccaggagcaggaagaaataacgtttttgagaggaagtagcaatatctgccacaacaggcaaaaagtagttgtaggcagatgaagaagaccatctcaggtattcatttattcaaggagcaaaacatatttgttgagcaactactattgactaagcttggttccaggcatggtggatacaagagtgaacaaataaaagactgctcttatgcagtttctatttagtggggaacagcaggtgtaagttccatgggggttggaacctgcccttctaggccagtgtggttggaatagagttttaacgaattttgcaggaagtaataaggacttcatatttgattctaagagcaatgagactccattaaatcgagtattaatcagaaagtggcatgatctgttttatttatttatttatttatttatttattttaatctttatatctgagacggagtttcgctgttgtcgcccaggctggagtgcagtggtgccatctctctcactgcaacccctgcctcccgggttcaagcgattctcctgcctcagcctcccgagtagctgggactacaggcatgcgccaccacgcccggctaattttttgtatttttattagagacggggtttcgccatgttggccaagctggtctcgaactcctgacctcaggtgattcacctgcctcagcctcccaaagtgctgggattacagcgggagccaccgcacctggccgcatgatctgttttaaataattactctggccaccttatggaaaatggattgttcggacagagctggacaaaagaatggaaacagaccagatatttcaggcaggctagagatgagcgtggcctggccttgcctggggcggttgtgactgactggattgggtgaaggacaggaaagctacaacaagggtgcctataggtgttcgtattgagtcactgggggcaccctaaatgggagttacctcagtagcagtttgagacaccagtcagataatggatgtgaaagcttttagaaaggttgaacggcggctgaaatcgcgtgtgttccatttacagatgggaaactgaggcacgagataccagaggatggagtcaggccacgttgtgcgccactctccccgcttaggtgggtgaggagaccgaggtgtgttgggcccccgctaaacaccagcaccgacctgagccccgcccagacccctccagccggctttccctgtcctctgctcgtgtgccaataaagttattgaaattgacaccggttgctaaggaagtgggtcgccgagccaggttgctaaggaagtgagcggccactgtctctccccatccggggcagcggggaatggctgagccaggggttcgccgcccccgccgccgccgccgccgccgccgccgccgccgccgcccgctttcggctcgggcctcaggtgagtcggaggggccgggcgcccaccgagcagggctaatcctgtggccgcctggggttttccctgcgacctgcgcccgcgcctctgcctggctttgctgtcccgcgagccggagcatcctctgccctgcctcctaggcatcctttggtagtccggacggccttgcccctccttcccctggcagggtcgcggcccgacccccagacacggccaccttgggtcgcagcccacctgggggccctgaggcggtggtcagggccccagtttgggaggagggcggggaagcgagagcctggggtccgaacctcggcgctgtgctgggcttgctgtgtgaccttgggcaagtcttttcacctccctggccttagctgacctgtttattcaatggggtcctaacacttgctgctcagagtggtaaagataatgagaagtgtatgtgaaagtgccctaaatggggagagggagaattcttagggcaccctagatgggagaccaagagggcagtttgaagtctgagcgagttagagacgtggcatttccacttagtaactgtgtggccctgggcaagttaatttctctgagtcttcttttccttatctgtgaaatgaggtaatagactactgtggaaatcagtgagactgggtatgtcaagtagcttggcacatagtaagtgctcaaccagctattatgaggcgtccagggtaggagggcaagacttccaggaggagatgactttgggacaggtaaggtgtaggtgtgtagagtgccagctcatatgggtagtcctactgcaatgccaacccccaaccccggttttacttctccattctgctcagagcaagggaggtacttctacaagtagtcctgggaaactctttgaggtcaaccccttgtagatagctggggtcatggtctcattttctacctgggcttcgttgacccttccagaagaaaaaaggcatctttgtgtcctttgggaagtgcttaaagcagtaataactatttacaagcatatgattaagaagcactttaccaggcatattatttcatttaatctttatgtagactttgccaggtgcctggtgatgtcatcctcattttgccgatgaggaaactgaggttcagaaaagtaaagggaaggacctgcttaagaatcctttttttttttttttttttgagacagagtcttagtctgttgcccaggctggagtgcagtggcgcgatctcagctcactgcaacctccgcctcgtgtgttcaagcgattctcctgcctcagcctcccgagtagctgggactacagatgttcaccacctcgtccactaatttttgtagttttagtagagacaaggtttcaccatgttggcctggctggtctcgaactcctggcctcaagtgatatacctgcctcggcctcccaaagtgctaggattacatgcgtgagccaccacacccagtcattgcctaagaatcttgtatctattaagtgatggaagtggacgtgtttctaggtaaatcctgtattttatcccccattcactgttgcctctgattttgcaacagttgctattataaggccacaggggtattcttttgttacttttaactggctagaagttaaaaggcaaggaaacaagatctcaggtaaagctttatttaaatagataccacccaaagtgaggatctcagaaaatagttggaatctttttttttttttttgagacggagttttgctgttgttgcccaggctggagtgcaatggtgccatctcagctcactgcaacctccgcctccctggttcaagcagttctcctgcctcagcctcccaagtagctgggattacaggcatgtgccaccatgcccggctaattttgtatttttagtagaggtggggtttctccatgttggtcaggctggtctcaaactcccgacctcaggtgatcgcctgccttggcctcccaaaggactgggattacaggcatgagccactgtgcccagcctgagagctggaatctttaaaagagggcttctctgtccctcattccctcctcattaaaatgaggggactaggctagattatactgaaggccctttcagtgctgttatgcagttgtggttaaaagcttgcaatcagactacctggactaaaatcttggctctgccacttccaagctgtgtgctactgagcaaagaggtgctactttacctctgaaatgatgctcagtacctctgaaatgatgagaggactttttggtaaggggctctgtgaggaagaattattcatagttcattttgaaccccttggtggtatagtttcctcatctgtaaaatggggatagtaataggccttattacctgtggccttattatcatgtatggctgttctgaggatttatttgaacttaatatatgtgaagtgcccagcatatttggtaaacattagctatcgttatttgggtttaacgtggtgcttgtgctgtattttccgtgtatggttggtgaaagaataaattaaagtatgtgataataccaggtccgtcaaccataatgtcattgcaagcatgaaacagtagccatcatggcattatataaatgttgatatttttatacagttggccccaggaacctgtaatcatgtgccacaatgggttgcaaagaaaggtaaagctgtccaggcatggtggctcacggctgtaatcccagcactttgggaggccaagacgggtggatcacgaggtcaggagatcgagaccatcctggctagcacagtgaaaccccatctctactaaaagaaaaaaaaaattagctgggcatggtggcgggcgcctgtagtcccagctactcgggaggctgaggcaggagaatggcgtgaaccggggaggtggaacttgcagtgagccaagattgcgccactgcactccagcctgggcgacagagcaagactccgtctcaaaaaaaaaaaaaaaaaaaaaaaaaagaaagaaagatgaaagctgatggtaggacgttaggtttagtagctcaacatccaattcagtaaatatttgctaaatccccttatgctaggcacatggaggatgtggaggtcaatcccatctccatatccttcgaggaactcagagcttaatttgcaaattactgcatttgacatctttaaatgaattcatatcttatgtttgccttggctgcagagtgaagccactgattctaatctgttttgttgtgtccctagacttctgttaggtgcctggattagaaacctcagattgcttcctaagccttttcatccattaattcgcaagtccctgagaaagaccccgtcttatgtaacagagagtagcaatacttgacaataacaataaggtgcctaatggcttacaaaaatgcctacacttgcttacacatgcttttactcatttaatcttatctgtgtcccttcaaggaaggtaaggtgcagattaggatctctgttttatagtcgaggaatctgaatggaagccaagaagccatgatgctattgagtggcccatttcacgttgaaatccagtcttctgtcttcaaattcagtgtacttaccactatcctgcccggattgtatttattcagtatttcctgagcacctagaatgtgtcagttctgttttagcctggagatatcatggtagaaaggtacagagtcccttgctctcatgcagcttatattctactggcagcaaacagaaaaatacagcagtaaatgaacaagggaatttggatgaggaataagtgctggggtgaaatcccatctctattaaaaatacaaaacttagctgggtgtggtggcacgtgcctgtagtcccagctattcaggaggctgaggcacaagaattgcttgaacctgggaagcagaggctgcagtaagccgaggttgcgccattgcactccagcctgggcaacagagcgagactccatctcaaaaagaaaaaaaacccaacaaacaaaaagaaaaagaaaaggccttgctaggatggtgacgtttttgctgagatttgctcccagggacgggccagccatttgaagacatgtcagaaggaagagcaagggtaaaggctgtgaggtggcaacaagcttggtaagttccagaaactgcaagaaggcttacaatggcagggacaggtgagtcaaaggcagagtggggaggtgggtggatgtaggggatggaagtggtagggagcgctcagatcatacaggaccttgtctgctagagtaatgagttgggattttgttctaaaagctgtggaaatcattggaggttctggagaagggacgtggcatgatctatttttgttttttaaaaaaatcactctggcctctttgtggcagtgaattttagagggcataggagtggcagccaggaggctagttaagaggttaggtgagagaagatagtggctttctaggttggtggcagtggagatggtaagaggacggattggggatgtgtttcggaggtagaaccagcaggatggcgggatgagggtgagagaataaggatgactcctgggtttttggcctgagcaattaagtagatgttagagatgccatctgcctctgaaatgatgaaaggactttttggtaaggggccctatgaggaagaattattcatagtttattttgaaccctgtagaggagaggcacaaggtataagcatcatactttatagtctgtggggaggaaatcccagattatgctggcagaagctagccaggtgcaactgattgaagcttgacgttcctactgtgaaccaaaaaaaaaagtcctgcttttctacagtctggctttttgccagcctgtggagcggcaggtgtgggctttgccagggcagtacccatctgtctttctgtcttgtgctgttggcattgcagtgctgactcgggatcttggctgagggagcctggccagctctggaagagggagcggaatcactagtgaagttcacttggtgtgccaaatggccacattctccctgccaaagtggttctttcctggtcaccaaatgacagttctgaagtttcagagcttttgacttcagaatccctggaaaacctattgtactctaccagaattcctagaggattcttgaatctcttctgagcaagggaattcgagcttcattgttatgtattccagtaactgtacttgtaaatctgggcattacagggttgtacattcaacattgtgaatagtaaaactaatagtcttatcactgccacttgtttatttaattaaatttaataaatttattcattttggagacagggactccctctgtcacccaggttggaatgcagtggtgtgatcatggctcccccacagccttgaactcctgggctcaagtgatccttctacctcagtctcttgagtggctgggaccgcaggcatgtactgtcgtgcctggctaatttaaaaaaaaatgttttggggacgggtgtggtggcttatgcctgtaatcccagcactttgggaggctgaggtgtgcagatcacgaggtcaggagtttgagaccagcctgaccaacatggtgaaaccccttctttactaagaatacaaaaattagctgggcgtggtggtgcgcacctgtaatcccagctactcaggaggctgaggcaggagaatcgcttgaacccgggaggtggtggttgcagtgagctgagatcgcaccactgcactccagcctgggcgacagagtgagactccgtctcaaaaaaaaaaaaaattctgtagatggctaggcatggtgactcacacctgtaatctcagcactttgggaggctgaggcacgtggatcacctgagatcaggagtttaagaccagcctggccaacatggggaaaccccatctctactgaaaatacaaaaattagtcgggtgtggtggtgcatgcttgtagtcccagctacttcggaggctgaggcgggagaatcgcttgaacctaggaagcggaggttgcagtgagctgagattgtaccacttcactccagcctgggtgacagagtgagactccatctcaaaaaaaagaaatttgtagagacgggtcttactgtattgtccaggcgtcttggccacaagtgatccactcaccttggcctctcaaagtgctgggattacaggcatgagccgctaatttttttagaaaacttggtctcactctgttgcccaggctggagtgcagtggtgcagtcatagctcattgtaacctccaactcctgggctcaagcgatcctcccacgtcagccatccaagtagctgagactacaggtgcatgccactacacccagctaattaaaaaaaaaaaatttttgtttttaatttttattttttgtagagatggggtcttgctatgttacaggctagtctcaaactcctggcttcaagcaatcttcctgcctcagcctcccaaagtgctgggattacaggcatgagccacagcacctggccaccactgctatttgtataactttgcagtttagaacgctctttcctgtgcattctcatttactaattgtcaatcagttgagatcatctggactacatattatccctggtttacaaatgaagacattgtggtgtggagaggtcacttgtttttgtcagtaatattgagcattttctaggtgctgagttagggagatccttgctgctcaaagtgtgttctctgtgacagatgtaccatgtccccaggaccttgtcagaaatgcagaatctaggctgggtgtagtggctcacgcttgtaatcccagcactttgggaggtcaaggcaggaggatcactggaggccaggagtccgagaccaacctgggcaaaacagtgagacctcctctgtatttttaaaaacagaagaagaagaagaaaacaacaacaataacaaggcccagatctaataaatcagagcctgccttttaccaagatcccggatgtttcctgtgcacattaaaagtttgagatgctctcacctaggtaatcagtagcaaaactaagacttaccaatgataatgacaatgaaggtaatagtcgtagctaagatacattagccaagcactgttgtaagcactttacacatgttgtttcatttagatttagacctcacaccaatcctgtaacacagatttccagaagaggaaagtagaggctcagaaaagttcagtaacttcctgacatctgctgactccaagtctattgctctttctaccattcattcgcgtgttcatctgtttttcaggtgggcagtgaccacatcttagctgtcttgtcaaaggcctttctcttccatacctgcataactaattttaaatgatgaccaaaaaaaaaaaaaaaaacagtgacttgaaagaatgtttgagaaaatcaagggaaaaacttctgagctagatgggtgtcagttacttgactgatgaggccgcaaacagatatctcatttggtcagataagctacctctcacacttcttagtgatctaacttcagggtccgaacagctgaagcaggtaggaactgtgagcttgtattctgagtcatttagctctaagctgtttcttgattctggtgataaatatctacactgggtgagaagatagtggataaagtcccatataacacctgccaactaattgttaaaacattccatctcactgtgcctcagttttctctctctgccctgtgggctcattattttcctttcaacacctcctgtctttctagactctcagaaagatatattggtcgaggactatgccattataggaaattttgacctgaaaggatggtgggaactgggtaaaggcaggattctatcaattctgctacttgctgtgtgacttggagcaagtgactcaacctctctaggcctctgtcttgcgcatacatatatatatgtaaaataaagatataggacagttcttcccaaagcccttccagccctgcccacaagactgaaccttgagttgggtgatattttgttctttcttggtgacttcatactgagctttctcccagacctttcgggtgtggcttttagagcgtatttcttggcagtcagagagcattacaatcagctcatcttatcagcatcacacatctgcacagcagcttgggatgttcatgtttaaggttcagttaatcatggtgacacattgtgtcttctcactttgtcacactgattgcggacattgagctcttcacacaggaagatctatctttagcatgctgatttatttaactcataatttgcattagagagggaaccagtgataatcatggtgggtgtggcttttatttttaaagtttttggcaagacatttgcagcacttgcattttgtcatgcttgaatatagtctataaatggaaatgggttcaagtgaaatagaaattgccatagattattgggagcttgggacttaaccactctggagtccttcatatcaccttcagcagtgctttcaggaagggcttgcttggccttttgtgtgtgacataaattaaacagaaactaaaagctcatagcacaatctctagcagcttagcagactacagtaatcattactttgtaacacatttcagaacataagcaaaaaatctagctggcaaatcataaaagattccatctaggtaagataaaatatcagttcaagttacctaaagataaccacaagaagatagtccttggtggaagtagttactggttttgcaagatctgcaataataagttagactctggcctaagaaatatatgtaatgtttttccttattcttcaattgtcagccttttaaaaatatataattttttccgattataaaaataataaacttccattgagtaaaaaaatgaggaaaatactgaacagattaaataaggctgactttaagatccaccactgagaaataactactgttaacattttactgtccatatacaaatgtattcctaaatacattttatctcataggcttgcagttctcacctgtttcctccattgttgttatttaggccattttcaacatttaaacattatgagtaatgcttcagagaacatcttaatgatgattattttgtgtaaacctttgtctgcactgctgatgatttctttaaactaggtcctttaatgttaaaaattttaaattacaaaggcaaccccccttaaataatgtttttaacatggcagtgttaacctaaagctgaaaagacagacagaattacaatttggttggggaatttacccatggtgatggtatcctaactcaggttttagcttacttgactacttgcaagtatatttttagaaagttgtattcaaagcatatttcccattttctatttggaaatgtttgcttaacattatttcataaccatttttccatatttttgtacttatttatttcaatttttgtttcattttatttttgtagaaacagggtctcactatgttgctcaggctggtctcaaactcctaggctcaagcgatcctcctgccttggcctcccaaagtgctcagattacaagtgtgagccaccaggcccaatctattttttttatttgtttatttttgagatagggtgtcgctccgttgcccaggctggaatactgtggcatgatcatagctcaccgtaacctccagctcctgggctcaagtggtccttccacctcagcttcctaagcagccagggccacaggtgcgtgccaccacttgtggctaatttttaaatttttcatggaggcaggatctcactatgttgctcaggctggtctcaactcctggcctcaagcaatgctcctgactcagcctcccaaagtgctgagactacaagtgtgagccactacgccttgctgtgtttttgtgtttagtagttattactacatgttagtagtttagtagtaactactacactttccctggcattgagcattgaagttgtttccacctttttataatcacatataatgtgttatacagaatatctccttctctctcagcctcttaagagaacaattctaaataagtggtttgtgaaaagtttgaactttaaaaaattctaacagagaactgtccatttcccttcttaggatcctctaaaagtatcttttttttttttttttttttttttttttcagatggagtctcactctgtcgcctaggctggagtgcagtggtgcagtctcagctcactgcaacctccgcctcctgggttcaagtgattctcctgcctcagcctcctgagtacctgggattacaggtgcacaccaccacgcccagctgattttggtatttttagtagagatagggtttcaccatgttggtcaggctggtcttgaacccctgaccttgagatctgcccatctcggcctcccaaagtgctgggattacaggcgtgagccaccgtgcctggcctaaaagtatctttaaaaaacagatttagctggatgtggtggctcattcctgtaatcccagcactttgggaggcctaagtgggaagattgcttgaggccagaagtttgagaccagcctgggcagcatagtgagaccccatctatacaaaacatatgaaaatttacccgggtgcagtggcttgcacctgtactcccaactactcgggaagctgaggcaagttcaagcccaggagttcaaggctacagtgagccatgattgcgctactgcattccagcctgggtgacacagtgaatgagatcctgtctccaaacaaacaaaaaatgaactttatttagatatattttacatatgatgaagtatttttttgatgtagtagtttttctcaccttctttttagtcttctctttatccatttttctttctgatgaagaattccctgtgagtaggacccagaacataggcctttgtcatttcaacccttcgttctctgaataggctgtttattggcaacattaactggaaacattttatgtacagcattggagtctcactctgtcgcctcagctcactgcaacctccgcctcctgggttcaagtgatgtgcactgtatgaactgtgagagcaagcatatcattataacattggacaatgagccaagacagttctgatggacttttgaagagggatttttcaaaaagcatttaactcatcatattaataaaataaatcctatgatttatgggaaattctgttggatcaactttggaaactgtttactataaaggtagcatgcgtaggcatgaatcttgataagacaagattctgatccggggttctgagtgggtccttatattctgcagagctgaaccaggtggaataggaggagagtttgggtaacagtcaaacacaacatccaaaattatgttgaatgtagtggtgagagctattccctttaaaactctctcttggttcttctgactgtgtcaagaatactgtatttgtttggtactggtctggtttttttttttttttttttgaaatggagtctcagtcacccaggctggagtgcagtggcacgatctcagctcactgcaacctctgcctcctgggttcaagcagttctctgcctcagcctcctgagtagctgggattacaggtgcctgccaccatgcccggctaatttttgtatttttagtaaagacggggtttcaccatcttagccatgctggtcttgaacacctgaccttgtgatccacctgccttggcctcccaaagggctgggactacaggcgggagccaccatgctcggccactagtctatttcttaacacttattaagctccctttcaaaccaatggtgatcaagcttaaggcctcagataagctacagtatttagctagaatttagtaacattgttgtctgttcttatatttattttcacagttactttctatttataacaagtgatactgattttccattcatggtggttatataaagtttctttttaaaataaactttgtgttaagcaaagtagatttaaagaaaaaacgttaagtaaataatagtacaggtgatgatagacatggcgaaaattgtccagaaacaatcggattattgacatttaggacatgctggtgtggaagaaaggccatggactttggagccagatggacctggtttcagcttgctttgccacttattaactcagtgtgccatgttacttccctgtctaagtctctgttttttttctcctgcaaattgggtcagggcagagttaccacttgtgggccagacgcttgctgcctgtcttcttctagtcctcacacggccccaagcagcaggtgttagtgatattcccattttacagatgaggaaatcagctccgaggggtaagaaactttcacagagcctcagaactacgaatgataggctgggcacagtggctcccagcactttaggaggccgaggcaggtagaacacctgaggtcaggaattcaagaccagcctggccaacatagtgaaacccacgctctactaaaaatacaaaagttagccgtgcgtggtggcaggcgcctgtaatcccagctgcttgggaagctgaggcaggagaatcccttgaacctgggaggtggaagttgcagtgagccgagatcacgccactacactgcagcctgggtgacagcaagactccatctcaaaaacaaacaaacaaaactaggaatgatagagctgggtttcagtcccaggtgtgtctgaatctctttttggctattcaggctacctctgcctgttaaatacaggttttgctatggccctctgcccatagcattattcacaatagccaagaggtagaagcagcccaaatgtccgttaacagataaatggataaagaatatgtggtacaggccaggcgcgatggctcacgcctgtaatcccagcactttgggaggccaaggcggaaggattgcttgaacccaggagttccagaccagcctgggcaatatagtgagaccttgtttctataacaaataataataataataaattagctcagtatggtggcatgtacctgtagtctcagctactcaaaaggctgaggtgggaggattgcttgagcctaggagttcaaggatgcagtgagctgtgattgcaccactgcactccagcctgggtgtcagcaagactgtgtctcaaaaaaaaaaaaaagaaaatatatatagtgcatacatggaatggaatattattcagccttaaaaaagaaggaagttctgacacatgctttagtattgatgaaccttgagggcattgtgctgagtgaaataagccagtcacaaaaggacaaatactgttatgattccacttatccgaggtagctagagtagacaaaatcatggaaacatggttaccaggggctaaggagagggggaaatggggaattgttcagtggttataaagtttcagctttgcaagatgaaaaagttctagaaatgtgttatacaacaatgtgaatatagttaacactactgaactatacacttaaaatgattaagagggtaaattttatattatgtggggttttttactgtaattttaaaaaaattttaaatgataagccattggttagagggtgatttttttttcatttggaaaatcccaattatgcataaaactagaataatgtaatgaatcatgaacccattacccacctccagcagttctcagcacttggcaatcctattttacctataaccttccatgcaccccacccctgaaaaagatcccagatggcatataactttatctgaaaatattcttgtttacctctagaggataagaactttctttttaaaataataacatttttttacacgtaaaaataatttcttacattgtctcatatccagtgttccaatttccttgattgtcttatacattttttttttttttttgagacagagtctcgctctgtcacccgggctggagtgcagtggtgcgatctaggcccactgcaatctctgcctcccgggttcaagcaattctcctgcctcagcctcccaagtagctgggattacagacatgcatgcaccacacccaactaatttttatatttttagtagagacagggtttcaccatgttagctaggctggtcttgaactcctgacctcgagtgatgcaccctcctcggcctcccaaagtgctgggattacaggtgtgagccaccgcgcctcgcctcattttttttttcttgagacagggtctcactgtatcacccaggcttgagtgcagtggtgtagtcagagctcactgctgcctcaaactcttaggcggctcaagcaaactcctgggctcaagtgatcctcccaacttagcctcctgagtagctggggccacaggcatataccaccgcacctggctaatttttaaaaatttttttgtagagacaggatcttgccatcttgtccaagctggtcttgaactcctaggctcaagtgatcctcccacctcagcctcccaaagtgctgggattatgggtggtgaaccacctagcttggtccttgtacatttcttaacagttggtttgtttgaatcaagatcaaaaaaggagctggacgtagtggctcaccatggtggctggtattacatgatggacctgtaataccagcagtttgggaggcctaagtgggagaatcacatgaagccaagagtttgagaccagcctgtgcaacaaagcaagaccccccccaacttctacaaacaattttaaaaattagtccaggcatggtggctcatgcctgtaatcctagcactttgggaggctgaggtgggtggatcacttgaggtcaggtgtttgagaccagcctggccaacacggtgaaacctcgtctctactaaaaatagaaaaaaaaaaaaaaaaaaaaaagaaaagtcgggtccagtggcgcacgcctgtagtcccagctactctggaggctgaggtgggacgattgcttgagcgaggagttcgaggctgcagtaagctgagattctgccactgcactccagcctgggcaacagagcaagaccttggctcttgaaaaacaacagaatgtgaagaccttgactcttaaaaaacaatagaatgtgtacaacagtcctacctctgggagtggatcctaccaactactcccacttaccctaaaggtatatatgttcagtatagccactgcagtactgtttgcagtagcaaatgaccagagaccatcagaaggtccctcaataagggactgactgatcaaagacattttttggctgggcgcagtggctcatgactgtaatcccagcactttgggaggccaaggcaggcggaacacctgaggtcaggagttcaagaccagcctggccaacatggcaaaaccccgtctctacaaaaaataaaaaattagttggatgtggtggggtgtgcttatagtcccaggtacttgggagtctgaggtgggaagattgcttgaccccaggaggttgacgttgcagtgagctgtgattgtgccactgcactccagcctgggcaactgagactctgtctcaaaataaatgagtgaatgaatgaatgaatgaaaggaagtaagacagaaaagaaaggaaaaagaagcagctaagcatggtgtctgatgcctgtaatcccatactttgggaggctgagagacggaaggatcacttgagccaggagtttgagaccagcctggggaccagcctgggcaacatagtgagacatttgtctctacaaaaaataaaaacaaaattaggtttggtggcatgtacctgtagtcccagctactgaggaggttgaggtgggaagactacctgagcccaggaggttgaggctgtggcgagccaacatcatgccactgcactccagcctggagtgcagagcaagagtctgtctcaaaaaaacaaacaaagaaaacaacacaaaatgagttggggggcggggagaaggagttctccaagatttatataggaagaagtacagtggtatatagtatactgctacttgagttaaaaaggtttaaaagcaaaagatgaagatgaaggagcaatgcagatatgttaggaagatttacatgttcactgtacactctgtacagcttgaattgcgttaatctttgcatagacatacacatgtatatatgcgtatatatcaggtgttttaaaaatatatgggtttatatatgggttttaaaataagacaaatctggttttgaatcctgactcttccacttaattgtcgtgtaaccttgggcaaattaatttccctgagtctctgatccttattctttaaatgaggctaatgcctgccttcctcccaaggtgattttgaggattaaaagaggactcacattaagctcttggtatactgtgagttgtgactattgaatacaataaaacccaagaactgcattgattctgaatagtaggtgttgtccaacagacttgaatatatttttgaatgtattttatgttttacaattgaatgccaaaaagagtttcttttcttctttccctgcctaaataaatgctttgtttgcctctttgtgtcatcaaatgacagagagtacatggcgccagtttgaattcagggcaggcatttattgtccttgttacttgactgtgacgtttttaggtttctttccggagaactagcgtgtcttcttcagacatttaagctgaaatcaaagttctggacttttctccaaagaaaacattgctttattgcttcccccaccttaattataaaaatcaaaatacatgcacccatcaaaaaatacaaagaaagcaaaaaaatagcctgcaggcgcaccaccctagaggtcaatattacctgcatttcatgagtatttattagtacttttcaatgttaaaagctaagcatttaacattcattagtttatttaatcctcagaacagttctttaagggagatattgctattaaccatacttggtggaagaagaaactgtgacttagtttcttgagattttatagctagtaaatggcagagcagaaattcaaagccagacctgctgaacacctcagctcatgcttttaacaatgtctttactctgtgttccccaaatctgcatctgcacatgtgcctgtacacataaacattaactgtatcatagtaattctgtttagtagcctttttcttcactcagcaatatgtcttgaatattgcccatatctaaatacctagaggtttgttgccatttttaatgacttcatagtttcccattgtagagatgtgccataatctaaccactcccttattgatgagcatttaagtgcttagaggtggtgatgtgacaaacacaaattgtgtattacattgttgcacatgtatttagttactcaattatgtccttaaaataattccaagaaatggaattgctgtttcaagggagtattcacatttagagttttggtactgattgcctgactgccctcaagtatgttgtgccaatttgagatgctgtggctcttatatgttctttctgtaagggacattttgaaactttttagacagttcacgcaactgtttggcttacaaaaaaggtgacgccccccgcccccttttttttttcttttgtgacagaatctcgctctgtcgcccaggctggagtgcagtggtgcgatctcagctcactgcaagctccgcctcccgggttcacaccattctcctgcctcagcctcctgaatagctgggactacaggtgcccgccatcatgcccagctaatttttttgtatttttagtagagacggggtttcaccgtgttagccaggatggtctcgatctcctgagatcgtgatccacccgcctcagcctcccgaagtgctgggattacaggtgtgagccaccacgcctggctgaccttatgtttacaaataatgcctgtaataacaacagaatatatttcattactttcttatttgacgtctatgctctaaatgctttttagagccgtcactgcatgacttgctacatttaccttagaaagttaaaaattctagtgctgtggacctaatagaaactgttttacgaagcttcatcataaatttaggataagtaggtcccgaatttaggtctcctagtaggtcccctcatttatcaattaaaacatttttattatcttttttttttttttttttttttaaattgagacagaatcttgcactgtcgcctgggctggagtgcagtggcatgatctcagctcactgcaacctctgcctcccgggtttgagtgattcttctgtctcagcctcccaagtagctgagactacaactgcctgccaccacgcccggctaagttttgtacttgtagtagagacggggtttcaccgtgttggccaggatggtctcgatctcttgaccttgtgatccacccgcctcggcctcccaaagtgctgagattacaggtgtgagccaccacacccggcccatttttattatcttatattcatggtggtcagcacaaatggatagataaaatgggaaaaatgagtaacccctgtatatttgtttaatttcacaaagcctttccatctctctttccccttgattttattttattttttgactaagtaatatatttacatgattcaaaactcaagagatattaaagggtaaacacactttgggaggctgaggtgggcagatcacctgaggccgggagttcaagaacagcctggccatggcgaaaccctttctctactaaaaatacaaaaattagctcggtgtgatggtgggtgcctgccatcccagctactcgggaggctgaggcacaagaatcgcttgaatgggaggcagaggttgcagtgagccaagattgcaccacagcactccagcctgggtgacagagtgaaactcggtctgaagaaaaaaaaaagggtatataatgaaaagtttctcttctacttttggccctcatccacctagctcttttagggaaagccagtgttgttatctggcaattgttacatggttcttgtgaattctttcagatatattttatgcacatataagcaaatgtagaaccattttctcaatatgtataaaacgtctttttaaaagttctgcaggacagtggtgttatttttcaacccaagatggataatcttgttttaaaaagtgtgtaactccctttgtgaaactggccatcataggaaccagagacctagaattggacttgctttcatggtgtggttcagggattgcaaacacggagtcctgatacttcaaaaacaattagaaataattgtaaaaaggagtagtgttgatggtgatgaggtggatacagagtaaaaacagctgcttcccccgagagaagcctgtccagggaattggtttaggctgcttagcagggagtcgcttttacttcttgctcgagtgttgcagtgcttttctgatggctcatgtgatctttggcttgggctgcatttcagatactctgagtatttgaaccctgggccaggcagttggcaggtggttgcgtgatctgatcttagaggacattgctttggaatgcattgatttgaggtgcgttagtatgcactctgtgtgcccacaggttgcacctccttgcagggttgttcctggggaattgccagacctctattttttcccatttggagataccacatactcattaaagagaatttggaaaatacagaaatgttgaaagagcaggggaaatcacctatactattacccaaggttgaccactattgatgtttttacgtgtgtctttatttttatataattgtgattgcatgcagtgattcaattttgtaaactgctttttcatttatgataagcattttccatgtcattacagagcctcggcaaatggcatttaaaaagatgggctagtatgtcgggcctttcttaatcaaatcatacatatatgaatttggtcatagacagagatgtctacaagagccagccaggaagtataaatgagcaaagcatgctagatatgaaacaggagatagtggggttggggaagattcctattgctgccacttggggttcaggtcaagggctgtcagatattcccatgtttccagagaagtggatttttttttttaatatgaaattgttaggccgggtgctgtggctcacgcctataatcccagcactttgggaggctgaggcgggcagatcacctgaggtcaagagtttgagaccagcctgaccaacatggagaaaccccatctctacttaaaaaaatacaaaattagctgggcaaggtggcgcatccctgcaatcccagctacttgggaggctaagcggggagaatcgcttgaacctgggaggcggaggttgcagtgagccaagatcatgtcgttgcactccagcctggacaagagtaaaactccgtctcaaaaaaaaaaaaaaattgttgtttttttgaattaaaaaaaaaaattcaggcctggtgcaatgtcacaccagtaatcccagcactttggaagtccagggtgggtgggtcacttgaggctgggagttcgagaccagcctggccaacatggcaaaaacccagccctacaaacagatacaacaattaattgtgcatggcggcctgagcctgtaatcccagctactcaggaggctgaggcggaaaatcgccagggaggcggaggttgcagtgagctgtgattgcgccactgcactccagcctgggtgacagagtgagactctatctcaaaaaacaaacaaaacaaaaattcagagaataatataagaaatagaatcagcaaagtaagggaaatgttataaagcttgaaaccttcctgtttttgttttttaagagaaaggataaagtattacagataaagttgaaatatccttcccatctctactcccattatccatacttcccattgcccagtttgggcagccactgtcataaattgttatatatccttctatctcccctcccctcccctcccctctcttccccttcccttcttcagagacagggtctcactctggagtgcagtggtacaatcgtgactgactgtaacctccacctcctgggctcaagtgatccttccacctttttggagtagctgtaggtagtaggccaccacactgggctaattttcatttcttgtagaaatagggtcttgctctgttgccctggatggtctcaaacttctgaactcaagtgatcatcctcctacctcagcctaccaaagtgctgcagttacagaggtgtgagccactgcacccatcctatcccactttttagtacttatacatacataaatgcaaatccatgagcaccgtatttttttgtaaattcctaatcgtaactgtcactctgcagctttgtttctcactcagcctatttatttatccatgttaaatctgtaaccctaattcagagattggcaaacactttctgtaaaaggccagatagtaaatattttagtattgtagtccatattgtctctattgcaactactcaactctattcacctctatagttaatgcagcagtagataatatgtaaactaaggaatattgctgttctaatataactttgtttacaaaaccaggctctgggccagatttgtatcctggactgtaatttgctgacctctgctctaatttattccttataacttgtaactactgaatggtgtgtgtgtatatatatatatatatatatatatttttttttttttttttttttttttgagacagagtcttgctttatcacccaggctggggcacagtgtcgcaatctcagctcgcttgcaacctccgactcttgggttcaagtgattctcgtgcctcagcttcctaagtagctgggattacagcgcatcgcagcatgccctgctaatttttgtattttttagtagagagagggtttcgccatgttggccagggtggtttcaaactcctgacctcagatgatcctccggcctcagcctcccaaagtgctgggattataggcgtgagccaccacacccagccatattgtctataatatgaatatatcatattttattattcaattcccctataaatggatgtctaggttgtttctagattttttttgtttgttttttgggacagggtcttcctctgtgactcaggctggagtgcagtggtgtgatcctgacttgctgcagtcttaacctcctgggcttaagcaatcctcctgcctcagcctcccaagtactgggactataggcatgtgtcatcacgcctggctaatttttaaagatggggtctccttctgttcccaggctggtctccaactcctggactaaggcaatcctcctgccttgtcctcccaaagtactggggttataggtgagagccgccacactggcctgttttgttttgttttgttttgttttgttttgttttgttttgtttacagatagtgtctccctctgtcacccaggttggagtgcagtagggctattatggctcactacaacctccaactcctggactcaaggtatcctactgcctcagcctcccaagaagctgggactacaggtatattctaccacacccagctatattttttaaatgtaaattttttttttgagacagagtctctctctgtcgcccgggctggagtgcagtggtgcgatctccactcactgcaagctccgcctcccaggttcacaccattctcctgcctcagcctcccgagtagctgggactgcagtcgtccaccaccacgcccccaattttttctgtatttttttagtagagacaggatttcaccgcgttagccacaatagtctccatctcctgtccttgtgatctgcccacctcggcctcccaaagtgctgggattacaggcgtgagccgccgcacccgctgatttttaaaaatttttttgtagagatggtctcactatgttccccaggctggtcttgaactcctggccacaaagaatcctcccacctcggcctcgcagagtgctaggattacaggtgtgagccactgcatccagcctgtttctagtttttctactgtgataaccatgctgcaggaagcaatcttgtccatgttttcttgtgcacatatgcaaagctttttactaggatatacatagatagagaagtggaattgctgaggattttgttgttgttgttgttgttgttgttgttgtttatttttacttttggaaacagggcaagacctagcaccaggctggagtgcagtggtgcaatcatggctcactgtagccttgacttgggcttacgtgatcctctcgcctcaatctctcgactagctaggaccacaggcaagcggcaccatgccctgctaatttttaaatttttggtggagatggaggtcttcctatgttgcccacgcttcatggtcttttttttttttttttttttttgagacagagtctcactgtcacccaggctggagtgcagtggcgcaatctcggctcactgcagcctccacctcctggattcaagcaattctcccgcctcagcctcccaagtacctgggactacaggcacatgccaccacacccagctaattttggtatttttagtagagacgaggtctcaaactcctgacctcaggtgatacgcccgcctcggcctcccaaagtgctgggattacaggtgtgagtcactgtgcccagcccatgttttatttatttatttatttatttttgagacgtagttctgctcttgtcaactaggctggagtgtaatggcgcgatctcagctcactgcaaaccctgcctctgggttcaagcaattctcctgcctcagcctcccgagtagctgggattacaggcgcccaccactatgcccagctaatttttgtatttttagtaaagacggggtctcaccgtgttggacaggctagtcttgaattcctgacctcaggtgatccacctgcctcagcctcccaaagtgctgagattacagatgtgagccaccatgccaggcccatgttgttttaaataccaggtgggccaaatgaaatgttttagatagaatgtaaccagtttgtgacctctctcttacgctttccataggaagccaatagttactgagaatccaattcatacctagttctggactttgaggtgagactctatgacagctagcaaggtgaggatgcgtgaatctaaacacaaaagagttggagaacggtctggaagagtgtgactgccgtgacaaatgtgcatctgatttcctcagcagataaaagagttgaggttggggaattactcaatttttcatgttcaataaccattcaaacagtgggtgttaacattgaatgacaagttctagcagaaaaggtcttcaggatgaaggcgatgagctgctgatctgtgcttccttctttcctggcaattctgtgagtttctttaaagatttatcactctaattagacccactggaagaataacaaaggtaataaagaaagagtatcagggcatccttccaagaaaactctctcctttgaggaagacccagaataagattttaagccttggtggcaggaaattaacttagtccattttcctgaaagaatatgtcaataatacatgactagttcagtctagctgggtgagttcagaaaagaaatggtgttctgtgttcagagttgaggagatttaattaaggggactcatgctttgggaattccttcctttttaaagatttttaagattaatgtaggtcattatcattcctttgtttctatcattttggagagctcaaaaaatatatggagctattacaaagcagctgaacctcaaggtcagcttgctgcaggctttctttcttctttcataggcttggagccccattgttttgacaggtaaaagtcggacagctccgccttctcagaagtctgtaatgcagaagaatcagtcctctgcactgacctgtctccctgtcctgccctgccattctgtttctcttactctatcaggtctaggatcttgtctggcaggctcgtgcactgaaacagaggtcttcccagaggatatcaggggctgggattttccctttgcacctagatcagctttggcaggcgtctgttgaaatggagggagagacaggccgtagctcatgagccattcccctgaaatgaaaagacgcaggaaactggccattctaacatctgtctctttcttcccatctggcaaaattctaatagcatgtagaagaagtttgtccaacccgcggcccaggatggctttgaatgtggcccaacacaaatttgtaaactttctttaaacattatgagattttttttgcaattttttgtttaactcattaaccatcgtagtgttagtgtattttatgtgtggtgtggctcaagacaattcttcttccagtgtggcccaaggaagccaaagattggacacccttgatctagaagataatgactacattcctgaagggcttccttttgcatagttttctttacacggcttgagatttagttcttattgaacatcaattaggtatttagatctcaatttaatctgaattttttttaggatgattgttacaaactgaacaatagaaatgttattttagagtgggcgctgtggctcatgcctgtaatcccagcactttgggaggctgagtggggtggatcgcctgaggccaggagttccagaccagcttggccatcatggtgaaaccccatctctactaaaaatgcaaaaattagctggacctggtggcgggtgcttgtgatcccagctacttgggaggctgaggcaggagaattgcttgaacccgggagacgcaggttgcagtgggccgagatcatgccactgtactccagcctgggtgacagagcgagactccgttaaaaaaaaaaaaatgttaatttaggctgggtgcagtggctcaaacctgtaatcccagcactttgggaggccaaggcaggtggatcacctgagatgaggagtttgagaccagcctggccaacatctctactaaaaatacaaaaattaaccatgtgtgttggtgggcacctgtaatcccagctattcgggaggctgaggcaggataattgcttgaaccttggaggcagaggttgcagtgagccaagattgtgccattgcactccagcctgggtcacaagagcaaaactcagtctcacaaaaaaaaaaaaaaagaaagaaaaagaaatgttattctagtgatgtttaatgcataaaattaggcctcatccttaatctctggaatgaccccctgacaagggttttggatgaatctgtattgttattttaatctagctttgtattagtttacaaagtacttccacccttataagcacctcttagtctcataatcatccataagaaagaagaattatacctattttttcagatttacagaaaacgggttcagagagggtaagaggtcttctggatttcttcattctagacaacaatattttattacatgtaacaactagaagaaatatgaaaagcaactttttgtgtttccacttgcttagcagcagaacagtctgtgaagggcagtgggggaatatgttgatgctgtctatttattaagccacagcatatatgcccaagtggcccatcactgcttcaccttctcccaccatgggagaatggcaggaaataagtcattctcacaactaaaaagaatactgctgtcattgttctgcatattttttaaaaattgcaattgcatatatcctttgattcagcaattccacttctaggaattgatgcttacagatacactttcccacacatgaatgattgtacgtcctaggtttttcacagcagaatatcagaaacagctgaagtgcatctgcagcagtgacataaattatggtgcatgcatgcagtagagtatgatgctgctgttgcagagaataaagcagctctgtatttaccgagggaatgaactccaaggacactgtttattattgtatataatatgtttgtgtaaaaagggagaggataaatgtgtattaatacatatttgcttatgtatcaatgatttaaaatctaataacacttgtctgtgagcagcagaacagggtggctagagagcaggtcacagagagagagagagagagagagagagagacctgtcactgaagagccttttgataaaaaaaaacagccaggcatggtggctcacgcctgtaatcccaccactttgggaggctgaggtgggtggatcacctgaggtcaggagttagagaccagcctggccaacatggcaaaaccctgtctctactaaaaaaaaaaaatacagaaattagccgggcatggtggtgggtgcctgtagtcccagctacttaggaggctgaggcaggagaattgcttgaacccaggaggtggaggttgcagtgagccgagatcgcaccactgcactccagcctgggggacagaggggagactctgtttaaaaaacaaacaaacaaaaaaaacccaaaaaaacatgaattacatgtttttaaaaatccctgcacttagtcaggtgtggtggtgtgcacctatagtcccagctacttgggaggccgaggtgggaggagatcacttgagcctgggaggtcaaggctgcagtgagctgtcatcacgccactgcacttcagcctgggtgacaaagcgagactgtcttttaaaaagaaaatttaaaaatccctgcactgagatttataggagtttggggtcctcatatataccggtaaagtactctgacctgcttactacctacccccacccaaaggacccatttaatcctttcttctgctccctgagttttccagcaccaaatgaaactctgtctctttttgtttttactttataaaattttaacactcccccacctttttttttttttttttttttttgtgtgtgtagatggagtcttgctctgtcacccagactggagtgcaatggcacaatcttggctcactgcagcctccgcctcccaggttcaaacaattctgctgcctcaagtagctgggattacaggcacatgccaccatgcccggctaaatttttgtatttttttttttttagtacagatggtgtttcaccatgttggccaggctggtctcgaactgctgctcaggtgatctgccctccttggcttcccaaagtgctgggattacaggtgtgagccaccacacctggctccattttcttatttgcattccaattctattaaatttattgattgattttgtatttttagtagaccatggtggcaggtgcctgtaatcctaactattcgggaggctgaggcaggataattgcttgaacccaggaggcagaggttgcagtgagccgagatcacgccattgcactccagcctggtcaataagagcaagactccatctgaaaaaaaaaaaaaaaaagaaagttattgccgggtgcggtggctcatgcctgtaatcccagcactttgggaggccgaggcaggccagtcatgaggtcaggagatcgagaccatcctggccaacatggtgaaaccccatctctactaaatatacgaaaaagattagctgggcatggtggcatgtgcctgtaatcccagctactagggaggctgaggcaggtgaatcgcttgaaccagggagtcggaggttgcagtgagccaagatcacaccactgcactccagcctggcaacagagcaagattccgtctcaaagaaaaaaaaaattattgattgaatgagtgctttttatgtaatgcattataccacatccttatttatttgcacacattttgcacaagccagtttttattaatgattgtgggattgaaaagtattattagcacaagctaggaaattctaacactacaaatgagtatactgtgaaaagtttttcctctttttttttttttttttttttttttttgagacggagtctcgctgtgtcaccaggctggagtgcagtggtgcaatctcggctcactgcaatgcaaccgccacctcccgggttcaagcaattctcctgtctcagcctcccaagtagctgggactacaagcttgcgccaccatgcccagctaatttttgtatgtttagtaaagacggggtttcaccatgttggcccagatggtcttgatctcttgaccttgtgatccacctacctcagcctcccaaagtgctgggattacaggcgtgagccaccacgctcagcctttcctctctctttaggcttctgagtctcctgggcccatagttcccgtgctaaagctgctactgttactacctttagaagtatacttctaacaatattgtattcatatcaagcatataacatgcatatatccccccttttcttatgtaatgtttgttttttaaatagagtttatttttagagcagtttcaggttcccagcaaaaataagcggaaggtacacagatttctcacatacctctgcctccacacatacaaagcctcccccattatggacatctcctaccagagtggtacgtttgttataagcaacagacctgcattgacacattatcacccaaagtgcataatttacattaaggttcattcttggtgttatagcttccatttttcacactatgtaaactatactgtacacactgtcacctacttttttcacttaacaacatatcttggtataggattacatttagattaccaccttctttttaataactgcataggattccacatatatggaatatatttaatttaatcagtctcctcttgatgggaacccgggttgctcacaatctgttgctcccacaataaatatccttatgtatatgtcattgtttaaaatctgtatctctaggataaattcttagcagtacaattgctagttcaaaaagtatatgcattttaaatgttgatgggtaggtccaaattgctctacccagaggttgtagtatttcaacaggttatagtagttcaagagaatataagactttttttcatttgtttaagaaaaggtttttttgggaggccgaggtgggtggatcacgaggtcagaagatcgagaccacagtgaaaccctatctctcctaaaaacacaaaaaattagctgggcatggtggcgggcacctatagtcccagttactcgggaggctgagacaggagaatggcatgaacccaggaggcggagcttgcagtgagccgagatcgtgccactgtgctccagcctgggtgacaaagcaggactctgtctcaaaaaaaaaaaaaaaaaaggaaaataaaaatagtgaccagcctgggtggctcacgcctataatcctagcactttgagagaatgaggtggagggatcccttgtggccaggagtttgagaccagcctggccaacatggcaaaaccctgtctctactaaaaatacaaaaaattagccgggcatggtggcaggtgcctgtagtcccagctacttgggaggctgaggcaggagaatggcatgaattcgggaggcagagcttgcagtgagccaagctcacaccactgcactccagcctgggtgacagagcgagactccgtctcaaattaaaaaaagggtttcattctgttgtgtaggctggagtgcagtgacacgatcatagctcactgcagccttgaactcctgggctcaagcaatccttcttcctcagcctcctgagtagctgggaccacaggcacacatcaccacccctggctaatttttatttttgtatttttattttactgtatttattttgaaacagagtcttgctctgtcctccaggccagagtgcagtggcgcagtcttggctctctgcaacttctgcctcctaggctcaagtgattctcgtgccacggccccctgagtagctgggattacaggtgcccaccaccacgcccagccaatttttgtattttttgtagagacagggttttgccatgttggccaggctggtctcgaactcctggccacaagggatccatccacctcgttctcccaaagtgctgggattacaggcgtgagccactgagcctggtcattatttttattttactttttttttttttttttgagacggagtctcgctttgtcacccaggctggagcgcagtgccaggatctcggcctctgcctcccaggttcacgccattctcctgcctcagcctcccaagtagctgggactataggcgcctgccaccacacccggctgattttttgtatatttagtagagatggggtttcaccgtgttagccaggatagtctcgatctcctgacctcgtgatccacccgcctcggcctcccaaagtgctgggattacaggcatgagccaccgcgcccagccgcttattttactttatttttaagatagagtctcactctgtcatccaggctgaagggcagtggcgtgattgcggcttactgtaccctcaacctcctgggctcaagcagtcctcccatctcagcttcccgagtagctaagactacaggcatgagccaccgtgtgcagctaattgttgttggtattttttttttttttttttggagagatgggggctccctatgttgcccaggctgatctcaaacacctgtactcaagtgatcctctggcttcagcctcctaaaatgctgggattacagatgtgagctactgtgtacagcctaattcacaaattttttggagacaggatcttgctgtgttgcccaagctggtctcaaactcctggtctcaaggaatttccctgcctcggcctcccagagtgagacccagacttaaaagatttccagctgcctcagcctatagcataagatcagatattgattgagaggaggatgggctagccaacaatactggtggactgcagttttttatttttaccactgaagctggttaagatcctgtgaggaaatatacagtgtagtaaagttatcagatatggctgtcaggttagcaagatgaagactatttaggtgtgtcagcttctgtcaggcaggctgcaatgacaacggtactgtgcttatttacttttgctttttctctaggaccgtagcatcctgagacattttgaattgacacttctcaagatttgactggatcagagttcatcatgtcaaagttgaaaagctcagagtcagtcagggtggtggttcgctgtcggcccatgaatggcaaggaaaaggctgcttcgtatgacaaagtggtggatgtggatgttaagctggggcaggtgtctgtgaagaaccccaaagggacggcccatgaaatgcccaagaccttcacctttgatgccgtctatgactggaatgccaagcagtttgaactgtacgatgagacgttccgaccacttgttgactctgtcctgcaaggtttcaatggaaccatttttgcctatggacaaactgggacaggaaaaacctacaccatggaaggaatccgtggtgaccctgaaaaaagaggagtcattcctaactcatttgaccatatcttcacccacatctctcgatcccagaatcaacaatacctggtcagggcttcttacttagagatctaccaggaggagatccgagatttgctctcaaaggatcagaccaaaaggcttgagctcaaagagaggcctgacacaggagtgtatgtgaaagacctgtcttcctttgtcaccaagagtgtgaaggagatagagcatgtgatgaatgtggggaaccagaaccgttctgtcggtgctaccaacatgaacgagcacagctcgcgttctcatgcaattttcgttatcactattgagtgcagcgaggtgggcctcgatggtgaaaaccacatccgtgtaggaaaattgaaccttgtagatcttgctggcagcgaacggcaagccaagaccggcgcacaaggggagagattaaaagaagctaccaagatcaacctctccctttccgctttgggtaatgtcatctctgctctagtggacggcaaaagcactcacattccatatcgggactcaaagcttaccaggctcctccaagattcccttggtggcaatgccaagactgtgatggtggccaacgtggggcctgcctcttacaacgtagaagagactctgaccactctgcgatatgccaaccgtgccaaaaacattaagaacaaaccaagggtcaatgaggaccccaaggatgccctccttcgagaattccaggaagagattgctcggctcaaggcccagctggaaaaacggtccattggtaggaggaagaggcgagagaagcggagggaaggtggtggcagtggtgggggtggggaagaggaggaggaggagggagaagagggtgaggaggaaggggatgataaggatgattactggcgggaacagcaagaaaaactggagattgagaagcgggccattgtagaggatcacagcttggttgcagaggagaagatgaggctgctgaaggagaaagagaaaaagatggaggacctgcggcgggagaaggatgctgccgagatgctgggcgccaagatcaaggtaccatacccgtacccttccttaggcccttgccctgtcactgcttttgctttcatcaaacaacaacaaaaaacataaccatatgagggatgatgtctctcatcagttttggatttccaacagctcatgatatccagtactcagtaaacctctgtttaattgacatgaatatgattttttcacatttacaaaaatgaaaattgaattcataatgagaataattattatgtatgcacatagtataaagaacagcaataaaagtaacacccacgtacccccccacccagtgtaagaaatagaacaacatccatttttctttttttttttttttttgagatggagtttccgtcacccaggctggagtgcagtggcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggnnnnnnnnnnnnnnnnnnnngtttaattgacatgaatatgattttttcacatttacaaaaatgaaaattgaattcataatgagaataattattatgtatgcacatagtataaagaacagcaacgcctgtaatcccagcactttgggaggccgaggcgggcggatcacgaggtcaggagatcgagaccatcccggctaaaacggtgaaaccccgtctctactaaaaaaatacaaaaaattagccgggcgtagtggcgggcgcctgtagtcccagctacttgggaggctgaggcaggagaatggcgtgaacccgggaggcggagcttgcagtgagccgagattgcgccactgcactccagcctgggcgacagagcgagactccgtctcaaaaaaaaaaaaaaaaaaaaaaaaaaaaaaaagaacagcaataaaagtaacacccacgtacccccccacccagtgtaagaaatagaacaacatccatttttctttttttttttttttttgagatggagtttcactctcgtcacccaggctggagtgcagtggcgcgatctcggctcactgcaacgtctgccatccgggttcaagtgattctcttgtctcagcctccagagtacctgggattacaggtgcctgccaccacgcccggctaagttttgtatttttagtagagatggggtttcactatgttggcctggctggtctcgaactcctgacctcaggtaatctgcctgtctcagcctccccaagtgctgggattacagacgtgagccaccgtgtccggcttttttttttctttctttcttttttttttttgagacaggatcttgctctgtcaaccctggagtgcagtggcccaatcactgcagccttgacctcctaggctcaaaggatcctcccacctcagcctcccaagtagctaggactacaggcacgcaactttgcctggctaaattttttaaattttttgtagagacatggtctcactatgttgttcaggctggtctcaaactcctgggctcgaatgattctcccacctccccctcccaaagtgctgggattacaggcgtgagccactgcacccagctgatacctatatctttagtagctccttgcgtttccctccccaacagataaccatcatcctgaattcggtgtttattgtttccttgcttttccttatagttttactttctacatgtatatttctaaagaaaacatggtttcgttttcatataattttttgcttttatgtaaatggaatcccactcatgccatttgcttttatttttgcaacattacgttcatgagatttatccatgttgatgcctgaagctgtggttcactcattattactgttccaagtattccatggtattccattctcctggtgtatgggttgtttccagtttctgctgtgaatgctcttgtgcttggcttcaggagaacatggacgtgcaagattgtcttgtttggcactgttaggtcttagggtatttgcagcttcaacttctctagacaaggacaagttgttttctaaagtggttgtgcagattgaaacacctcgcagcagggtatcagttctggatgcccctcatccttaccagcacttgtgatgatcagactaacatttgcatatagtatagcctctcagtgcagtttcagtatgcagtaccctgattacacaagataaggaacacttccatcacccccaaaatgtcctcatgctactttcttatagtcagcctcctctcccaacccctgtgtgctaatatatttctttacatccattccattttccacccaatggctagttagcattctggagtgctgaggctcccattgttttgagccttctttctggtggcaatgcactatgcctgcagttgcctggactctgagcttccactgggctttaatggcagaggagagtgcaaaggtagacttggaaggctgaggatggccactggctaaccacaaggcagaattccttggaaatgttcagttctgttttattgaattcatgcaaactttgatttctatcctaaaatgtctccatgtttataaattttaaaattacaagttatctttgcctccctcctacccctactgtatgaagctgtactgtttttttgtttgtttgttttaatcagtggcttcatagtagccctttcacagagctgggtgctattttacttcagaggcagggttttaaaaccttgaaagtcccttctagcacttttaagacctgatgtgaaaatggagtcgtatacaacacaattaggaggtaactttgttccagggaggggttctgagatgccattatgtcaaagcacttcatgccttctcactgctgcacagtaagcgcgactggctgtgcccatattttgttttgttttgttttgttttgagaaagggtctcactctgtcacccaggttggagtgcagtggcgtgatcttggctcactgcagccttgacctcccaggctcaagcaatcttcccacctcagccttcgagtatctgggactacaggtgtgcactgccatgcccagctaattttgttgattttctgtaaagacaaggtctcactatgttgcctaggctggtcttgaactcctagactcaagcaatccttccaccttagtctcccaaagtgtcaggattacaggcgtgagccaccgcacccttatgtccggcctgggtatgcccatatttgacttgcatactgtcttttaggatcagatctgttattcaaggccaggagcacctagattctctaaacaacccctcagagaaagttgaactctcagaggctgagtctgcaagattcagcatcatcttaaggtcactgcatctcttagacattttgactatggagaatgacattatttctgtctttctcaatccctggatgctgtgaaatcataaaagaatgttagaggctgggcgcggtggctcacgcctgtaatcccaacactttgggaggcccaggcaggtggatcccttgaggtcaggagttcaaggccagcctggccaacatggtgaaaccctgtctctactaagaatacaaaaattagctgggtgtggtggcatgcacctgtagttccagctacttgggaggctgaggcacgagaattgcttgaacctgggaggcagaggttgcagtgagccaagatcatgccactgcactccagcctgggcgacaaagcgagactccatctaaaaaaaaaaaaaagaatgttagagtggttaggtattgttaggtatgtatgtggagtttagcaatctagtccagccccttcattcgagaggtgaggaaacaggctcagaggactcactgaaagatggcagcagagctccagtgaggtttataagtttcttaaaagttgtgcagttttggggtcccatactttttaggtcaaaatcattctcatggcttcagcccctatcaaaatgctgaaggctcccaatctgtatatctagcctagcactgtctcctgccatccaggcccattgtatgtctagcctagcactgtctcctgccatccaggcccaataaccttctgcccactgggatgctcacagccactcagagcctgctcttgccttccttatctcagggaagccagacccctgggagttatccttgccagcagccactccctctcacttacagccaggccgtcccaaagcctttggatcctgcctcatcagggtctcttggactcatctactctgccctccccaactagggaggaggcctagcccaggcctagacccctgcagtggcttcctgtcatgtctccctccatcctgccagtcctttgccatgcttcccattgcaggggagtaatgtttctaaaacacacatctgattgtgtagcctcatgctcaaaagaatatgtcagtggttccccgaacttctcaggatcaagaagtttagtctccttgacagggatttaggtcaacttcatcacttcccaccttcccctcacaaaacaatctttttttcttacctaattcctattttttaacttcagctgtctgtgtatctggccctgcagacagaaagctttctctgactccctctaaaagtctgaattctctgactgggcgctgtgctcatgcctataatcccagcagtttgagaggccaaggcagaggatctcttgaggccaggaattcaagaccagcccagacaacatagcaagatttcacctctacaatcaatcagtcaatcaaccaatcagccaagtgtggtggtgtacacctgtagtcccagctgcttgggaggctgaggtgggaggattgcttgaactaaggaggtcaaggctgcagtgagctgtgatcgtgccaccgcattccagcttgggtgacagaactagaccctgtctttaaaaaattttaaaaaatccccacagagtctgaattctatcccatcagtgtgcctctcccatgaattactgtgtcctttcctcatgatggcatctggcgccatatggttaaagcctgcttgcttgtctgttttcctcagtggactcggagctttgtgattcacactcacattgcatccccaggacctaacataaagggtctgcttaatatgttctaagtggggttaatactttgtagaaacaagcaaaaaaaaaaaatttgttaaagctgaaattcatgtatctgaagaaactgtatcttcagtgttaccaagaagcctctagtgaagctgccccagtccctcaccagtgatggatgggcacagctgagcacagtgtattttttcccagagtttgtcccttttggctcagtcctgagctctttatctttcacaggctcccctgtgaggaattatgttctgagagaaaccgttcatgagatggattctactttgtttctcactcaggccatggagagtaagttgcttgttggaggaaaaaatatagtagatcatacgaatgaacagcagaaaatcctggagcagaaacgacaggaaattgcagagcaggtaacttttcattctttttcagggagaatgggtgaggtaaggtgtgtttatgctgcagagcaaacgtctcatattagactctcttcaaagagaatgagagcaaggtgtgtctgcctcatcctagctggagactctgatcctagcttggggaacccagcatagacacagtctctagggcaagctgatgaattttgtcatgttgctcagaaacgtcgagaaagagaaatccagcaacagatggaaagtcgagatgaggagaccttggaacttaaagagacatacagctcattgcagcaagaggtggacatcaagaccaaaaaactcaaaaaggtatgaaaggaatgaggccagatggagttgccttgagacttggggaaagggagaactctaccctttggacagacaccctcctcacctgcctctcccctcattccagctcttctccaagcttcaggcagtgaaggctgagatccatgacctccaagaagaacacatcaaggagcgccaagagctagagcagactcagaatgagctcaccagggagctgaaactcaagtaagtgccaggccttccatagtgcccccaagccacttgctgagtcattgatctcgtttgtttagttagaaacagccctggctgggcttggtggcctacgcctgtaatcccagtgttttgggaagcggaggcgggcagatcacctgatgtcaggagttcgagaccagcctgaccaacatggtgaaaccccgtctctactaagaaatacaaaaattagctgggcgtggtggtgcatgcctgtagtcctagctacttgggaggctgagataggagaatcgcttgaacccgggaagtggagattgcggtgagttgatatcgtgccactgcactccagcctgggcgacggagtgagaaaaaaacacaaaaaaagaaatagccctgaggacaggtccttctccagctcatctcctgccaccccatgttctgttcattcctgaaaaagtcactttccatctctggatcccatctgttaactgaatgacttcatcaggtgatctccaagttcccttctaaccctaccttctcgaagcttttaaagattctggtcttacatctgtctgatgataagagggaatattttattaacttgactttttattgtgacaattttctgaatggtataataaatacccaagtacccatcacccagattcaaggattaacaagcttttgccatctatctttcacaaaaatattttaaagcaaatcttaacctcatgttatctcactcctacatacttatatatatatatatatgatcacagtggttttttttttttttgagacagagttttgctctatcacccaggctggagtgcagtggcacaatcacagttcacagcagcctgtaacttgtgggctcaaacagtcctcccaccttagcctcccgggtagctggaactacaggtgtgtgccactatgcccagctaatttttaaaaaaaattttatagagatagagtctctctatgttacctaagctgatctcaaactcctaggctcaagcaatcctcctgtttcagcctcccaaagtgctgggattataggtgtgagccaccacacccagcccacaatactgtttttaaaaaagcttaattgagacatacttcacataccatacaattcacatatttaaagtgtacaaatcagtccgggcatggtggctcatgcctgtaatcccagcatttgggaggccgaggcaggtggatcacctgaggccaggagttcaagaccagcctggccaacatggtgaaaccccgtctctactaaaaatccaaaaattagctgggtgtgatggcgtgtacctgtaatcccagttactcaggaggctgaggcaggagaatctcttgaacctgggaggcggaggttgcagtgagctgagatcacaccactttactcaagcctgggtgacacagcgagattcttgtctcaaaaaaaaaaaaaattaaaaaatgataaagtatacaaatcagtgtttttttaaaagcatatatatgcatagggctataaaaccaccactacaatctaattttagaacatttttattactctcctctaaaagaaactctaccagttagtagtcactcctcattaccccctttcccaacccgaagtaatcactaatctgcttcctgtctctatggctttgcctattctggccatctcatataaatggaatcacacactgtgtggcctttttggcctggtgtcttttgcttagcatgacgctttcaaggatcgtccatgccgtagcatggatcaacagatatctggtagtcccaacatcaattgttctttattatgactgaataatattgcactgtatgaataggacacatatttatttatttttcagtttatatacattccgattatttctagtctttggctattatggataatacttctataagcattcatgtataaggttttgtatggatgtgtgttttcatttctctgggatacattcataggagtggaattgctgggtcatatggtaactcagtgtttaactttttgagagaatgccaaactgtttgccacagtggctgcactattttacatttctaccaccaatttctccacatcttcttttttttttttttctttgagacagtctcgttctgccacccaggctggtgtgcagaggtgcagtctcagcacactgcaacctccacctcctgggctcaagcgatcctcccacctcaacctctggaatagctgggactatagcggcatgccaccctacttggctaatttttgtgttttttgtagagatggggtttcaccatgttgcctaggctggtctcaaactcctgggctcaagcagtctgcccgacttagcctcccaaagtgctaggattacaagtgtgagccaccatgcccggcctctccacatccttgtcgacacttgttatttcctgtctcttttatcatagacatcctaacgagtgtgaaatggtacttcattatagttttgatttgcatatttctctgatgactaatgatgttgagcatcctttcacgggcttattggccatttgtatgtctttggagaaatatctatacaaatcctttaccccattttaaaatggggttgtttcatatatatatatgtatatatttcgtatatatatgaaatatatatatttcatacacacacacacacacacatatgtgtatatatatagtttttttttgttttgtttttgttttttttttttttttttttggagttggagtctcgctctgtcatccaggctggaatgcaatggcgtgaacttgactcattgcaacctctgcctcctgggttcaagcgattctcatgcctcagcctcccgaatagctgggaatacaggcacccgccaccatgcccggctgatttttgtatttttagtagagatggggtgtcaccatgttgcccaggctggtcttgaactcctaacctcaggtgatccacctgccttggcatcccaaagtgcttggattacaggcatgagccaccatgtccagccaataattaagttttaagagttttttttgagacagagtctgggtctgtcacccaggctggagtgcaatggcatgatcttagctcactgcagcctctgcctcctgggttcaagtgattgtcctgcttcagcctcccgagtagctgggactataggcatgtgccaccatgcccagctaatttttgtatttttagtagagacggggttttaccatcttggccaggctggtctggaactcctgacctcaggtgatccacccgcctcagcctcccaaaatgctaggattacaggcgtgagccactgtgcccggctgagttttaagagttctttatattaatatattatgaataccactttctcatgagattcatgatttgaagatgctttctgttattctgagttgtttttaaactttcttgatggtattacttatagcacaaaagatttccgttgtgatatagcccaatttaattgtattttcttttgtttattttacttttggtattgtatctagatttgccttttctggacctttcatataagtttataaatgaaataatgttggaataatgtggccttttgtgactgctttcttcatatgtgtgtgtgtgtgtgtgtgcatgtgtgtgttttgttagtttttttttttttttagagataaggccttcttctgtcaatcagactggagtgcagtggtgccatcatagctcacagccttgacctcttgggttcaagtaatcttcctgcttgagcctcctgagttgctaggacttcagttgcatgctagcacacctggctaattttttaaaattttttcataaggatgggtcttgctgtgttgccaaagctagtatagtgttttcaacagtcttccatgttgtagcatgtatcaatactttattcattttttatgaccaaataatattctgttgtataaatataccacattttatttatccattcattatttgatggacatttgggttatttctacttttgggtgttatgaataatgctgctgtgaacattcatattcaagtttcttttgtggacgcatgtttcattctcttagatcctctaagaggcttatagtgttaggtcttacatttaggtctatgatccatttgagttaatttctgtgtatggtatgaggtagggtttcaagtacagtgttttggatgcagatatctagttgttccagcaccatttgttgaaagggcttttctctcccatttcattgtcttggcatacttattgaaagtcagggccgggcgctgtggctcatgcctgtaatcccagcatttgggaggccgaggtgggtggatcacctgaggtcaggagttcgagatcaccctggccaatatggtgaaaccctgtctctactagaaatacaaaaattagccaggtgtggtggtgcacacctgtagtcccagctactcaggaggctgaggcagaggaatcccttgaacctgggaggtggaggttgcactgagctgagatcatgccactgtactccagcctgggcaacagagcaagactctgtctcaaaaaaaaaaaaaagaaagtcagttgaccgtaattaagcatttatttatttatttctggactttcaatactgttccattgttctatatatctatcctcatgctagtaccattctgtcttaattactatagctttgttagttttgaaatcaggaagtgtgagtcctccagccttgttctttttcaggagtgttttgactgttcagggtcccttgcatttccatattcaaacatactttgttttactgcactctgctttgttataattcacagatattacattttctacaaattgaaggtttgtggaaaccctgcataaagcaagtctgttggcaccattttttcaacagcatatgctctcttcatgtctctgtgtaagcatttattagcaataaagtattcttaaagtctatactttttgtagacaaaatggtattatacatttaatagactacagtatagtgtaagcataacttttatatgcactgggaaaccaaaaaattgtgttacttgctttattgtgatacttactttattggagtagtctggaaccaaacccacagtatctctgaggtatgcctctacattttaaggtcagcttgtcaatttctgcaaacaaagccagctgggattttgatattgatcacattgaatctgtagatcaatttgggcaatattgtaatcttaacagtattaagtattcagatccatgaacatgagatgtctttccatttatttattatttctttaatttttctcgagaatgttttgtagttttcagtgtataattcttacacttttgttaaatttatacctaagggttttttgggtgctatggtatatgacattgttttcttaattttatttttggaatattaattactagtatataaaaatactggctgggcatggtggctcacacgtgtaatcccagcactttgagaggcccaggtggacggatcacctgaagtcaggagtttgagaccagcccggccaacatggtgaaaccctgtctctacaaaaatacagaaattagccaggcgtggtggcgggtgtctataatcccagctacttgggaggctgaggcaagagaatcgcttgaaccctggaggcggaggttgcagtgagccgagattgcgccattgcactccagcctgggcgacagagcgagaatccgtctcaaaaaaaaaattttatatatttatatatatttatatatatatttttatatatttatatatatatttatatatttatatatatttatatatatttatatatttatatatatttatatttatttatttatatatatttatttatatatatatttatatatatttatatatatatttatatatatttatatatatatttatatatatttatatatatttatatgtatatttttatatatttatatatatttatatatacatattcatatatatttttatatatttatatacatattcatatatatttttatatatttatatatacatatttatatatatacatatttatatatatacatatttatatatatacacatatttatatatacatatatttatatttatatatatttatatttatatatttatatatttatatttatatatatttatatttatatatatttatatatttatatatatttatatttatatatttatatatatttatatatttatatttatatatttacatatatttatatatttatatttatatatttatatttatatatttatatatatttatatttatatataattgatttttgtctacacaatgatatttttatacctaaaaaaattaagtttcttagtattttctagtacccaatccacattcagattttcttggtttgctcgttttaagatctacatattaggactacatgttacatttggttattaagtctcttagacttattttaatctgaggcaattctttttattttttattttatttatttgtttatttgagacagagtctcactttgtcgccagactggagtgcagtggcgcggtctcggctcactgcaaactctgcctcccaggttcaagtgattctcctgcctcggcctcccaggtagctgggactactcgagtagtgagccaccacgcccagccaattctttttatttttaaaaatatttttcagccgagcatggtggctcgtacctgtaatcccagcactttgggaggctgaggcaggtggatcatgaggtcaggagttcaagaccagcctggccaagatggtgaaacccccatctctactaaaaatacaagaattagctgggtgtggtggcgggcgcctgtaatctcaactactcgggaggctgaggcaggaaaattgcttgaacctggaaggcggaggttgcagtgagccaagattgtgccactgcactccagctggggcaacaagagcgaaactccatctcaaaaagtatatatatacatatttttcatagttgacttgttgaaaagactgaatcagatagcctgtagaaatatcccacattgtaggcgggagtggtggcatgtgcctgtagttccagctacttgggaagctgaggcaggaggattgcttgagcccaggagttcaaggctgcagtgagccaagattatgccactgcattccagtctgggtgaccgagtgagacaccaactcaaaagaaaaaaaaaaaagaagaaatatactacattctggatttgttggtctctttcttcatggtgtcaattaacttgtatctctatcccctttatttagctctaactgaaagctatctctgaagcacgggttcccaaccttggctacaaactgagaagttttaaaaattaatgatgtctgagccccacctcagagattctgatttaattggtctagggcagtagtccttaaactttagcaggcatcagaattacctgaagggattgttaaacacagattgctgggtatcacacccggagtctgattcagaaaggctggggcagggcctgagaatgttcatttctagtaggttccaggtattgcttctgctggtttggtgaatgcactttgagaactcttggtctctcatgaggtctgggcaagatatttttcaaaactctgtaggtaacgttaatgtgcagcctggcctgagaaatgtggagctaatagtttcagccaacagatgatctttgtctggatccattatttcattagtggggttacaaaatgaccatgcctggccaaagaagaagttttcaaagggattcttttaatgatcaaattttaaatttggaaaagagcccttaaaattaaatgtaggcaaggtgcggtggctcatgcctataatcccagcacttttggaggctgaggtgggcaaattgcctgagctcaggagctcaagaccagcctgggcaacatggtgaaaccctgtctctactaaaaatacaaaaaaattagctgggcatggagacatgtgtctatagtctcagctactccgggggctgaggcacgagaatcgcttgaacctgggagacgaaggttgcagtgggctgagattgcgccactttactccagcctgggcgacaaagtgagactctgtctccagaaaaactaattaattaattaaatgtgtgtgtcggtcagtcctctttgcaggtatgtacatctagaaaaagatcaggacaaaatataccaacataataataatagttatctctggatagtgaaattgtgggtgattatgttttttacattttctttttgttgttgttgttgtttgagacagagtattgctctgtcacccggattggagtgcggtggcacgatcttggctcactgcaacctctgcctcccaggttcaagtgaatttcatgcctcagcctcccaagtagctgggattacaggtgcaggtcaaccacgcacggctaatttttatatttttagtagagacagggttttgccatgtttatcaggctggtctcgaactcctgacctcaggtgatccacccacctcggcctcccgaagcactgagattacaggtgtgagccactgggcctggcctgttttttacattttctaatgaataaatagaatcattgtaaccagaagaaagccaaatatgtgttataaaaaatagtttctgaaatgtcaaagagaaaattttagctccccaaaatatttttttttctaaggagtctattttcattattatctctctctctctctcttttttttttttttttttttttttttttttgagacagagttttgctctttggcccaggccagagtgcagtggtgtgatctcggctcactgcaacctctgccctctgggttcaagtgattctcctgtctcagcctcctgagtagctgggattataggtgcctactaccacacacagctaatttttgtatttttagtagagacagagtttcgccatgttggccaggctgttctcgaactcctgacctcaggcaatccactggctcggcctcccaaagtgttaggattacagacatgagccaccgtgcctggcctatatctctttttatatcttttgagtaaacagtgagtcagcctctttctcacagtaccctatacctctgtgctgtttgctttgtgtcccttccatgttcatttccttttggcattgttttgtcctgaggctttagaagagtaaaggcagagatataatgggagacagtcatcaccatagagagacaccaccagtgggttccagtttccttgtttgatgtgtttcctgggcacttgtcagacagagactgttagtaggaatggtcttcattctcaggggctgaaatccacttagtcctgctttttatcctggtcagttagaatgggaaattttccagcttggacaacgagccatgggattggagtaaggcagtttaatttcttctgtttttggcattttggaagttaatgaccttggttatcagcaccagtggccctctgaaagatacttcaggtagcaaatgttcactccaatatagcccaggggtcacctccctcttgagcctgttcacatcctgccccttcccaggcagaagtgacctctccatatttctaagacagaccactgtcagtacctattatacctaacagggctgcaccattaccctttgtttcaggcaggagccagatgtcatttgtgtctgtatctcagctctttgtatgatgttaggcccatcgtacttgctgagtaaatgtttgctatgtgccttgactcttacctgattactcaccatgcatgagaccagatagctgacacttcatatgtattctgtatctgttttcacctgttatgtgtgctcttacaggcatcttattatagaaaactttatccctctggaagaaaaaagtaaaattatgaatagagccttctttgatgaagaggaagatcattggaaactacatcctataaccagactggagtaagtcactattaactttaagtatattttcaagtatgagggaggaaaagaatgttgataacaagagccctctggtcaacaaaggggtttgataagaacacagtttggcttatttaaactcaaaacccactgcattactgattttctagctgccatagatccaccaggtaaaagtttgatcatgagtgtggttttaggaattgggagactttgtcactagtgagtgagcaagtgacctttccaaagttcctgcatttctgtttctccagctgtgaagtgaagtatgctaggtcacgtaaggggcaattcagagctgttatctttgtgtgtcattctgacccacagtgttgagaaggattctcatgctaagtctgggtgctgctggaaagatgggagacacctggcagggatgcagaggtggggggtgttgacagctatgctttgtgaatgctgtctaagaactgggtgatgattaaaaatctcttctggcttaaaagatgcatgatgctctgaatcagaaagcaactcaagcagaaaacagaagcatttcccgtcccacttacgtcagcctgcagtccagggagttacttgcttcaggttctgtcagtgtcttccgagtgctggttccacaggactccagccagggctttaacactgcagttcatttccaggaaccagcagatgatgaagcggccagtctcagccgtgggatataagagaccattgagccagcacgcaagaatgtccatgatgattcgtccagaggcccgatacagggtgagaagatccttcttgggtttttctcctgtctcttttggagtctagatttgtgtaagcccttagatactattccactcagagttcataccttctttccagaggtacttgaagacatttataccaataacaattataacaaataataaataaataagccgagcacagtagctcacacttgtaatcccagcagtttgagagtccaaggtgggcagattggttgattcccaggagtttgagaccagcctgggcaatgtggcgaaaccctaactctactaaaaatacaaaaattagccaggtgtggtggtgtgtgcctgtagtcccagctacttgggaggctgaggtgggaggattacctgagcccaggaggcagaggctgcattgagccaagatcatgccacagcactctagcctgggtgacagagtgagaccctgtctcaaaaaataaataagtaaatataataaaaataataactaataggccgggtgcagtggctgatgcctgtaatcccagcactttgggaggctgaggttggtggatcacctgaggtcaggagttcgagaccagcctggccaacgtggtgaaaccccatctctactaaaaacacaaaaattagctgggtatggtggcaggcacctgtaatcccagctacttgggaggctgaggcaggagaatggcgtgaacccagcgggtggagcttgcagtgagccaagatcgcgccactgcattccagcctgggcaacagggcaagactccgtctcaaaaacaaaaaacaaaaactaaaaacacaaaaattagccgggtatggtggcaggcacctgtaatcccagctactcgggaggctgaggcaggagaatcgcttgaacccaggaggcaggaggcggaggttgcagtgagccaagatcgtgccactgcactccagcctgggtggcagagcgacactctgtctcaaaaaaaaaaaaaaagtcagtactagagaaggagagtacaaacatcctgtctgtcatggccagtaaatattaacaatgaacttcaaaatggctctgtgggaaggctggagagaacacagatgtgtagtgacaggagatggacctgtcgtaaagaacttcaggtactttcatctcacaaaatgtgtgtcagtcatgtagtcatttaaagggacatcattgaggactatttaatgaccccaaaatagaaaaatagaaactctgccatgagagcctctactttttaattaaattaaattaattaattaatttgttttgagatggagtctcgctctgtcgcccaggctggagtgcagtggcgcgagctctgcttactgcaacccctgtctcctgggttcaagcaattctggtgcttcagccttcctagtagctgagactacaggcacatgccacgacacccagctagtttttgtatttttagtggagacagggtttcaccatgttggccaagttggtcttgaatgcctgacctcaggtgatccacccacctcggcctcccagagtgctgggattacaggcatgtgccaacacgctcagctaatttttgtatatttagtagagacggggtttcaccatgttggccaggctgctctcgaactcctgacctcaggtgatccacccgccttagcctcccaaagtgctgggattacaggcgtgagccaccgcactggccttttttttctttttttttttttttttgaggcaggatctcactgtgtcacccaagctggagtgctgtagcacagtcatagctcgctgtatcctcagactcctcggctcaagtgatcctcctgccttggcctcccaaagcactgggatgaccatgcccagctgagcacttgctgtgtgctgggcattgtacccagcacttgactgctttctctaattaagtttccccatcttctctatgcattcagtcctgttgcttaaaggtcaagtagtggggcaagtggctgaactaggatacacaacgtattaagttatagagtaatttacaccagaagtatatatatgatataaaatttgatgtaaaatgtattgaaatgtaaactgtttttctctggttggtggaagcacactcaatgttttttttctttttgctcatctgtattttataactatcaatagggaacttgtattatttttatagtgaaagattttcacttgaaatatttttagatgtttctgagtctctcttggcagccagagccaaacagaagattacggttagttagctctttgggtgccattcttcctggctttgagttatttaaaagaaagaaagcaaaagcaaaaaattaggtggagttaggtgttgtaaaacggcatcacttctttcaggcaggctctttcttgataggccctgaataacaagcaatttgcacttctattcttggaggggccctcgattgcttgtactgcctgtgtccagttggaggctaacctagctggtgatggctgtgcttctgcaggcagaaaacattgtgctgttagagctggacatgcccagccggaccaccagagactatgagggtccagccattgcccccaaggtccaggctgcattggatgcggctctgcaggatgaagatgagatacaggtggatgcatcatcatttgaaagcactgcaaataagaaatccaaggccaggtgagtggctttgatgacgtgtgtttaaacagaacatgtttgaacaaggacaaaccaaagcaagaatgcttgtttatcatggaatactttgcagaacacactagaaaatattgccatattactcctatgtttacttatttattctacaaatatttatggttgagacactatgctgggtataccgaataccagaatacctaatgtccccagtcccttactataaggtgaatgtgttctagtgaaatagcagtcagttcttctgttctcatgaggtgtccggtagttctaagtgctttacaaacattctcttaatgatttcctgtaaaaacttagaaggcaaatattataatcagtcccattttatagacaagaaaactgaaacttagagaatttgagaaagtagccatctctaaggaaacccagcaagtaagggccaaagcaagaattcaaaaataggtcaatccagatccacaacccagtctctgggcctccatgctaagtttacctcacccatgtggtgcaaaactagtaattctgtcttattacatcctggattaaaagttgtaggaaaacaattgggtggaaaaccaaaatggaagaaattctacctgcaaacttaatatttttttatcaatcaggaaaggacagtacagtcaagctttggttttaaagaagaacaattgctaagcatcagagtctccttctctcaggttccacacctctgttctgaggccattttcaccatccccaaaggttcaggctgtgccagtgtagtggttttacagttgaacttgtcgttttcaggccattgaagaatggcctgaaatgaaatgttaatgacatctgatgtgtcagggacagagatggggacatgtaatataaacatgtgtttgacttttgcaggcctaaaagtggaaggaagtcgggatcctcctcctcttcctcaggaacccctgcatctcagctttatccacagtctcgggggctggttccaaagtaaagccagcttctcctctcccagggcggaaacagcatttgccttctgagagaagagactagcaaaaagctgcagagaggattcggcccaaactcagaactgttcccctgaggagaagcggtggcctctttgcagatcaaccaacttaatctggttgaacgtgctgttcctaatctggcactcagcccctctgggaaacatcttttaattagcatctcagaaatgcatgggtaaggtaaagtgcgatagttcaagtggaaagcaagagaatgaccagtgaccttgcttccttcccccttgccttcttctcccccttcccctgtgctccctttctctcctctctccttttctagcctgttctttacatggggctcccttcttgttgaacaatagggcagaatcaggagtcaccttagcaggaccacatctttggagcctcgggataaaatgacagtgaggttgaaaagtgaaaaccctagaacttgaataggtgcctgttcttgtagggagaaatgagaaatcgcatttggatccaggccccaggtgggcaccatcagcagtcttgcttccatgcacctcagtaagaagtggatctgcctttgggacctgctcagtgaggaaatctcttccaatttctgcttctgaatgattcaatgttgggagcaatagaaataacattccctttgccttctctgagtgtttagggaaatagcttctttaaaacctcaaaaccatgaccatcctgtcaaagacctaagtctgtaagctggtgccatgtccatacaccatgtcactttactcttcatttgtcaccatcttttcccatgcacgcatactctgaacatccttgtgtgggcccatcctctgcatccagagcatgctctgcagtgggcctgttttgtggaagaaaggaggctgtctctgccttctctgatgggactggagttgagggaaggagctgtattgtggcacttctgaattccccgttttgttccatattggtatagagagcagaagagtagctaggcagatgcagagatggagacatgagactcagtgcagtgggcagggaagacataacagatggaagcaaaggaatcctgcctgccttcagcagagaattcaccgaatcctagaactgtggctccctccaggcagagcctaagatgctggtgaagaatagctgtgtgattgaataggctcaaaggagagttcagaattcccatttacatattactagtttggtttgtaagttttagttccttgtattattgagattcagagcttcattttatgttggtcattaggtgaatattactcattttccctcaagagaagctcataagtgtgtgtgggtgtgagagcacgatggtgcctgtgttctgtgaatgtgtccatatgtgtctgtaagagagacagagaccaagaacttgcccaattttagaaatacactaatgtgcagttgttgccttttgtctgtattgaaggcccattgaatgactaatccaggctggaagcattcccatgtgggtgtctgagtccatgagccaagcctgaggggacagtgagtctccaggtctgccacactggtgcaccttgctggcacggtgcctcaggaaggtggcgactcaggtgggccttgagttatattttaactcagctgctcagttcccagggcacatttctggatcagaacccatgggaaacaggaggtactaagtgcaatgtcttagcattctgcaaaatggagatctgttgtccagcggcttatctcctttttagtaacccttctttctgaacccagggcccttttcagccttccctcatcttttcttgagatcaaactttacttctttcttatttactaagaatttgcctgtttgaataagaacaaaacgctaaggtgggtagcctaagctgattttctgctggttacacgtgtctctcacaccacatttcctcaaagctaatctgaattctgtaggctaaaaatattcatgtagcaaatctgagaattgaaaactgcagataaccggccgggtatggtgactcatgcctgtaatcctagcactttgggaggccgaggtgggtggaccacctgaggttaggacttcaagaccagcctggccaacatggtgaaaccccatctgtactaaaaatacaaaaatttgcctggtgtggtggtgcatgcctctagtcctagctactcgggaggctgaggcacgagaatcacttgaacctgggaggcggaggttgcagtgagtcgagataacactactgcattccagcctgggtgacagagtgagactccccctcaaaaaaaaaaaaaaaaaaaaaaaaaaacagaaagaaagaaaaagaaaactgcagataaccctatacattaatactggtatctcgaggtgactcttctgaccaagggtggttaagtgacacatagaacttttctaagagaagacagacaagttgacaggcatgccttgtactcagctgtgttcatgtggtggtctgtggaaagaaaagaagactcatttggaaatgaagctgtccctttccaagcagtctctggtgcttttcttctctcaaaatggatccgataaatatttgaatagagcagattgtagaatgtcgtgctgtcaccagaaagctgctgttttgggttctgcattgagccaaatatgtagaggacctaccaagcccactgagggactaggttttcatgtctctggtcatacctagaatgttctgagccgtctgagggccttcatgccggcagcagctagcaaagccagaaagcaagtctaacaggatctaagatgaccatcaggagaaggagtttgagactgtgtatgcaacccccaatagacccccttttactctgatctggagaatgtatctggcttcatattttcaagtcacatgtctctcagacccctggattcagaacccaaggccacaaatcataggcatgaagcactttcttaagactgacctaacgctggattatttcccgtccaatgcctgcatgctgcttgaattgctccacccacacctccatgaccaagggcgccagagtgctgcaactggggcgtgggccgctctctgcttttcctgtctgactctgacaagtcctccctcactgaatgtagaatcgttgccaagtttctgagaagtgtcgattccctgttaacatggatatcagttctgcctcacatttcccacttgaggttgaggcgtactggagacaacacctcagaccatctgaaccccatcagtggacgaaaatggggctgttaatatactctaaaagccatactaaaaatgctctgagggaactggctaagaatagtgggcctggtgattgtctatcacgcaaggctttgttttgtactgttcagaaatctgtcacctttctgcctgcccttgtttcctgaatgaaatgcttctggggttatttatgaaaggagtgatcctggggcaggcaggaggcagtgggcttcatggctccttgaagttattactgatcttgaccttctctttggctacctttagacaaagaatacgccaatcaatacttggggctctaagttttacaattgatatttatttgtatcatctctttgtctaggaatgtaaaagtgattctaaactaagatgtgtaataaaaatcaatcagatttattgtacctacaaaaaggtgtcctcataaatgactaaggcttttgaaaatgacatgcctgtggctgacacactgccattttcaataaacattttaactgggtgggagtgggaaaatgaagattgagttgggatgctggcattatttaatatagcaacaaggggcagggtgcagtggctcatgcctgtaatcccagcactttgggaggctgagccgggtggatcacttcaggtcaggagttggagacgagcctggccaacatggtgaaaccctgtctgtactaaaaatacaaaattgagtcgggcgtggtggtgcgcacctgtcatcccagctactcgggagactgaggcaggagaatcgcttgaggccgagattgcagtaggccaagattgcacaactgcacttcagcctgggcaacggagcgagactccgcctcaaaaataaataagtaaataaaaataaataaataatatagcaacaaggaaaaggacacaaaatgaagaatgatagagtgacaaataagtgtttttcatgtttttccgtggaggttcctgagactggcctgggcaacggcatgaaatttcttttaacttttgtgttttgttttaaaaattcttttaaatttactattatacat

SEQ ID NO: 12424 - DNA, 134241 bp, Human
  misc_feature (1)...(134241): n = A,T,C or G
ttgcaccattacattccagcctgggtgattgagtgagactccatctcaaaaataatgaaataaaataaaataaaatagtaaagttgagactagccactagtggtcttgtgtgattttccaccagccagatttcagctacttaggggaatgtatgtagtaggtggatggttggatttagctagagttgaggctttgccagctgagactggaatataattccaatagaaaaacctgtaatattatttgtattagggttctgtaaagaaacagaaccaatagtatatggaggggtgtgtgtgtgtgtgtttaaatttattataaggaattggctcacacatttatagaggctgagaagtttcccaatctgctgtctgcaagctggagacccaggaaagctggtggtgtcattctgagactagagggccaatgatgtaagtcccattctgagggcagaggattgatgtcccagctcaaccaatcagagagaattccctcttcctcaagccttattttattcacgtcctcaatggattggatcatgtctggtcacactggggagggcaatctgttttattcagtacactgattcaaatgagattagctcatccagaaacaccctcacagacatacccagaaatagtatttaatttgagtaccccatgtctcagtcaagttgatatataaaattatctattattggacttgcctcacatattgaaaaactatatatatgatttgaccttgaatctatagagttaattttgtttaagaaaatctttaatcagctaggtattagaggagtggttactttactttcattctcattttgaccttggtttgtatttttattctttcatacttctgatatgacttagtcctttatttaatagatataaatctgtttcttagtgtcagtagctcttctcatttagagtatatcatagcatgtgcatatttttctagttctcaagacagggaaatcttttaccagtgattttcattctttattcttcattgggtcttggaaacttgaattttaggccttttacttattctcttattttttattaagcatatcattttcacatctgataatagaatatttgtaatgtcaggaaatttttcttgctgcctcagtttatctttaaaattaagtagtgttcattaaattatctccaagatacttacgtgttctgaaaatactatgattatgtgttagatattttatactgataatataatattcatagtcttagttttattctgattagcttcaactactaatcttgttcaaggctaaattaggcccttaaagaattttacattgtctctaagcagttatagttgggctaccataacttaatggatattgtcgtattttcacaagaaggaagcaatatttgaagagcctttgtcttttgcatgcatgcctgatagtgaaggttaatactgggttaatagatccattgcttctaagcagttggaggaggactggaatcaagagactccatttggagaaaaaaaacagtttggcaataaaaatcacaactggaaacttgtgaaactcaagaattctacatgtatagaaaaaaaatcacactagaaggacattcttgtgaagcagcagttttcttagctttggattcttggagggcctattataaggcaaattatatacttatgaattaacacaattaaagtcattgggtagaaagtgcctgctgttgatgtttctcactttgcattatccattgaaaataaacgtgcaaaaactcttcttcattgaaacatttaacttttggcctttcagacaataaaatgtctctgttgctaccttgtatgcaagccaggtctttgaatccaaaggtataattttatctactgtttcagccctattgctttcatttgtctggctatggtagatttatatgaagaaaatgagggcttattgtttcagcaagtgtaatgagcaatgtgtttttcctttaggatcaaacagagcatactgaatcagcaggactggctggtggtgcagcagacatcatgagtaagcaccgagaagtctgttccttatcacgtgtgtaaggggaaaaaggtaagaaaatgtttttatttctcttagagattgaacttgagaaaccaatgagatctatagaagataatgctgatgcatatatgttacttgcatcatttataacattgtgtcttattaaatcaggagtatgctttttttcaaaaagatttgacttaaattcagaggaaaagggtatttaaaaatcactgttattttgtgtcacaatggtcacaatgttaatttccctcccagtgctggctccttcgttttagagtttgttgaccatagaaaggtaatttcagaaaaaatatggatttgagcaatatttaagctcatgcaagagctaaacaagtaaagctaatttggtgatggggaatcagaaatgtaaatttaattatgttattttattttgtatttttaggtaagttattatgtagagcaataatttccagcagaaaactggaagtattcttgtagaacaggaatccttgtctttttcctaactaggagtcatgttgttttttttcaagtcttaagattatttaagggtgtgaacccccaatatctgtgttggaaacaagtgcttgatgtagccaaaagaaacccgcacttagacagaaattttctcagcaaggcacttttacttctgcagaagggtgctgcttgcacctattacaaatgcaagagcacaccgaacaaaggaaggaaggggtttttaaccctaacacagttcctgtttctgtatcttttccctattggctagggttggattgcacaatctaagctgatcccaactagccaaggcttaaacttttccaaacagggtaaatgtgagatttgtgaaggggcggggtgggtaaagaagaaatggttagacttaacagaagcgggggtaggattgtttacaacttatgaccaggaagttgagtctttgaagaggaactcaagtcgtcccaacaatttcccctcttctgtcttacagttcttcatcttcagatttctttaacaggatctggctttgttgttcttcttgattatcaaggtgcgagagcttatctgagtacggagggggagaggttggggaggtttttgtgagagctgcttctatgagcctttgggttaacccacgaatacaaggtatgatacagcaaccgacaaggatgagtacatctttaacaattgcaagggaagtaaagattgaggtcatgagtcccttccattttccaaaccacctttccattaggcctgtaaaggggtcgtctattccagagtttttggctaattgatttgctagggtggtaaggccttgtaaggcttttatgattgtcccatcaggggctgtattattaggaataaaagtacaacactggaccgtgatcatgacatagactctgccttttttggccaacaccatgtcaagggttattctgttttcccagaccatctggctgatggggcctagtttcagcgattccttttatggcatctctggtataattgatgaattgctgctgattgtagtatatgtgatttatccagtctacgtttttgtttatagtggaccaccagaataagatagactcgaacctggcggctatttggttttgagctttgaattcatttggtaccctccgcaggaccctgatgctgtctatgtaaacttgagggtcaaaggacccatttattggggcttctttttttcttctggttacctgcttcctgatgaaatgccatggtgaaagccatggccagttgaatcagagcacaagtgccactccagttgcttggcagtgtaccaaatattggtcccccacaataccaccatacatcctctcggggatggactagggctgactgattggttatctcttgaaaaggtttaggcccactacatcccatcaggtttccaaggaatgtcaaattttccccttgttgtgaaagacacaaggtaaaattggcatcgagagctggaagttgaatggcccttgggggctgtcccataggggtcctgacctttggggaaaatagtgagtgagtggcacatgacatgtttccccaggctgtggggtgctggaagagagctaccatacagtctttgcctgatggattggcccatccgagtgggaggggaacagtttgggtttctggcctgcctgttgcacaagcgtaacaatctgttttatttagggtgcgaatggaatatttaatcaattccagctaggcatttacatcttgataactggtttctatggctagggtttgctgtaaatccttaacttctactatagctactttggttttgtcagtaggcatgaagcgagaaatggtttgatttttgtggttttgggaagcgggtaatggggggagatggaggaggaggagcaaacctcatttcaaagatgcctgtagggtcttttgcagtgacatctgctcctaggccataaaggtgctctaaagtggggatagggtcagtggaggtggggataggaatagagagaagtactgggttacactggtggttttggcaatttgagggggtggttcctttggtgaagtggaggtagggttttagggcggtgcgaccctctgaggaggtccagccctgatatttcgtggtccagataatatctccccaactataacataacccctggaaggcttgtggtcgttgattgcaagggtcgggggtggtgctggtttttctggggatggggggcagaggtacttttctgaagaagctagctgtctttgactatggaggtttccacagggtatgacaagacaggcatcgaatgtaattgtggggagggtgatcgggttacattgataataaggtgtccttgggtagctaaaggaagaataaaaagacagattaaacctttttgaatgttagtttggagggtattgatcctggaatgatggtccatgactttgcaatggttgcggccccttttagcccagtgtggtgggtccatgcttttttggccgttcagattgctgtctcagtggttaggagtattagataaggagtattagataaggtccttcccaggttggttcaagctttccttctttccaacatatgataaggacgtgatctctgggctggtgtcggtgaattgggaattcgaggggtggagtttgcgctaggaggccttgagtcctgagggaggaaagggtggaagacagaccaaatatatatatttttagaaactgatcttttgtttcaaatgtgggaaggtcagtagtggaatttagataaggcagcccatagagcatttcaggccaagatcttttgtgtgtgtgtgtgtgtgtgtgtgtgtgtgtgtgtgtgtgtgtgtgtgtgtgtgtgtggcagagtcttactctgtcgcccgggctggagtgcagtgatcttggctcactgcaacctgcacctcccaggttcaagcaattctcctgccttggcctcctgagtagctgggactacaggcaccagccaccacgcccggctaatttttgtatttttagtagagacggggtttcaccatattggccaggctggtctcgaactcctgaccttgtgatccaccctccttggcctcccaaagtgctgggattacaggtgtgagccaccacaccctgccaggccaagatctttttgaggggcagtttggattcttagtaaggcaatgggaaggcattttgtccatggtaactggatttccaagattaatttggttaggtgattttttagagtttgattaattctttctaccctccctgatgaaggtggatgccagggagtatgatattcccattttattcctagtgcttgggttagccccttaatgatgtgtgcagtgaagtgagtctcattgtctgaatcagtgttctctattagtccaaacctggatatgatatgttccaacagtgctttgactacattactggcagttgtgcttgggaagggtatggcttctacccagtgggtgagatggtctactatgactagtaaatacttgaggcagccgattgggggcatttcagtttaatcaacttggatgctttggaatggccttaaccctgggtttcttcccgtgggaggctgcttctttagggtttccttactagtttttctgcacatgatgcaaccatcttccacttgcctagtactctatacacccatagactctgagggctacattgcacatagcttgaggaccccagtgagttcctggatgaagctgtgacaatatttccctcatgaggggcttagacagcatttcccttccatctggtaatgcctgctttccctctgggctctcctgagctcctattttctttagagaaaggtctacgtgggagaagatggggatcgcagctggagggggaaacaaagggatagatggaaaatgggtgccttttcggaagaggcagcttgcttagctgtttgatctgcaaggttatttccctggctttcaaaagatggattcttttggtgtcctgggacatggacaactgcaatttcttctggcagctgaagattttctaatacttgcaaaattaattttttgtggaccaaatcttggcccttactattgatgaagcctcgttcagtccagatttttccaaaggtatggactactctgaaggcatacttggagtcagtgtaaatagttccttcttgattctgcagggattttaaggcttggtttaatgcaaagaattcacagtttgggcagaccagttatttggcagtcttcctgactctacctctgtgaggatttccccatcaactgtggagtacctgttgtacctttttccttcaatgatccggggggaaccatctgtaaagaggtgatgccctgtttggaaaggggttttgcttagatccagtctgactctagtttgagaactgattagatctaagcatttatgcgtagattcttctgggtttggatttcctgttaggaaagcagcggggttgagtgaattgtcagtggttagtgttaggtcatccctctctaataagataacttcatattttaaaattcttgagtcagtaagccatctctctgccttctgattaagaatagttctgacttgatgaggggtacttatgatgaggtttcccccaaaggttattttcctgctttcttctgttagcaaggcagttgctgctatggattggacacattcgggccatccacgggttacggggtcaaggatttttgacaggaaggctacgggccattggtggcctccgtgtttgtgggtgagtactcctaaggccactcctttgcttatattaacaaaaaggtggaatggctgttctaaggagggcaaggccagaatgggggctgttacaagtaggtgttttatttcttctacctgttggatctctgatggggtccagaggagggtttacagggtctggtctttcttgagtgagtttttgatataggggctttgtttttaaggcataagagttaatccacagatgacaatatccaaccaatcctgagaatttcctaagttcctgctttgtttcaggtaaaggcaaagataccataccttcaatttgtttgggtcctatctttcgtttgcctttactgattaggtgtcctaggtatttcacctcaggttctacgaattggagtttattctttgagacctgtaacccttgttcccttaggaaatttaggaagttaactgaaattgctgttacttgatccttgttatctcctgagatgagcaggtcatccacatattggagaaggcatatggatgaaggcagggagaaattttctagaacttgttctaatatttgaccaaatagatctggggactctgtgaacccttggggcaagactgtccatcagtactgttgttttctatcagagtcagggtcctcctactcaaaggcaaacatgtcccgactatcttctgctgaagggcaagcccaaaaggcatcttttaaatctatcaccatgaaccattggtggttgtatgggattctactgacaatggtgtaaggattgggaacaacagggtgggcggtttgaactatttgattaatagcctggaggtcttgcactagccgggatgacctgtctggcttccttacaggcaatattggagtgttataagggggcatacagggttcaaggagtccatcgtggacaaggctttcaattatatgttttaaacctatcctggcttccaagggaatagggtattgttttgtttttactgcttccctggtagtttttaatttggcatggattggaggaacctgtagctttcctcgatttccttcctttgaccatatgtcgggatggatttggctttcttccgaagtggtgaccaggtttaaggaagtaagttttccctgattaacgtataggcctatgcctaaccttaacattaagtcccttcctaataaattagttcctgctttgggaattaataagaacttagtagtggccgacttattcttatatttgactttggtttcctctagaatttttgccctgaatccttcccctataaaccctgagacagtatggttttctgctgaaaatgctaagcctgatgggagaaaacatagggaaagcgagctgctcctgaatcgactaagaaagtgactatctctgatttgggtcccaccattaaatttatcaggggctcttggtgggactcaagatggaagatgtagagtacctgaccccgctattcttcttcaaatgtcatgagtggaaggactttcttttccctctcccattcaggacattccctcttaaaatgtcctggctttccacactagaaacatctgttttcccttctccccctccctgttccctgactctcaggtttcatccctttgcttcctgtataggggtcagacagccaggtgcttagaaggtctacaagttctattctcctgggctccctgttgaagagttccctgttgtagggtggacaggcataatctttgccttttgcttctgcctttcctcatccctctctacatacaccttttgggcctcttaaaagttcctctatgggatggtctttccaattttctatcttttgtattttttttgtaatgtctggccaactattggtgacaaagtggagctttaacattccttgtcccagtgggtcctctatgtctaaacctgcatattttcttatctgttccttaagtctaagaattctatgggcctttcatctttcccttgttgtacattaaatgctcaggaaacattagggttcaaggagctgattcccaaatccctttaattatcatgtccctgagatctctcatgttttctcagtgggcttcattattgttatcccactgagggtcctgggccaggaatttatgctctgctgcaaggacattttgaacaggagggtgtttgcgctcccagactatcatggcagccctgaagatcatggttctttcctttcctgagaagagaataactaggatagacattaattcagcccaagtgtacagttgtggctccagagactgtccagtttgatctgcgattccaaaagggtcgtctaacagtggtttgagttccttttttagatttctaacctctgaactagttaagggggcatttacaaagccaatatcccctcctcctagtggtacttcccttaagggaaaaagggttggggtagacttctttgaggaagggaggaaaggaaagttttggatatccctttggcattgtctatttcccattggagctttcctgaggaaggggcatgttcaggtggctgtccagcggggatgtggggtggcatggcccatggggcagggttatatgggagaggaactgagtgttcagcttggggtggaggggtagggaggggaaggactgagtgttccacttagggtggaggggtaggcaggggaaggtggtctagaggatcccatgcatctttagatacagaatttgacttaggtaggtcgtctttgggaggtattgaatttggctttgctttctcatcctttaggggatagagaaggacaggtctttttctccaacatagagcatcatctgtctcctcttgagaaactggacttttatcattgacttactggatcaggagttgacatatccagtcctcattttacccaaactctggccaaaagactgaaggtctgagggtgggttccttagtccaaataaaaacagcaatactttatcatacgctgtcttttcttgtgttttgtcctttcattatccttccagtattttaacataaggcataggggactgtcagggggaattttattgtctgcttggccttttatagtccctgtcttacttggggtatttcccatcctggcggttggtgaggctaaatgtctcgtattagagatttcttgcactcccgtgtcctagaggctgaacctccccttttcccactggaggtttcttgcactcttgtgagcacccactttgtccttattggctgcttccctcgtgagaattttaggttcctcttagtattggtgggttggtgtaatcccctgactggaaaactgccctaagacctacaaggtgaccacagaaccgagtccggactccacactcgcttcgcacccaatggcgtgtctcactcacacactttcaacctacagagatcccaaccaccaaggaatactttgttgccccaatagtgacgtttcttaccttggtctatgcacagagttatctggtcactgaggaattcttagggatcctccctatagcccatgttgctgagagtccggatttattcgtcactttgggcgagattcgatcctccactcctggggccaccacaacgaggcagtgggatgcgtctccccatgaaagataatcactagcccctcccaaaggagaatgggatcctggacaagcccccagatttgttggaaacaagtgctcagtgtagtgaaaagaaacccgcatttagaagttttctcagcaaggaactttacttctgccgaagggtgctgcttatgcctgttacaaatacaagagcacaccaaacgaaggaaggggtttttaaccctaacacagttcctgtttctgtgtctttcccatgttggatgggtcggactgcacaatctaagctgatcccgattggccaaggcttaaacttttccaaatagggtaaaagtgtgatttgtgaaggggtggcggtaaagaagaaacagttaggcttaacagaagaaggggtaggattgtttacaacttatgaccaggaagttgagtctttgaagaggaactaaattgtcccaacatctgggacaggtctcagtttatttagaaagtttattttgccaaggttgaggacacccaagaggtcctgatgaagcaactgtgttgtctgaggtatacacccaaggttcatcgtcttgtgccaggaaaatttaggacaccgacacacacgaggagtttaggagcagaggtttaataaacagaagaaaggagaaagaaaaacagctctctctattgagagagacgggtcttccgagggaaaagactggcaggtggtggatgcgccggattttatagtccagcttgaggaggcggtgtctgatttatgtagagctcacagattggttcgatcaggtatgaagtttacatagcatgcagggaaggctggttgccccaccctaatcttattatgcaaacgaactttctccttggcaggtgccatcttatctgctccttactgtacatgtggctggcagagaagggaagatggagcctccatcttgagcatgtctagtccctagttcctgctggcattcacccgtgcaagctcccagcttccttgtctgtgtctgcagctcgacttcacagactgctctttgttagaaaatgatttccagcctggccaacgtggtgaaaccccatctctactaaaaatacaaaaattagccgggcatggtggcacaagcctgtaatcccagctactcgggaggctgaggcaggagaatcgcttgaacccaggaggcagaggttgcagtgagccgagatcatgccactgcactccagcctgggtagcagagtgagactctgtctcaaaaagaaaaaagaaaatgatttggggctacttttcattaaaaagaaaagccttactgaggactctcgtacccttactatctgcctaagtgatttcttcttaactcctgtatcactgacaacacgtgcccagggttctcagagcacaacttggttttatacattttagggagacatgagacatcaatcaacatatgtaagatgaacattggttctgtccggaaaggcgggacaattcaaagcaaaggcaggactactggaagcagggagtgggcttccagatcataggtagataaaagacaaatgattgcattcttttgaatttctgattagcctctccaaaggaggcaacagatgtgcatttatctcattgagcagaagggtaactttgaatagaatgggagggatgtttgccctaagcagttcccagcttgacttttccctttagcttagtgattttggggccccaagattttcctttcagaaggggtagaaaatggtggagggtatataggtgagaaaggttacaaaaactgattacactactcactaatggaatgttgcatactctggttgagttatctgacttttccatgtaagctgtaaggaaaggcatggtgggaccagcagtgtttaataggaaactgagccacttttctcttcagttgagggtggagcagaggtacttggcagcaatgccttcttcaccaaaactctgagtctgcagttggcaagctatttctcctcctttagccttttcacatgggagtgtgagaagatagtgccctcttttctgccttcacttgccaaaatctcatccttcaggcgttgcctctttaggaagtttccacccattgtagcaaaaactatcagttatccaccaaagtcaccaaaatccatttttcccttctgtagtagccacagctgtgatgtcacagtccaatcagcctttgcagctgtgtattcaccatcacagttaagatacagcataattctatcaccacagagatccttattgctactcctttgtagttgcatgtaccctctcccctgactatccaatatttaatgactttttaaagttaaaaacactgttaaaactcataggaagagctgggttagcataaaggcaaaccctagtatgttcctggatgagaagacttaatatcattctttctcctgagtgaggactaggttaggaattctaatttctcatggtttattttattggcactctattccatcctgctccattgctgagtcttgggaccatggaggggactttttctgtagctcctggcttcatgtagaaagctcagtttagcccctctggtgcataaatttctatgtttgcagccagtaattcttattcttcctgctacctttcaaaacccaggcttaaaggttgctgtctagttttgatactcctatggactgccactcttcagttcctgctttccttctaggtttatggcatctgtgtatttccctttcttgcttttgaatttgactgtttaaactcttttaaaatattttatttagaatttttttatttatttatttttgagacagggtctcactctgttgctgaggctagagtgcagtgccaccatcatggcccactgcaacctccgtctcctgagctgaagcaatcttcctgcctcagcctcatgagtagctgggattacaggcatgtgtcaccacacccagcgaatttttaaaattttctgtagatacggagtctcactatgttgtccaggctgatctcaaactcttggcctcaagcgatctcacaccttggcctcccaaagtgctaaactctttaaaataattagttttgtctagaatttttttatttagagtaggaaggaatgtttaccacccatcagctcagtgtgcccttttttcttttaagaaatcttaagcctgcagaaaaatggaaagactagaacaattaagacccatatatccttcagctagagttatcagtttttaccattttgtcccttttgcacacctttcttcccttcccacacatatactctcacatcatttaaaagttagttgcagacaacacaacacttcttccctaaacacttcagcaggcatctcctaagagaacaagtaagggcattcccctacaaaatcagaatgccattatcacatctaagaaaatgataattaattcaatgtgtcacccaatgtatcgtccatatccaaatttcttctgagattgttctcaaaatgttaatttatgctgtgtgtgtgtatatgtgtgttttcttgatccagaatcaagtcagtgcctgacacttggttatttaatattttgtctgttctagttgagaataatcttttttcctttttttttttttaaagacgaggtcttgctctgtcacctaggctagaatgcagtggtgcagtcatagctcactgtaacctcgaactcctgggcttaagcgattctcctacctcaacctcttgagtagctgcaccaccacacctggctaatttttatttttatttttgttgatgttgcccaggctgctcttgaacttctgggctcaagcgatccaatcctccacctcagcctaccaaagtactgggattacagatgtgagccactgcgcctagccacatataatattttggaaagttcagatcagatacagaatgtctcacattctagatttgtcttattgtctcctcatgattaaatcggctaaatgttttggcaagaatactgtataggtgatgttttatatttttcattgcatcatattggaaagtgcataatgtcagcttgttaaactgttgtggtggtactgagttaaatcatttggctaaggtgatgatttctatatctcttcattgtaaacatacatttccttctttgaaattagtgatttacctgtggaatgataatgtgaggtactgtgaatagtttcttccccaataataatttacttaatagtttagcatccatttttgatgcttgtttgaatcagttatcgtaactggaattcagtacaacttattgaccagctgcttatacactgttcatttattcattctgcagttattaattgaaatagataccacattagcacatcaggctctatgtgaatcaccaggaatacatggtgaacacagtctggtgggtgcccttgtggtgcctacagtctggtgggagagattgacaaataatcacactgatgtgtatttatagatggtgataaatattttaaggaccaagaatggggtgccatgagggattgttgttgtagaaaaagcgggttcttgtcaaacaaccaggaaagattaggctcacagacacttttttttttttttttggagacggagtctcgctctgtcgcccaggctggagtgcagtggtgtgatctcggctcactgcaagctccgcctcccaggttcacgccattctcctgcctcagcttcctgagtagctgggactacaggcgcttgccaccacgtccagctaatttttttgtatttttagtagagacggggtttcaccgtgttagccaggatggtctccatctcctgacctcgtgatctgcctgccttggcctcccaaagtgctgggattacaggcgtgagcctccgcgccctgcctaggctcacagacactttgaagggtgagggggaaggcaaaaaggaaaaaactcagcaaagcgagaggggttcctgttaacaggctcccatctcacagattgaatcccatgttaccacacaggaacaggagaggcaaacggagtgaacttcccaaggccccaccccgtcctcccagtgtgcagtgcgcaggtgggcatccagaaagaatcagtcaaacagggaggtgaacaacacacaccagggcctgttgcgggggtggggatcgtacttagaggatgagtcagtaggtgcagcagaccaccacagcacacatatacctatgtaatctgcatgttctgcacatgtatcctggaacttaaaaaaaaaaaaaaaaagaatcagttggaaaagggcaggcttcatccaggatgggcaatttggtttttcagccctcatgctgttttaaacttgaaggtggggttttgctggggtacccttggctgcctcctgtctctatctgtccccttataaggggagccatcaccttttctgggggttcacataacacttgcctttgaaagtgatatttgagcaaagagatcaaatgaagaatgatgaacttaaataacctcttgaacttctgtactagttattctgtagcacttatctgttaattttatctgacaggttaatcacttgctgtctcctgtgctgttattaaaatcatttattatttaaattttcttacttagccttgtttactgttgactaaattataagctttataatgttagggatgatatctgagacttgattacagtatagatgcatatagtagatgcagtaggtaaatatgttaatctgattatttgtttactaatatttttataatgaccataaaatgctgttaaatattgtaggtgtatattgaatgtgtcagattgtgtgttgtgagaaatttcatttgctcttagcattagtagacattaaatgtgcaacctatctgaaatggcatgcatataaaaatgattttgacctataaataattagacaacaaagatagatatttaaaaaaattcatagattatgggctgggtgtggtggctcatgcgtgtaatcccagcactttggaaggctgaggtgggcagatcacttgaggtcaggagtttgagaccagcctggccaacatggtgaaaccctgtctctactaaaaatacaaaaattagccaggcatggtggcacacacctgtagccccagctactctggagggtgaggcaggagaatcgcttgaatccaggagggggaggttgcagtgagctgagattgagccactgcactccagcctgggtgacagagtgagannnnnnnnnnnnnnnnnnnnnnnnnnnnnnnnnnnnnnnnnnnnnnnnnnnnnnnnnnnnnnnnnnnnnnnnnnnnnnnnntaggagccaatctataaatgttaaccaagttaataatcatgggaaaatactctttctttttttgagatggagcttcacacttgttgcccaggctggagtgcagtggtgcaatctcggctcactgcaacctccacctcccgggttcaagtgattctccctcctcagcctcctgagtagctgggactacaggcacacgctaccactcctgcctaattttttgtgtatttttactagagacgaggtttcaccacgttggccaggctggtctcaaactcctgacctcaggtgatctacccacgttggccttgcaaagtgctggaattacaggcatgagccacgacgcctggccgggaaatacttgaataagtcagttaaattccctgagcttgttttcttatttgtaaaatgagggaaatatcattgacacttatatacctcagagaagaagaaacactaccttagtaagtcaaagaaatttcatcacttattatatttgacttaaagtttacaaagacagcctattacatttctgattttctctgtttttcatgttttccttactcagactttttggggaatttgtaatttgacctcccctgcctgtattatatcaataagaagccaagcagaattttcagtttggaaagaaaaatttgaaacactaaggaaataggtgtggagatcatggtaatggatggaaaaaaggagataataggtagcatttacttaacacctattatgtgcccttagcatctgttaagtcattgacatacctagtgtatatgcccaaggatgcttttggatcgattaacattaaagaaatggtttagaaatggtactcgaagagggttacaagaataaccaggtcagggccaagtgcatggctcatgcctgtaatcccagcactttgggagactgaggtgggcggatcacttgaggtcaggagtttgagaccagcctggccaacatggtgaaaccctgtctctactaaaaatacaaaattagctggacatggtggtgcttgcctgtaatcccagctacttgggaggctaaagcaggagaatcgcttgaactcgggaggcagaggttgcagtgagccaagatggagccattgcactccagcctaggcaacaagagtgagactctgtctcaaaaaaaaaaaaaaaaaaaaaaaaaaggaataaccaggtcagagtcatcattagcattttggaactagtatccgttactcctgtacttaaacttccctgtcatttcccatttgaaaaaaattctgtaagcttcgttctttaatagaaacacaattttataccaaacaatgattcctttcccagcatctgaaatgtgtctgttgaagcatgaaatgatcaccaagtcagccttttatatttagttatattttgttgattgtcagcttacaggtttttagaatttattagcttaaagatcttataatatatccagtgggatgccaggttttgtagtttaccattatctggaaagatttataagagattttatccttgtgtatatacttaagatttataaattatattttaataattcaaaatgtaatacgcatttactttttaggtttaaacaagtctcttaagtggtgtttcctcaccgatggagaattacttccaagcagaagcttacaacctggacaaggtgttagatgaatttgaacaaaacgaaggtgagaatttatattggtgaatctgtttgcctatgtggtatagagaatgtggggatataagaggatgtagtatttaaaaaaataaaatcaggtctgatgacttaatgatagtaatattatttaataatatacaggggaagaaataacattttttagcactaaatgccagatacttaaaatcccacagatcttattgccattttatagatgagaatagaggcacagagaggttaagcacttttctcagagttatcttgtgaacaagtggcaggattagaatccaggcagtgtgacactagagcctgagctttactgaactaccctatacaatgaatgtatggtcaagaaatgtgcttgcatttcctaaactaagaaaaatagctcgttctatattgattgcccaataaagtaaagatacatttaaaactatttacatcacaactgcctaagtggttaattatatattctcaagcatcagtagaaatgtccacttaagattcacttcttttgtttgtttgttggttggttggttttttgagaaagtcttgctctgtctcccaagctggagtgcagtgctcactggaacctctgcctccctggctgaagtgattcccatgcctcagcttccagagtagctgggattccatacacccgccaccatgcctggctaatttttgtatttttagtacagaaggggtttcgccttgttggccaggctggtcttaaactcctggtgtcaagcagtcctccctcctcagccgcccaaagtgctgggattataggcatgagccaccacgcctggccaagattcacttctatttagggaagacttttctctaaatttccatcttggtttaacttgagtgggtaagccataattaaatttcttcctcctcaccgttcttcccctgtgttctctatttctaacaggaaatggcattaacaagtttacaaagtggtatatttccatccaaagtccatgattccagtccaggcaacatgatgaaaccccgtctctacagaaaatacaaaaaaaattagccaggcctggtggcacacctgtggtcccagctatttgggaggcaaaggagggagaatcacttgagccctagagatagaggctgcagtgagctgtgatcatgccactgtattccagcccagatgacagagtgagaccctgtcttaaaaaataataaagcccatgatttccatattggtttacaaacctttgctatattcagtgaatcgggctattctttgatagcagttgggaagacagattagttttgactttgttactttagatatttaatgctctccagccttaaattgaatatggaatcatgacaggaaggaagagagagaggaaggctaccagagtggcctgcttttctcatattttaccattgatgacctaacactaacctatattcctaggctcattcctggttcatgtaaatgtgaaatctaatcattggggttttacatcatccaggtgggctttgtacataccaggctggaaggtatattattttctgagtttcaactgtttgtataagtattttcttaatcttttatttgatttagccctctgtgtatcacagttctttgagtcataaggtacttagacatgtattacacctaatcatgtgaatactatgcttctagaataccactgactctaataaaactcttagttcattacatttgtctctttgtgacttctgtagattctattagggtgctttgtgtatagttgttttcaatacatttttgttgaatcagtaaaaatattttagttaaaaaatagagcaattgcttacagaataataactcctttagaaggagaaggatttctgaaaccagcttcttggttgtaactttgtggttcatttgtttgaactatttttttgaatctcactaccagttgcattaaaaactatcacttcaagcctcgtgttatcttagagaatatacttaaaatgatttctcattttgtgttaatttattttctcatttaaatgaaaaaatataccacagactgtgatgacactgggcaatcaacattatgcccaggtaggaggcagttgaataatgaaaattttaatacccgatcatttctgtttgaacattgctaaatattcttgtaagaagctgtaactatttttttgtttccaggaaccatattggaaatatgacttatttgcttttttttcttttaaggaatcctgtgttactaaatttcaaatctctactggttcaaatttggtaaattcaggatttgacatttcagaggatactaagcccattcttcacacaatctgagttttgtgccctttttaacaacttttcactacttctttacactaattcttttctcaacccaaactgatttacttattgcttccttaaattcttatatttggggatatgcttttctttattcctctatttattaatgctttcttttccaaacttacataaaactgtctttgaagcatagcccagttcttcttgccttcatgaattcaagctcgcttacctcatcctggaaaatatctgtctcctctgaatttatttttctactcctacataatagttttcagacactgagtcctcacttgatgtctttgataagttcttggaaactgtgactttaagcaaattgatacactgtatgccggagaaccttaactgttgtttatatcaattagcttatagtaaaattggcttctttatacagtgagttgttttgcttataattgcagtttccaagaacctatcaacaatgttaagtgaggacttactgtacctatgctactccatactgctaattagatgtttgtacgtgtctcttattctcccaatgagattatatacttcttagaggcaagagctatcatttaatcttcatgttcctcaatcctgctgcttttactatggtagatattcacttatatatttactgtgtatgttctacctatcaggcactatgcaaagtgaggacttatattgatagaaatgatttctgccttcagaaatcattcagtggttgaaagagaagggtagataaactattgcatttcagtgtagtaaatgccttaataaagttttgattaaggtgctgtggacacattgaagattaatgttacagatgaggattgagcttacaaatatatctgcataatttcaggaccatgattatcagagatactggaggaagaaagcaagaaaggcactgagtgcattgttccttatttctctaatttacttagacatatgcagtagccctataacttgagagaataacttagccattgtagttatgatctgttaaaaagtaaacagaaacattatatgaaattatgcttattggtagactataagaatgttgatttaatatgataaatgaacactttttgcccagtgtcctcagataataatataaatatgaacctgattaataatgtattgtgacatggttacaagcagaatttcacgtactgtggcaaactttttttaacatgtgttgggcaaatttaaaatatttttaagtaagaagtataataaaccccagtgtacccatcatccagctttcacagcatttcatatgctgccattttgtttcatttatacctttatcaccttctcactccctgcttcattcttattttttttaacagctttttaaaaggtaaactttatatacattagaatgcatagatcttaactgtccagttttggcaaatgggtatctctctcaaacccacatcctaattatgatacagagtgtagagcattcagtctctacagaaaacttcattttccttcctgcttaattagttatcctagccactgttctaaattttttccatctaatccattagattagcacctgtcctggctttgctcaatccaagggtgctttcccctcttctgggtcccattcacctgtgggtcagtttaattatgttactagattgaggtagaattcttttgttgtttggaatagtctgagatattaccatttggtgacatataattgcagagaattgtctgaaatatattttcttattttttagccccgaattagaaatctaatatccttggaatatttaattttcaaacgatagttagaaatgttattaacttagtcataagcttttccagtgttacaagcaaacttattgtaattacttatttttttccagatgaaacagtttcttctactttattggatacaaagtggaataagattctagatcccccttctcaccggctgtcatttaaccctactttggccagtgtgaatgaatctgcagtttctaatgagtcacaaccacaactgaaagtcttctccctggctcattcagctcccctgaccacagaggaagaggatcactgtgctaatggacaggactgtaatctaaatccagagattgccacaatgtggattgatgaaaatgctgttgcagaagaccagttaattaagagaaactatagttgggatgatcaatgcagtgctgttgaagtgggagagaagaaatgtggaaacctggcttgtctgccagatgagaagaatgttcttgttgtagccgtcatgcataactgtgataaaaggacattacaaaacgatttacaggattgtaataattataatagtcaatcccttatggatgcttttagctgttcactggataatgaaaacagacaaactgatcaatttagttttagtataaatgagtccactgaaaaagatatgaattcagagaaacaaatggatccattgaatagaccgaaaacagaggggagatctgttaaccatctgtgtcctacttcatctgatagtctagccagtgtctgttccccttcacaattaaaggatgacggaagtataggtagagacccctccatgtctgcgattacaagtttaacggttgattcagtaatctcatcccagggaacagatggatgtcctgctgttaaaaagcaagagaactatataccagatgaggacctcactggcaaaatcagctctcctaggacagatctagggagtccaaattccttttcccacatgagtgaggggattttgatgaaaaaagagccagcagaggagagcaccactgaagaatccctccggtctggtttacctttgcttctcaaaccagacatgcctaatgggtctggaaggaataatgactgtgaacggtgttcagattgccttgtgcctaatgaagttagggctgatgaaaatgaaggttatgaacatgaagaaactcttggcactacagaattccttaatatgacagagcatttctctgaatctcaggacatgactaattggaagttgactaaactaaatgagatgaatgatagccaagtaaacgaagaaaaggaaaagtttctacagattagtcagcctgaggacactaatggtgatagtggaggacagtgtgttggattggcagatgcaggtctagatttaaaaggaacttgcattagtgaaagtgaagaatgtgatttctccactgttatagacacaccagcagcaaattatctatctaatggttgtgattcctatggaatgcaagacccaggtgtttcttttgttccaaagactttaccctccaaagaagattcagtaacagaagaaaaagaaatagaggaaagcaagtcagaatgctactcaaatatttatgaacagagaggaaatgaggccacagaagggagtggactacttttaaacagcactggtgacctaatgaagaaaaattatttacataatttctgtagtcaagttccatcagtgcttgggcaatcttcccccaaggtagtagcaagcctgccatctatcagtgttccttttggtggtgcaagacccaagcaaccttctaatcttaaacttcaaattccaaagccattatcagaccatttacaaaatgactttcctgcaaacagtggaaataatactaaaaataaaaatgatattcttgggaaagcaaaattaggggaaaactcagcaaccaatgtatgcagtccatctttgggaaacatctctaatgtcgatacaaatggggaacatttagaaagttatgaggctgagatctccactagaccatgccttgcattagctccagatagcccagataatgatctcagagctggtcagtttggaatttctgccagaaagccattcaccactctgggtgaggtggctccagtatgggtaccggattctcaggctccaaattgcatgaaatgtgaagccaggtttacattcaccaaaaggaggcatcactgcagagcatgtgggaaggtaagttgcatgtatacactcagaaatcgggcatgcacattttgtaatgctgaattaaatagtaataaaggcaatgtaaggtgaatatatgtctggttgagttgacctaaatagcatttttgaaaacccagttctagtaaatttctatataaaaaatgatgtcactgattcttagatagtatttgtaattttttttgttgccacgatttatgctgaatcagtttttatgaagagatgagaattgaggaagtgtaaactttgtggtttctgtattgatagctacttggttaatgtaatagtttgaaataaggaagttattctttcagtttaggaaatatttgtcattaacttattgcattatttattgaaaaatgcatttaaatacaaaaaataaaaataaaaattacatttaattgttgaaaaatattacacatagaatccatcctacttttttctgtgagatttttgccattatacaaaacattctggaactctttatacacatgcacacatatttttgtcttttctcccatataactttgatacaaagtagagttgaagtctgtagatttttatgacaaggttgtaagaatgatattccttagctctccccaaattttgttagctaaaaacacatcttttttgtttgtttgtttagagttgtaaataaggaaggaaggagattttatatttttgagatatggtgtcaggtctagaataaaatttcagctttgttactattaattatataactttactaagccttagttttataatctgtaaaaacaaaccaaaaaagattaataacttttattgggctgttgtcaagattaaatgagatctcagaagtcatagtgctcaatgattaatctctacctcccttcttgcctgattttttggtccatctgtattaattagggtgctttcaacttcaaggaacagagtgtttgaccccccagtgacttaggtgaaaataacatttatttcatgtaaacagaagctatgagactcagtgatttatgtctgggtgcagagacaggatcgtggaagttctctcggtcttcccctcatgtcagaagatagtatctcagttctaattatcgggtctcaacctgacaacttcctaagcacaaagaaactggctggggggcaaaagagcctactctactcttggcaccctcttatcagggaggaagggacctccagcaacttcctttaatttattggccaattttagaccataaccaattacaggcaaaggggactgggattatctaatcaatcatgatttatctcctggggctgagcacagtgttgcctgaaaaaaagtgggattctgttaacaaaggagaaggggaagtagtgatatgtaggatgagtaagtctagacgtctaatgtactacatgaggactatgcataataaaatcatactatatttgggattcttgcaaaatgagtagattttggttcctcttgccacaaaaatgggtaactgtgtgagacaatagataggttaatttgcttcactatagtaacctttttactgtctggatgtatctcataacatcatgttgtataccttaaatgtatacaataaaatttattttaaaaaaaggagaggaggaaaatggttcctaggtgagcagtcactaaggtttactagaagatcctagcacaaaagaaccaaattacagggagcagaaagaagctaaagctgacactgggcttgttggtctctgattgctaaagtttgaagaaaataatatgtctaattcctaaatattttccagtcttcttcttgttagctgaagtactatttgtagattaggttcatcatttttatgttgttctgtattttgcttactgtaacactttctgaagtgtttgctttcttaagtaaataatgaaaacatttttggtataggccagcacatccagctataatgagtaaataggtaccttagatggattcagaaagaaaatgatgcacaaaatgcatcataaattgcaaaatggttggaatttttgctgagtagaatttgtggaatttatgaattcatggattcatgtggcttatggattcataatttcatctttttccctcgtttaccttagagatgttataagtattaatgagataatatctgtaaaaatccttgagcttctcagaagaaaagggcttataaacatagatactaattggattatgctgagaatgcagctagaaaaataccccaaataatgttatatattgaaaaaaagaaagtttgttccatttcagtagaaattaagcatacgtagtaattacttaatatttatagctatattccctttactgcaacaagcatatattgtgtctaatatataaaaggttctaggctaggtaatggggattcagaggtatataaattggaatttatgatgtcatggcaatctttttttttttttttttttttttgagacagagtctctgttgcccaggctggagtgtatggcgtgatctcagttcactgcaacctctgcctcctgggctcaggcaattctcctgcctcagcctcctgagtagctgggaccacaggcatgcgccaacgggcctggctagtttttgtatttttagtagaggcggggtttcaccatgttggccaggctggcctggaactcctgaccttaagtgatccacttgccttggcctcccaaagtgctgggattacagacatgagccactgcgcctggccaatctactgactttctaattatgatttcatttatgtcttatctaagtttattatttgtttttgtaattcagttccaagcttgatgagggtaaggattttttctgccttgattgctgctgtatcctcagccctagaacatacgggtgctcagtagatatttgttagatgaattaaacaataagtgaatactgtttcttaatgcagcagtactttttttttttttaaatccagtgccttcaatctttagatgatggtatcaaatttagatataacgggtgtaagaactttggaaaatattttaaattagtcatgtgtattgttcctacttaagaacagattcaaaccaaaatgtttctttccctagtttcttatgtactgatgggaatgaatagatatgagagtagtaagtagctgctttagaatattacatggcaattcacagtttccctcatactttgcatgaaaatctgtcttgccttgtaattgatattgtgattttagccatctggcatgaaaaaaacagaaccaacatttagattaatcttggtttctagtgaagctgaacccagggaaatattttccattacacaccctctgaaaggctgtattggttaaaagtggtctcatccatgtcatagcacttatcatgcagtattgtctttgtctttgttccccattaggctgtaaagatcttgagattgcctctgatttgtctttgtatccagcatccagcacaaatacctggcacctatgaagtactcaataaatgtttgttaatgagtgagtaaatgagtctcagatcattgattaattcaacaaacactgagtgcctgttatttgtctgtcactgtgctgggtgccgagcttacaccaatgatgttgtgctccccaccctcatggtatgtaaagattaggccagtgacaaaaacaaaacaaaacaaaaaaacatgatttgtggcaagggcgatgaaggagataaggagggataatataaaaaatgggggtgggagaagaaggtatgagaagacatctgagaagtgacatagttcaaggttgacacatcaaggttgacacataaaggtggaggagtcagttcttcaaagaacagagaaaaatgctgcaggaagtagaacagcatggacaaagtcattgaggttaagaaggcacctattcaacaaactgaaggaactcctgcaggaagtagaacagcatggacaaagtcattgaggttaagaaggcacctattcaacaaactgaaggaactccagtatagtgaacgagggaagagtcacataaaaagagatgggaaagcaggtggggtggcacaggcctgttgtcccagctactccataggctgagcatgttatgatcatgtctatgaatagccactgtactccagccagagtgacagagctgagaccccatctccactaaaaaaaaaaaaatgctgatgaggaagttaaggaatagatgatgcagagctttgcaggtcatgtaaggagcacagtgggaagccatgggagtggatgagattaccaagggaagagaatagactcagggctgagcccatgtggtcaagcagaggaggacccagtaccagttgccaaggagtgagcggagaggtaaatagaaaaccaggaaaatatggtctcttggaagtcaaaagaggaatgtagtttgtgaaagggtttatcacctatataaaatactgtcagtaagatatggacaggaaagggaccattggacttggctataacagggtcattgaaaaaagctgattgagtggagcaatgtttacagaagccagatgggaatgggttgaaagtggaatatgaagggaggaagtggtgatggctttttcaagaacttttgccatgaaaacagaaaaaaattgtagcaattattagatggagatggtggttatggatgcctttttggaggatgggaaatactgttgtatttttatagtggtatgggtgattctctagaaaagaagttttaggagaaagggaggattaaacaaaggaagagaaaaatccttgagaaggccaaagggatgggatctacaacatgttgaggatttgctcttcagtgggtggggctagacagaggttggtttatgaagttagtggtgagagcatgaagaaatttacacctgattggcttatacttcatatagaaaatataaacattgtgaagggtgaaatagggatagatgatgaaggtttgaggagagtgagatagttacattggagaggaaaagtaaagcctaatagtgaattgaaatttcaagagccctttgtgcttggcatcaaactttcagtcagttagatgaattaaaaaataatctagtccagtcctgacttaatgggttagaatcagtatttatccttggagatatgatgaaattgttatattatctttgcgatacaagcattttagtttggagaagcaagaagagttctgtaggacccgtctgtgctactacctgtctacctatttccatgtatttgttcttttttaaaacaatttaaaaaaacttttagctggatgcagtggctcatgcctgtaatctcagcactttgggaggctgaggcaagtggatagcttgagatcatgagttcgagaccagcctggccaatatggtgaaacctcatctctgctaaaaatacaaaaattagctgggcgtggtggcaggggcctgtaatgccagctactcaggaggctgaggcacgagaattatttgaacccaggaggcagaggttgcagtgagccgagatcgagatcacgccactgcactccagcctgggtgacagagagagactctgtctcaaaaaaaaaaaaaattatgacatattatttgttctttcattcagtgagcatttacttattgcttggtattctgttttttactaaagagaagcaaaaagaaaaaaaaaaaggaaaagaatgggcctcctggtaaaacataccactcatgttactgtagatgacttaaagatataaaatgagaaatgaacagttacaaagctgcagatgctctgcagtgggaagcagatagattgtggtggtggtggtggttgtgaggagaatgagatactaatatttattgagtgtttaccatgtgccaggcgcttttctaaatccagacttacagactttatttaatacacataacaaccctatgaagtagctagctactgttaaaatccacatttacaagtgacaaaataggcctagaaagattaagtaacttgttcaaaatcacacagccagtaagtgaagttacgattcaaactcagggactttgacttctagaaccaaaagggagctagcatttgtttagtgcctattctgtgctttatttattatctaacttaatcttcctggtaaacctgtgtgatagttgatggtatccctaattaacattgaagaaactgatacggtaggaccctgacacagtcttgctagctgtataactcatgctctttcccataaataaagttgagagaataaaacaaataggtttctttatggtgatctttatgttattttctttgcatttctgagagaaatgtctgcatttatgccataatttttatttttaatttttggagacagggtctcactctgtcgcccaggctggagtgcagtgatgcaatctcaactgactgcagcctctacttcctgggcccaggcaattatcccacctcagcctcctgagcagctgggactacaggcacacaccaccacacccagctaatttttgtattttttggtagagacaggatttcaccgtgttgcctgggctagtctcaaaactcctgggctctactgatacatcagccttggcctcccaaagtgctgggattacaggtgtgagccaccatgcctggcctttatgccgtaatttttaaaacaaatgccttaaatactatttcaaaaagaaagatgaaaaatatctaacattttattagatataaatttttattttgaatagttatgtgttaaattagttgcagtttatttttgggtaacttgagttgaagtcatttttgtttaacatttgagaatttagatgtgaatagagaataaccttcataaaatctgaattagtaacacattaagacaaataatgttttggcttataccttcagagatcagttttcttaaggattttttttatcctgttttttttcctgggttttttttttttttgagacaaactcttggtctgttgcccaggctggagtgcagtggcatgatggtggctcactgcaaccttgaccttccaaggtcaagcgatcctcccacctcagcctcctgggtagctggggctacgagcatgtgccaccacgtgtaactaattttttttttttttttttttttgagatggagtttcactcttgttgcttgcccaggctggagtgcagtagcaagatcttggctcactgcaacctctacctcctgggttcaagcgattctcctgcctcagcctcctaagtagcagggattacaggcacctgccaccacacccgactaatttttttatttttagtagagacggggtttcatcatgttggccaggctggtctcgagctcctgacctcaggtgatccacccacctttgccttccaaagtgttgggattacaggcgtgagccgctgtgcccggccactaattttttaaaaaatttaatgttgcccaggctggtctcgaaatcctgggctcaagggatcctcttcacctcggcctccccaagtgttgggattatatgtgtgagccactgctcctggctgcctttgattttaaaacatggccactggttgggctccttgggaagcagaaaggtagtagtaggccctcactcagtaccaaatgttattaacagataacttaggtgcaaagtgggataaaacacatgtagctagaaaatgtttgcactaagttcatgctattttttgtttttttgcatctcttctcctgaaagccatctccctttcaatatctagtctgctgatacattctaaatactagtcacaattttttattgtaaaatatgcataacataaaatttaccagtgtatatgggtttgagggtatatggttcagtggcgttacatgcattcacattgttgttgtacaaccataacaactatctccagagctttttgtttttttttgagacggagtctcgcttcgttgcccaggctggagtgcagtggcgcaatctcggctcactgcaacctctgcctcctgggttcaagtgattctcctgcctcagcctcccgagtagttgggattacaagcacccaccaccatgcctggctaatttttgtatttttagtagagacggggtttcgccatgttagtcaggctggtctcaaactcctgacctcaggtgatctgcccgtcttggcctcctaaagtgctgggattacaggtgtgagccactgtgcctggccatttttatcatctcaaacttaataacttcccatctttccttgcccctaatgcctggtgactgctattctaccatctgtttgtatgaatttcactattctaggtacctcatataagagtggttacacaatgtttgtacctttgtgtctacacatttcatccatgtcgtagcatgtattagtcagaaggacagaaccaataggatgtggagatatatagatatatatatatgactttaataggtaggatatatgtatatatacgagagtttattagggagaatcaactcacatggttagaaggtgaattcccacaataatctattggcaacctcgggaaagagaagctagtggtagggctcagcccaagtttgaaagcctcaaaagcaggaaaaccaacagtgcagccctcaatctgaggcctaaggcctgagagacccccagaaggctgctagtgcaagtcttagaatccagagcccaaagaacctggagtctgatgtacatgggcaggaggagaggatataagcatctggcaaggaaaaagagaaagcaagcaggaagactcagcaagcaggcttatctttgcttcttctgcctgctttgttttagtgcactggcagctgattgtatggtgcccacccccattgagagtgggtcttcttctcccagtccactgactcaaatgtcagtctcctctggcagtaccctcacagagacacccagaaacaataccagccatctaggcattcctcaatccagtcaagttaacacttaatactaatcatcacatagtgtgtatcagagtttcattcctttttaagtctgaatatttcattgtatgtatgtaccacattttgttaattcatttatccatcaatggacacttcagttgtttccacctcttgggtattaccaataatgctactatgaacatgggtgtacaagcatctgtttgagtccctgctttcagttctttgtgtatatacccagaagtagaattgctggattatatggtagtcctgtgtttgattttttgattaagcaccatattctttttccactgcagttgcacaattttccattcccgtcaacaattcacaagagctccagtttctccacatcttctttggctctgtgtccccacccaaatctcatctcgaattgtaatccccatgtgttgggggaggggcctggtaggaggtgattgaatagtgggggcagatttcccccttgctgttctcataatagtgagttctcatgagatctggttgtttgaaagtatgtggcactttcccctttgcatgctctgtctctcctgttccaccacggtaagatgtgcttgcttccccctttgccttttgtcatgattgtaagtttcctggggccttccagtcatgttccctgttaagtctgtggaactgtgagtcagtgaaatcccttttcttcataaattatccagtctccagtagttcttcataacaatgtgaaaacagactaatacacttgtcaacacttgttttctattgttttgatatagccatattaataggtgtgaagtggtatctcattgtggttttggtttgtatttctctgatggttagtgatgttgagcctcttttcatgtacttactggtctctatattaaaaatctttggagaaatgtctattcaggtcttttgcccatttttaaattgggttgtgttttctgttgttgagttttagagctctttatatataattcagtctcctatcacataaatgatttgcagatattttctcttattcttgggtttttcattctgttgtcctttgatgcaccaaagtttttaattttgatgaactccaacttacattttcttttgttgcctgtgcttttggtgtcatatcaaagaaatcatctccaaatttgatgtcatgaagtctttcccttatgttgtcttctaagtgttttgcagttttagtgcttgcgtttaggtcttttatccattttgagttaattttttgtgtatagtattagcttagttttattcttttgaatgtggatatctggttttctcagtatcatttgttggaaagactgttctgttcctatggaatggttttggcactcttgtcaaaactaactggaccatataagtgagagtttatttctgggcttttttctattccattggtctttatgtctgtctttaatgtcagtaccacatggttttgattaccatagcttcatagtaagttttgaaaacatggaatgtgagtcctctggggttgtagtttgtcaggattattttggctattctggatcccttgagattcaatttgaatttgagaatggatttttctgtttctgcagaaaacatggttagggttttgatagagattgcgttgaatctgtagatcactatgggcattgttgacatcttaataataagccttctagtccatgaacatggaatgtttttccatttatttgtatgttctttaatttcttttagcaatcttttgtcttttgtagttttcactgtacagtattttacctccttggttaagttaatttctaggtattttattctttttgatgctattgtaaatggaattgtttccttgatttcatttttggataattcattattagtatgtagaaatgcaatggacttttttgttgatttttgtatcctgaaactttgccgcatttattagctctaacagtttttgtgtgtttgcggggaatctttaaggttttctaaatgtagcatatgttgtcagtatacagagataattttaccttttcctttccaacttgggtgccttttatttatttttaattgctctggctaaatttccaatactatgttaaatagatatggcaaaagtatgtatccttgtcttgtttctatcttaaagcaaaagttctttcagtctttttttttttttgagacagggtgtcattctgtcacccaggcttgagtgcactgccatgatctcagctcaccgcatcctcaacctcctgggctcaaggtatcctcccacctcagcctcccaagtagctgggactaacaggcgtgcactaccacacctggctaatttttttttatttttagtagacatgaggtctactgtgttgcccaggctggttctgaatgtctaggcacaagcgatctgcctgtcttggcctcccaaagtgctaggattacaagtgtgagtcaccatgcttggccagttttcagtcgtttttgttgttgttgttgttgttgttgttgtttgtttgtttgttttttgtttttcttttttgagatggagtctcgctctgtcacccaggctggagtgcagtggcgcgatcttggctcactgcaacctctgcctctcgggttcaagcaattcttcttcttcagcctcctgagtagttgggattacaggcacatgccaccatgcctggctaatttttgtatttttagtagagacagggtttcaccatgttggccaggctagctttcggtcttttaccagtgcatatgatgttggctctgggtttttaatatatggcctttattatgctgagataatttacttctgttactagggttttttaaagttttttttaaatcatgaaagagtgttgaattttgttaaatgctttttctgtatgaattgagatgatcatttggggttttttgtttcattttgttcaggtaatgtgattacattaattgattttcataagttgaattatccttgcattccagtaataaatatcacttggtcatggtgtataattctatcaatatgttcaattcaatttgctattattttcttgagttttgtatcagtatacattcatacagaatattggtctatagttttcttataatatgtttgccttgttttggtatcaagatagtgctggcttcacagaaggagttaggaagtatttcctcctcttcaattttttggaagagtttgagaaggattggtgttctttaaatgtttggtagaatttgccaccaaaatcatctgatctagggctttactttgttgggaagtttttgattactgattcagtctccccactagttataggtttattcagattttctgtttattactgattcagtcttggtaggttttgtgtttttagaagtttatccatttaatctaggtaagtcacatttttgttgtagcgttgaggcattttttttttttttacaaaaaattggtactcatatacataaagtaatatgaacttaaaattcatacatttacttcattttttagcttgacattctagtaaatcttttgctccatttatttttggttatgatagcagaagatctacctggatgatttaagagcatcatttgtcaatgagcacctcttattttctctttattggcagtagtgcttacagctactattaatgctgctttccattttgtcgtttcgggttcaaacatacctctgtaatagccaccactgaaggcagattttggtagactttgaaaaatttgttttgttgttgttgttgttgttgttgtttgttttggggtttttttgttttgttttgttttgttttgttttgttagagacggagtcttgctctgttgcccaggctggagtgcgatagcgcaatctcggctcaccgcaacctctgcctcctgggttcaagtgtttctcctgcctcagactcccaagtagctgggactacaggcgtatgccaccacacccagctaattttttgtatttttagtacagacgagttttactgtgttagccagggtggtctcgatctcctgacctcatgatacgcccaccttggcctcccaaagtgctggaattacaggcatgagccaccacgcctggccgaaaaatttgttttacttgaggttccacatgccttatataagggttgcaaaacataacagcctgcaaatcctgcagcagcaatggtcagtccgactgctaccactgtactggccatggctgggctcccctactgcaccaggagcatggctcatcccagcccagaggttgcggccaacaatgacacacctttaccagagagtgacacaggcaccgatggcaagcacaatacactggattataatttttttaaacaagaggattatttgaaaaacagtctaggtgcggtggctcacgcctgtaatcccagcactttgggaggccaaggcaggcagatcacttgagcccaggaattctagaccagcctgggcatggtggcatgtgcctgtagtcccagctactcaagaggatcacctgagcccagggtaatcgaggctgcagtgagctgtgctcacaccactgcactccagcctgggtgacagagtgagaccctgtctcaaaaaagaaagaaaaacacagtttatgttgttgttgtatatcgagtcttaaatcaatgcttcctctggcagaacaaatcagaagttggttatacagtatcaactggccaagtgtctttattatttacagcatctacattagtttttaaaaccatcacattttcaatatataaatgggcaaaaagatgtttagatgggttagtaaacaatggagaaatattttaatttactagatactaagaggtagaaattaaaatttttaaaattttatgcctatataacaaaaaatagaaaatgttgatagtatgatagatagtgaaattgacactggcatatttacacatttaaaaagccacacgtgggtcgctggggaacccaggctgtcctaggaagccgagtgggagtggcacagagctgctggagatcctgagaacctgagttttggcaagcagccagaatacttaaaaaatgaccacaccaaacaaggcacctcctggtactgaccctgagcagttggaaaagactggaacagtacgggaaattgggtcacaagctgtttggtcactctcatcttgcaaaccaggatttggagtggatcagttacgagatgacaatctagaaacttattggcaatcagatggctcccagcctcatttagtgaacatccaattcagaagaaaaacaacagttaagacattatatatttatgcagactacaaatctgatgaaagctatactccaagcaagatttcagccaaagtaggaaataattttcacaaccttcaagaaattcggcaacttgaattggtggaaccaagtggctggattcatattcccttaactgataatcataggaagccaacttggacgttaatgatacagattgctgttctagccagtcatcaaaatggaaaagacacccacccatatgagacaaattaaaatatacacactggtagaagagagcgccattggtaaatttcctagatgtacaactatagatttcatgatgtattgttcaataaggtgactttaaaatgatatggaagtcattaaacgtatctttgttttatcctgtctttaaatagtatatcagttacctttattgaaaaaaacatcagttatttgcaactttatatatatttaaaaatattttattgtaattttgataaatttgggtcatattatctttaacatgtaataaagctcacatattttacattactaaaaaaaaaaaaaaaaagccatatgtgtggctgggcgtggtggctcacacctgtaaatcctagcactctgggaggccgaggcaggcagatcgcttgagcccaggagttcaagagcagtgtgggcaacatggcaagacctcatctctgccaaacaaaaggggacgtatgttccaattttttgagctaatgattccttttttgagtaaataattcttaaaacaagtgcagtaaacaaaaagatgtgtattttagtgttactaaatagcaaatacatttaaagtaatttgtgtccaaaattggataatgggccaggtgtggtggctcattcctgtaatcccagccctttgggaggccaaggtgagaggatcacttgagctcaggagttcgagaccagcccaggtaacgcagtgagacctcatctctactaaaaattaaaaaatggcgggatgtggtggtacatgcctgtagtcctagctacttgggaggctgaggtggaaggattccttgagcttaggagttcgagaccagcctgggcaacataatatctctgctaaaaattaaaaaatagctggatatggtagggcatgtctgtagtcccagctacttgggaggctgagttgggaggatcacttgaacccaggaggtcgaggctgcagtgagccatgattgtgccagtacacttcagcctgggtgataaacgagaccatgtctcaaaaaaaaaaaaaaaaggttaatggtaagttaagtacaatacatatatttgcttcagccattaaaaattattacaaggcagtgtagaaaatgcttatgatgacatatgaatagaacagaatgcaagcttatgctttgtttacaattaaattattcttgggcataaaaacagatatgtctgaaggaaacatatttttaaaaagtaattttagagccaggcacggtgggtcatgcctgtaatcccagcactatgggaggctgaggcgggcggatcaccagaggtcgggagttcaagaccagcctgaccgacctatggagaaaccctgactctactaaaaatacaaaattagccgggcatggtggcacatgcctgtagtcccggctactcagggggctgaggcaggagaatcgcttgaacctgggaggcggcggttgcggtgagccgagatcgcaccattgcactccagcctgggcaacaagagcaaaaccatctcaaaaaaaaaaaaaaaaaagtaattttaggctggatgcagtggctcatgcctgtaatcccagcactttgggaggccgaggcaggtgaatcacctgaggtcaggagttcaagactagcttgggcaacgtggcaaaactccatctttattaaaaatactaaaattagctgggtattgcggcgcgtacctgtagtctcagttacttgggaggtcgcagtgagccgagattgcatcactgcactctagtctgggtaacagagagagactctgactcaaaaaaaattttttttaattcattgagtctgagctattatgcttatttcttttcttttcttttatttgctgtactttacttttcttttcttttcttttcttttcttttcttttctctctttctttctttccttccttccttccttcctggcttccttctttcctttctttctttctgtctttctttctttctctctctctctctctctctttctttcttttctttctttcagatggagtctcgctctgtcttccaggctggagtgcaacggcgcgatctcagctcactgcagtctccacctcctgggttcaagtgattctcctgcctcagcctcccaagtagctgagataacaggcgtgtgccaccaccacgcctagctaatttttgtatttttagtagagacggggtttcaccatgttggtcaggctggtcttgaactcctgaccttgtgatctgtccacatcagcctcccaaagcgctgggattacaggcatgagccaccatgcccggctcttttttttttctttttcttttttgagacagttttgctcttgtcgctcaggctggagtgcagtggcacaacctcagctcactgcaacctctgcttcccttcccaggtttaagcaattttccttgcctcagcctctcaagtagctgggattacaggcatgtgccaccacgctcagcagatttgtatatttttagtagagatggggtttcaccatgttggctgggctggtacagcctcagttggatataatattgaaagtctgaattagagatctcttttaaccctttctgtaatggacacttaaaatgactctgataattattattgttttctattaataacagtgaagtttaaacaggtgtttagacagaggcaagggtctggatttgtttgaactgctttagatcttatgatactgatttttgctatgtgctaataagtggagggataaagtactcctgcatttgacaatttttataagttgttactttcactggtctttgtgaacagctggacactggtcagttctatgcactctcctctcctgtttttattattctcacatcacagttatttttgtcataattatagggctttttgaagacctgggacatcattttttgcattttctaatttggaaagaaataagtgagcatttgatgatttgaattttcaagaattgcaaaggaataagtgttattcacactgtaagagggtataaataggcacaaagtggtactttgaatataaagcatgttcacagatttagcaataggatttgttatgtggaaagcctgtagtgggaaattttaaaaggaaaggaaagggaaataagaaaggtaccaacatacatttagaacctattatatgctacattttatacatataatttcatttaatcttcataaaagccatatgaaggaaatactgtattagcatttctattttacatgtgagaaaaactaagacctagagagtttaaattattcccataaggtcatctgactagagaataatcaagttgaaataggaacacagaagtgccacatttaaaaaaattacatataaacacacaaatggaaccttttaaccagtacttagctggaacatcgtatagaatatatattataaattaccttactttgtctctttatgcttaggcaggtcatacggatcctgccatatgatgtcagctgtaaccattaggcataaaaatcttgaggtcattcttataaacagattaaaatgtgttgttgcaaaagttgaatggctctagattattttctgaatttggatatgaatcatatagtccttccccaaaaagtttacattaatgtttgtttctccattcatacatttatgtatttatgtatttatttattttttgagacggggtttcgctcttgtctcccaggctggaatgcggtggcgcgatctctgctcactgcaacctccacctcttgggttctcctgcctcagcctcctgagtagctgggattataggcgcctgccaccactcctggctaatttttgtatttttagtagagatagggtttcaccatatttcaccaggctggtctcaaactcctgacctcaggtgatccacctgccttggcctcccaaagtgctgggattacacacatgagccactgcacctagtcccagtcatacatttatttatgcaataactttacttttcaaggaagcaataagcaaatatttactgagtactatgtttcagacacaatattgaagataccagtattaaaaataatttagctcattattccatggagtttacattctagtgtggggaaatggagaataagttcaatcagtgcagtagattgtgttgtgataaagatatatggcatatggtaagatatttcagcagtataatttaagttcaggtgtgcaaatatgtaattttcttaatttttagaactgactttacttttttactctaagcctgtagcttagagaactggggaaggtacttagatggtatatggaatatagtggggtatttttagttgtcagaatgactgaggttgctactggcatttagcaacctgtgcataccaagactgctaaacatcttgctatgcccaggacagtactgtcctatgaagaactggcccacctaaaatgccaagagtgcccctgttgagaagcactgactaacctggctcatggtagacaatttcatcttgatctttttaggcaaaattgactattatccagtaatttcaaattcaggattatttaaactatcccaaacctggctcaaatctcttagattctgcccatctcctctgtgatactaattcttatgacctatgaatctcactacgtcatagtctggcgttgaagagtcatctacttttctagctaactcctgtgctttcctctaatctcattggaaacgtaaaggatctctctatactgttcttcggcctgtgggatattgagaaagatgggtattcttgggttcttctgtgtttactccatttgctgctcccttgcttgcttttttttttttaagatactttgttttttattcaaaaatcattatttgagattattgtcccaaagcctaactcactacttctgaatgttcccaactatattagtttgctacagttagcaaaataccacaaattgggcagcttaagcagaaatttattatctcacagttattagaagtctgaaattaaggtgatagcagggttggttcctcctgggggctgtacggaaaagatctcttccatgtctctctccttggtttgtagatcgacatcttcatgttcatatggtggtgttcttgtatgtatacctgtgtccatatttgcctcttttataagggtatcagtcatgttggattaggagactaccctaatcacttcattttgattacctctgtagagaccctatcttcaaataaggtcacattctaaggtgttaggagttaagacttcagcttaagtatttgtgggggatacagttcaacccataaaagcaactaatttttttaaatttttttctaatttaaaaagtacagaaaaaactaatcaaaataaaataaaaatatcccaatacaacatttaaaaaattatataaagtaaaaggagagaaaagatagccagctgtggtggctcatgcctgtaatcccagcactttgggaggcccaggcgggcagatcacttgaggtcagaagttcgagaccagcctggccaacatggcgaaaccctgtctctactaaaaaaaaaaaaaaaaaaaaaaatcgctgggcatggtggtgcacacctgtaatcccagctgttcaggaggctgaagcaccagaatcgcttgaacctgggaggaagaggttgcagtgagctgaaatggtgccactgcactccagcctgggcgacacagcaagactgtgtctaaaaataaaaaagaaaaaggccctacttccattccaatctcatcctccaacttgactatatttttcttttccatgtcaatcggtacatacagaactatttcattctttttatgggaacgggattccattttatgggtatactgcagtttaattagctgttacactactgatgaacacttgggttgtttacaacttttattataaacaatatggagataattcttgtgtagatctctttgcacatgtggatgttttcagtagtgtaaaattttaaaactgtgtgctgagtcatactgaataaacacttccaattttaaaagatattgtcaaattaacctaccagcgtatattactaccagcagaatctaagagctataccctcaccaccgttagatattatcagtgtttaaaaaaaaaatctttgctagtctcatagtaaaaacatactataaaactcattgttttattttgtcatgtgtggtatttactatatctgttggccattttatttattttttctgtgtatttaccaatgtgagttctttgccttatttccttggaggtatttgttggttattgaagctcatgtttttatcataaattaatttttttgtaataattgtagtagctcattaaggtttcccaaatccattcttattctcttccttttttttctccctacactgtgcccatacagatctgatcatgtctttctctttgattaaaatgcttaagtgggggctgggcacggtagttcacatctgtaatcccagcactttgggaggctgagccgggcagatcacctgaggtcaggagttcaagaccagcctgaccaacctggtgaaaccccatctctactaaaaatacaaaaattagctgggcatggtggcacacacctgtaatcccagctacttgggaggctgaggcaggagaatggcttgaaccctagaggcggaggttgcaatgagctgagatcacaccattgcactccagcctgggcgacagagcaagactctagctcaaagaaaaaaaaatgcttaagggctttcccattgctctattaaaaaggtcaaaacagatcctacagagcctttgcttggtctggcctcagcatattccatgcatcccttaactcttggggcctcaagccatattaactttttttagttatttggtgggtccatgcttcttcccctaataggaactgtgtacatactatttcctctactattactgtctcttcttggcacctctttgttcacagaaaactcttacccatccttcagatttgatgtcttgtcatttcctaaatcttccctgaccttgccaatctaggctagagcctagattacatgatcttatttcaccatttaccacttttgaaacacgtgatttatattcacttgtatggtttttctttttctttctttcttttttttttttttttttgagacagggttttgctgtgttacccagacaggagtgcagtggccattcacaggtgcagtcatagtgtagtgtgtcttcaaactcctggcttcaagccatcttcctgcctcagcctcccatgtagctgggacaataggtgtactcctctatgcccagccttgtgttattatttgattttaggttataacctgaaacccttgcactaaattgcattgcatgaaggcaaggaccatgtccgttttgttttctgccacatccccattgggtagcttggtgcccagtacatagtaagagttcatatatttgtggaataaatgagtgaatgatggattcttggttttgtctctttattagaaaggttattgaaggattttaagaaatttaacattattagatttattttttagaaagttcagtctttgtttggaagattaattggaaaggcagatgtgaagattaggagaacagttaggttatcatcatgatcgtttagtcctcagataataacagcctgaacagaggcagcaatgttagagataggagaagatgtgattttggaagaacaatttcagaggaaaactaacaggacttaatgactgactggatgtggtcatggcgagggagaaggaaaagtcaagactcaaaatttaaatgaaatatgtaatttagtatgaagtagtattacagagtagttaactatagagccattgcagtcatacagattaatcatgtaatttactagctgtatgaccctggtaattttacttaatgtcttagtccattcgggctgctataacaaaataccatagactagatggcttataaataacagagatttgttacagtctggagcctggtaagtccaagatcaaggcaacggtagatttggtatctggcgagggcctgcttacttatagacagctgtgttctcactctaacttcacagggcagaagggtgaggagtctccctcaggcttcttttatagggcactaatcccatatgccccactacctaataccatctcttttggggttaagatttcaacataggagttttggaacattcatctgtttacctaactgctaattgtaaatgagtgtcttcatggaatttttgaggttaaatgtaacacatgtaaagtgcctagtagtcatatagtttgctgtgaacttgaggaagtcatttaaccatctaaactcagtttcttctgatagaaaataaggataatatgtataccctttgttctccctgtatcacagggatatctccctatatcacatttaagaatgtcaagccctataaaaattgtaaactgataacagtcatagtaactagatattaattatacatagaaggatgggagatatcgagcttaacttagactttaatatgacccctcatctcttggttcaactttgtaaagtataggatgcttcttggctgtaaaaactgaagaagtagaatttatcctactgggaacaggcttttgccactgtaaggctctatgtggtaaatgactgatgagttctcaagaaaataaatctggccgggtgtggtggctcacgcctgtaatcccagcactttgggaggccgaggtgggtggatcacttgagttcaggagtttgagactagcctggccaacatggtgaaaccccgtctcttctaataatacaaaaaaaaattagccaggcgtggtggcttacacctgaagtcccagctactcaggaggctcaggcagaagaatcacttgaacccaggaggtggaggttgcagcagtgaaccaagatcgcaccactgcactccagcctgggccacagagtcaaattgtgtctcaaaaaaaaaaaaaaaaaaagaaaagaaatcttaacaggaacaaaggagattgttgttgcctggtgtagaggggagaaggaagtgagattaccaggaaccaagcccagaaggtggaaattggcatggcagattttgattgcctgctgtgatttcctgtagctaaagcagtgcgtttgtttatgattgagttgtatatattgacccttggccttcatagcaaaaacagtgaaaacagctggtatagttattattccacatataaggatagtaacaaacagaagttaaaacacagaaattccaatctttgtttatttcatcctgctataattcctttccaaacggaaatagcacatgtaactatctttcaacacccatgttaggtgattgtgtgcatagaaatcttgcctaggggtaattcaggtggttttttccccactgctgtatatttgccacgtgatcttagttaagatttttattttcagccaatgtttcccatttctttattgttgacagacttgtaatctcactcttgcttttgaattacccaacttcctgaactacattttctttgaaactttagtattgtagtttaataaggttcactgacaatcagtgtttgtcaatattggttcactctctttgcatggcaatcccaagtaaattttgtgtgttcttccccccccccccccacaggttttctgtgcttcctgctgtagcctgaaatgtaaactgttatacatggacagaaaggaagctagagtgtgtgtaatctgccattcagtgctaatgaatggtaagtattaaaacaggttgatttcatagttattgagacaaaacaagggaattacgatgagaagacttttttccccctgcctttctttacaagttgctcaccttctcaaatgtcataactttaactgaaaatatttagctaaatttccatgttttgaaagtatcttagcatttcagaattcctgtgcctaatttaatgaataaatgctaaagccaggtaagttttgcaggaataatggaagttctttggaaatctggtgcgaggtagttatttgtgttcctataaaataaccagagtgaggtgggaatggggagcttttgatcaccagatgataagatgttaaaactgggctgagattttccttttaagagaagccatctctttctaaggaacaacttaataacttagcatgtgttcttatcaacaccttgtttcattcatcttgttgaagataactattttagcatctaggaccaagtagaaaattgcatttttaaagcccatttatctctttaatgctacttagatttgctatgagaataatggtttagaatctagttgttacgtggtaaaaagaatatggccggggaaagtaaataaaacttacccagtgttcatcttttgctggactggaaatgattttaagggcatattagttaaaaaccctgagtattcttgtaaaaagatacactaaaattgttcaggttatagtattttctctttgaatgcatctttgtacagttactggaacaattactaatagacataaaatgttgaacttgaacaccagtgctacctgtgccaggatagtgtgcctcctggaggctggaacttatctgctctgagacccctcctgctctgtccgtctgcattgctgatagtgatgttttcttgttgctggcttattaacctgttgcatgacagttaatctgatctgttctaatttcctatgatccacccagtttcctcccatttctgaattcttacaattttgaccaaatatgaatcattctctccactcttaagggttactttttaaatagtggttatttcacttggttgctcaattgatgatttttattctgctgctttcattttcgggcacatattcacagataagagcatgctgcttaattatagtacctaatacctcttttatttgatgagatcttccaacttgatagctaatttttttaacttggcatagctaaagatgaaggaaatggcagaggattcacatggaatacttactttttattaagccaaggaggcccttaacaggggatcctaaggtaatccacttttcctggtttttccagtgtctttcctctcgcatggcttagcccggtctttttcttaatatttaatttgatgcttttcggtgttccctatccctttttccctttctccttttctcttcctcccctctttctgccagtgctttcaaaggaacatagcttttgttactagccttgtcttgcagtttggaggcaataaatattcaaaatcctatggatcattctttgatgttgaaagagatttttgaaaggatgcttaaaaagagggtggcttctatttctgggcatgtggtattacctgaacctagaagataaaatttggtatctttcatttctgtagcacctttcatcctatttgctttaaaggcgataggtgatgtgtcagtatttagtgaaattatagggtacacagaatcttaatgtatttgtgatcatttatattggttgatcacacttacatgatattggcacattttcatgttcaaataggtcctgtgcttttgagacacaccaaagatgtgaaatggttgttactgatggatagttttatacagggtgatgattacataaaagcagaattcagaaaaagattgagatgtgtcctcctgagctttaggctttagaaatttttaatgagattttattttaactaacaagagccttaaaagtttagaaatgaaacttaaaattttacagtagagttattctattttagcccctgattttgctttttgatagaactttataaaatgcattaaatattaaatgaaaaaatgtctaaatgctatccaagtttcaaattcttaaagtttgatgttgtttgactccctcttaaggaaatgtttggtctcctataaagaaaccaggctccaacctttaactcagattgatctgctatcagtctatcagaagtatcctataattcttttttatttttaatttttttgagatggagtcttgctctgttgcccaggctggagtgcagtggtgtgacttggctcactgcaagctccacctcccgggttcatgccattctcctgcctcagcctcccaagtagctgggactacaggtgcctgccaccacacctggctaattttttgtatttttagtagagacggggtttcaccacgttagccaggatggtcttgatttcctgacctcgtgatccacccgcctcggcctcccaaagtgccgggattagaagcatgagccaccactcccggtctaattctttaaaaaaaaaaaaaaaaaaaaaaaaaaaatcatgttactcttatttgctccaaccaaatagtttacttggctaaatggtctcctttattacataaaatcacctatctctttaataccttcactaggtggaagagagacatactatgagtattaattaggagaagctgcattatttatccaatattgtggaggtcttgatgtccatattttgcaatccattcacattgattgtgtctgtatttgctttagctcaagcctgggagaacatgatgagtgcctcaagccagagccctaaccctaacaatcctgctgaatactgttctactatccctcccttgcagcaagctcaggcctcaggagctctgagctctccacctcccactgtgatggtacctgtgggagttttaaagcaccctggagcagaaggtaggggatcatgtgctattctctctctttttcctcacgaagttcctctgaaaaggtgctgatatgactttacagcacaagtcttaaaaaacactgcagataagtctctttgggtggttattaaaatggaacaacaaggtgagaaatgtgtcaagactatttctgggcaagtagagaataatatttgtgttgcttggtattttagaggcacctcagaatatatgtcagtctcctctccaacttaagaatggagtaattacactgcttgtccttaaaaagaggtgcagaatttgaagtcaatctgtaaattcctagcctacctcatgcctgtcttaatgttctttgtaggagtttagtaagtgataaaaatgagagttcttctttccgaccagcccattcaagtattgctttttggagtatacattgccattttctcttttcatttttaatctgtccatataaaaatatgaacatttttgtgttagggacatagactttaaatctagaactttaattctgattatatcatatgataggtagaaaattacaggctcaacttacattggtttattatatctttatgatgataatattgtcagatgaaaggcactgtgtaagtgcaggggattatgaatagtaaaaataacatttatttccttaaaatgatcttatcaagtttcccttggtaattaaaatcagtcttccttcattaattttatcttttcatctattaatattcccttccccttgctaaataacccacctttccttttgaagatcatagacttctattgacattatcatactcttccccattttttctcttttcagatcatcccttagtcatactccttgtatttttatgaatttaggctttcttaaaatctttattctcttcatttgttgtttttgttgttcttccctagtctctgtgtgttttggctgtttgaattgatttctaaaactggacttaaagggatcatttcatcagactcagttttccagctttttccctgtctttttactaaaacacaaattacttttgcactgccagatcagtctttttcttcttcagttacacttcaggcaaagatctggtcagtttgcttcccaattcttacatatctgtgccagctcttctgttataaatgaattattctttaacattcttcagggcatcttttgccctttgaaagtaccatatcactttaccagatgtttaatttctttggaaacctcataactttagaaaatgtgaatgtctattgcttttttcaccatgctattaatttatttccgaggcccttgaacactttccttagtttctctgtcagtgatacgggacagagtatgtgacataatcatagatgtatttaagaactcttaatatttcaaagcaaagtattttactctttgcatataagttaaacaagtaaagaatatatttaaatttgtatttttaattcatttataaccacttttatatacagttacatttctgatgtttctgattgtaagttgccaagtaatgatttctttgtacatctggaattggtgaccttctcttctttgatgttagaaaaccttccaatgccacattgatgcctgttttatttttctggcccctcaagtggctcagcccagagagcagaggcgagtttggtttgctgatgggatcttgcccaatggagaagttgctgatgcagccaaattaacaatgaatggaacttcctctgcaggaaccctggctgtgtcacacgacccagtcaagccagtaactaccagtcctctaccagcagaggtaagaaaacaaaacagcaactaaaattgcatagctactttactcagcattgtgctgcctctgttgaattacttttgtgtggaactctgtaggttttggatacaacttagtgtatacgtgcacatatatggataaagtaaatgtggcaaaaatcagctgctgttctttgctgtatatttagaagttttttcaggagaaaggttcttaatgaagattgttctcagatgagctcaggtgctccactttagctagcagtcgggctgtggggaattctgtccccttgctacattggtttttaaagcatgttccccaggttccatggcagcctctcaggagtgctatggtgaggaagagcaggtaacatgaaagggcctgaggagctgagtttaaaaccctggcttatcaacatcccctaccagagtggtacacttgttacacttgttgaacctacactgacacatcgtagccaacccaagtccacattttacattaggattggatacttttttttctttttttgagatagagtctctgttgcccgggctgcagtacagtggcgtgatcttggctcactgcaacctctacctcccaggttcaagcaattctcctgcctcagcctccaaagtaggtgggattacaggcgcctgccatcatgccaggctaatttttgtatttttagtagagacagggtttcaccatgttgcccaggctgcgtctcgaactcctgacctcaagtgatccaccccctcagcctcccaaagtgctaggattacaggtgtgagccaccacaccctatcaggattggataaaaattttactcctgatgttttcatagaattgttagttactaattatttatattaatgataagtaatatttttttagacatttacatcctatataatttgtgagtttgattgtaattgaaattgcatgttgttaagattagattttttgacatgcagagctgacttacctgtttggtgagttattgaaccatgtaatatctgtcttcaaatatttctagtttttgaatttttctgtggctgcagagggtgacagccagaactgtgtcttatccttctttgtatctccacagtgactttgtcaagaaagttttttctttattccccccaactgtttttttgtttgtttgttttggtttttttttttgagacaaggtctcactctatcgcccaggctccagtatagtgccgcagacatggctctctgcagccttaacgtcccaggctcaagcaatccttctgccacagcctcccaaatagctgggactgtaggcaagcctggccacaactgtttatttggaaaaaaattcaacctacagaaaagttacaagaatagtacagtgaatacccatatactcttcacctatcttcatcaacttaaccattttgccacatttgctctaccacttcacagtacacacgctttttttttatgacccatttaaggattggttgcacttcaccacttaatagttcagcttgtgtaccctaagaaaagtcattttcttatacaaccacaatgcaattatcacatgagatggaaacttaacatgtaattctggtttccccaattgtcacaataatgttctttatagctttaatttttttgttttgttttgttttgagatggagtcttgctctgtcgcccaggctggagtgcagtggtgcgatcctggctcactgcaagctccgcctcccgggttcacgccattctcctgcctcagtctcccgagtagctgggacaacaggcgcccgccaccatgcccagctaatttttatgtatttttagtagagatggggtttcacgatgttagccaggatggtctcgatctcctgacctcctgatctgccctccttggcctcccaaagtgctgggattacaggcgtaagccaccgcgcctggcctatagctttcatttttacatatatgtgtgtgcacagatatattaatttttaaaataaaatttatttttaaaaatcaagatctcattaaggaccacagttgcatttagttgtcatatttctttggtttgctttaatcttgaatagttctctctcttttttaaagtttttatatcattaatatttaagtatttgggccatgttttacatgatactctcaatttgtatttgtctgttttttttttttctcatgactagtttcagattaaacattttttggcagtaatgacaatcctacataagtgagggtgatttcttaaaggatcacatcaagaagtattagtttgggttgggtgcagtggctcacatctgtaatcccagcactttggaaggccaaggcaggaggattgcctgaaccccgagtttgagaccagcttgggcaacatagtcagactctgtctctatataaaattaaaaaattagctgggcatgatggcacatgcctgcagtcccagctactcaggaggctgaggcaggagggtgatgattttctctttctgttaaatttctttcctatctcttagtttgtatgatgggttcttaaactataaatatttttgaaagaatgaggaaagtctagtgagtgaatgttatagggaaacaattttctgctcattataagacaggctaagccacattattttgtgctctcacattgtgcaacactctaatatttatgtggtaaaatgagagaaagcaaactctttaatgccagactagaaaatattaatatttttcttatttttatggtctagtagagtgcctggcacttaacaagtgcccagtaaatgaagtaaatgtctttttattattattattatactttaagttctgggatacatgtgcagaacctgcaggtttgttacataggtatacatgtgcaatggtggtttgctgcacccatcaacccgtcatctagattttaagccccacagtaaatgccttttcacagaaggcatttaagtagagaccaactgaccactttttatgatattaaaaggaggatttttgcaccattcaatagtaggttagaatagattattttctgtaccaggccttcaagtcagttaatggtagtttgccagtaaaattttataaagttcctatatgatgccataccggaaaattttagaaatcccactaaaaatgtatagtcctaaaaactttgtcctaagtagagacagaagtatggcaaaacatgggcatatttattttattttattttattctttgtttgagtcagagttttgctcttgttgtccaggctggagtgcagtggcatgatctcagctcactgcaacctccgcctcctgggcttgagtgattctcctgcctcagcctcctgggtagctgggattacaggcgcccaccaccacacctggcaaattttgtatttttagtaagagacggtttcaccatgttggcaaggctggtcttgaactcttggcctcaggtgatctcccctccttggcctctcaaagtgctgggattacaggcatgagccaccatgtccagccatattttgaagaaatagttttaatgtttgttcaggtatacaatatatgtagcaaaatgcatgactaaggagcatgaatctttaggaaacaccttgaatttatacatggttttatatatatgtgcatgtgtgtatacacacacaaacacacacacataaaatatgtaagcaccattcaggtgaagatacagaacatctccagcactccataagggttccttatgcactttttctgtcagtaccttctcctttcatcaaggtaaccattgttctcacttctgtccctacagattagttttgcttattcttgaattcatataaatccaaacaatagtatataatgttttgtgtttagctttttaagctcaacttaatattatgagatttatccatatgcatcaaaaattaatttatttctgagtagtattccattgtatggatatgccatcatttatgttatgttctcctgttagtggccattcaaattgtttccagtttttggctattatgaatgaaatgaagctgctagaaataatcttttttttttttttttttttgagtctcgctctgttgcccagactggaatgcagtggcaggatctcggctcactgcaacctccaccttccaggttcaagcaattctcctgcctcggcctcccaagtggctgggattacaggcacacgcccagctaatttttatattttttgtagagatgggatttcaccatattggccaggctgatgttgaactcctgtccttaaacaatctgccttccttggccttccaaagtgctgggattacgggcgtgagccactgtacccggccgtatgaatattgttatacatgttaaaaacagcttttactgtttttcttttaactttttgttttgagacggagttttgttcttgttgcccaggcggagtgcaatggtgcgatcttagctcactgaaacctccgcctcctgggttcaagtgattctcctgcctcagcctccctagtagctgagattacaggcatgcgccaccacgcccaactaatttttgtattattagtagagatgggatttcaccatgttggccaggctggtctcaaactcctgacctcaggtgatccacccacctcagactcccaaagtgctgggattacaggcgtgagccaccgcacctggcctcttttaactctttaaaagcttctatttcatgtttaagttatagagaatatacatctgtatagtatgggaaataaaagttatagagaatgtagagaggagagcatcattttaataaacatttgagcatgttctatttaataattaagtggatttaacgccaaccaacatgttttgcaaccttatacttcattaaatatagctaatgtgatctgcctagtaatgcaaagaaaaacaaacttcaggccgggtgcagtggctcacacctgtaatcctagcactttgggaggccgaggttggcggatcacaaggtcaggagattgagaccatcctggctaacaggtgaaaccccatctctactaaaaatacaaaaattagccaggcgtggtggcacgcacctgtaatcccagctactcgggaggctgaggcaggagaattgcttgaacctgggaagcagaggttgtagatgatgccattgcactccagcctgggcgatagagtgagactccttctcaaaaaaaaaaaaaaaaaaaatgaacttcaagatttattttattacatagtaaatgaaaaatgatgacattttatcaaagttgatttttttcccttttttattgtggaaaaatattaacatatataacaaatgatttacaattttaacaatttttaagtgaattcattggcatcaagtacattcacattgttttgcaactatcaccactgttttcaaagttaatttttaaaagcaatataaattagaccttaagtagttcccaaggtattaaagattaagaaattatgaaataatattgaagttttgtttcttttgccactacagttttttaaaaatatttttctcttatggcaaaagaaacctgggtaaaggaagctttaatgcaggttttaaggcctcttctgtcattaccatgatttgatgataccaaaaggagaaacttacacatttgaaaacattttcatagtataagcctgatttgtttttttgttttttttaatccatgggttaatgaatattttgtgctacctttcaaaaagtatgaatttcagattttcacttaagttcccatttgtatttttaattatgtcctgccaaagtcttgaattctctgtagtgctcactttgttgatttgcttttcctagacggatatttgtctattctctgggagtataactcaggttggaagtcctgttggaagtgcaatgaatcttattcctgaagatggccttcctcccattctcatctccactggtgtaaaaggaggtaagtggactacatatttaaacagtgatagttctatctgccaaatgttaccttctaattaaggtagagagacagaatttgagtgacattcacctttctcttatccaacaaaacaaactcccccaaaactatgaaaatggttgttgctgttattattttagagtagatgcttatgtttttatattataatgtcattttcagtttttgaatggatataatattacttataatgtaaatgtagtttattagcagtttttaaaaatatttcaaagcacataatattctgaaggattgcttgtggtttaggatgaacccactctgatacagtcatttatttagcttttcattttgaggtataatatacattcagaaagaacgtatagtaagtgtgaagagcactgaatttaaatggcagttttactgttaaaaatatttttagggatcttgataagaagtaaaattattatctaatcaaaagaatgcttaatattatgtgaaattttatttttataattttaacttttattttagattcaaagggtatatgtgccaatctggtacatggatatagtggataatgctgaggtttgggttatgattgatcctgtcacccaggtagtgagcatagtacccaatgggtaatttttttttgtttttgtttttgttttttgttttgagacagggtctctttatccagtcagccactgatgggcagttaggttgattctatgtctttgttattgtgaatagtgctgcggtgaacattcaagtacatgtgtctttttggtagaacaatttattttcttttggatatacacccagtaatgggattgctgggctgaatggtagttctcctttaagttctttgagaaatctccaaactgctttccacagtggctgaactaatttacatttctatcaacagtgtatacatgtccccttttctccacagcctcaccagcatccatggttttttgactttttaataatagccattctgactggtgtgagttgatatctcattgtggttttgatttgcatttctctgatgattagtgtgaaattttattgctgacatatatggatcagtatacaattactacatttttagaaggtggcttattaattaacctctcctgaactttgtcctaggcttttaactggtctccttgccttcagtctttctttccttcattttgtcttccacactgttgccagttatgtttttaaacatagatattatcttatattgcttttacttagaaatatttaatggattcccaatgtctttagtgtaaattacttaccttagcaagcaatttttttttttttttttttttttgagatggagtctcactctgtcgccaggctggagtgcagtggtacagcctcagctcaccacaacctccgcctcccgggttcaagcagttctcctgcctcagtctcctgagtagctgggactacaggtgcatgccaccatgcccggctaattgttgtatttttagtagagacagggtttcactatgttgaccaggctggtcttgaactcttgacctggtgatttgcccacctcggcctcccaaagtgctgggattacaggcgtgagctaccatgcccggtctgacaatgtttcttataaccttatctcagcctgtctttctagccatttattatcaactttatttccagctattccccagcaccttacatgtatactgcagattatttgctattttttgaatatttacttttcattcttctgtactttttcttgtgctgtggaataatgggaaagaatggacttcagaattgaacaaacctgacttttaatgccagtaccgttccattctagctgtgtgatccagttggcaagtcattcatcctctctgaatttgtttcctagtctgttttatttaaaacaattatataactacacctacttaaaagtcattgtggttattaagttagatatcatacctgtaagtacataccaagaaagtatctggcataaagtaggcatgtaattaatattttccatttcttcctttcttctgcctagaatacccctctctactgtagacttcctgaagaactcctcaaccttttaaaatccagcttaatggttaattcttctctgaatccttacctgggctgcttagaaaatagtgatttgcttcattatctctgttctaatagtggttcctatagactgttggctacattaacactttttctcattgcaatttagatattatattttcagatcgtattctttcacttagactatgaaattcttcatcttattttatacttgcatttactgctccttgcatggtgctaggcctgtagtaggctctcagcaaatgctgtctatattgtactctcaaatgcagctatgtcccagatagttcagcagtgaactttcacatacagttaagcattcttttgactgcataatgcttttgcttctttaccaggaccctgtaaaaatatctactgttagtaaaattgctgcttagggttcagatttttattttaataaatcttagattaataaggaactaaattggcctactctgttgttaaaaagagtcagattgttggattctattgttagtaaaatacctattgttagtaaaattatctattgtaaaaatatctattgttagtaaaattgctgcttagggttcagatttttattttaataaatcttagattaacagggaactaaattggcctactctgttgttaaaaagagtcagattgttggattccattttcataaaaagttatgtccgttaaatctaattgtcaaaacttctcctaccaagaaagaacagtgaattatctatattacttaaactatattacagtctcttcatcaaaattttgtaattttttattccagtgggatgactttacttaaaaaattttaaactcaggatttctctttccaataaatatttttaataatggagtagatatttcccattgtatccaaaaaatccattttaaaatttccattagaaaatgggaaatgatgttactttgttctacctgactgtccctcaaatatgcattttatataagaccaaccaagcaacattcaacttttaggttttcagttcctttcccatatctctaggttctacagtgattattacgcatgatttgacttcaagctgaaaggaccactgtcattcaaaatgagatgctgaagcacatactgtgcttccagagattaaatgagaagagttacattcagtattaacttgttcatgttcagaatcttatgtgtgatttactgatgattttagtgacatatgtactaaactcttaaattatacttaaaggaattgttttatgaagccagtcacacacaatacttttattttctgggttcattttttaaagtttaagtttttaattgtcaaaaatgtcaaacagtacaaaaggtcatagagtaaaaggtagggctctcttctaccccaactatttgatatcctttccagaggtaactagtatattatcactttcttgtatatcatgagttattttaaatgctggtcttgaacatttattatgtgaaattcttgttataatagttggaaaatttttattaaatagaaaggtagtctttagattgtggcacaaaccactgtggggagaggtctatacacaggataaccacattatcatctaaggtggactgggtcacttttgagagtaaaagagggcactattaatttgatactgagccagcagatacaaaccatgctctgtatgcacctattgataaatcaaatgcatgtctcttttctgtgaataattagctcatttctccatctgatctctttcttgatttgttcctttaaccaatctattacattgttttctcccctttcagactatgctgtggaagagaaaccatcacagatttcagtaatgcagcagttggaggatggtggccctgacccacttgtatttgttttaaatgcaaatttgttgtcaatggttaaaattgtaaattgtaagttataaatttttaaaaattaaaatcagatgttttactgactcatagtacataaaactttcagatttattacacacaagtatttttatatagagccacatctttttttttttctttttttttttttgagacagaatctcgctgtgtcacccaggctggagtgcagtggcaccatctcggctcactgcaagctccacctcccgggttcacgccattctcctgcctcagcctcctgcctgagcagctgggacaacaggtgcccgccaccacgcccggctaatttttcgtatttgttttttttttagtagagacagggtttcactgtgttagccaggatggtcttgatctcctgacctggtgatccgcccgcctcagcctccctaagtgctgggattacaggcatgagccaccgcgcctggcctagccacatcttactgaacactgagttctgaaaaagttggtttttataaaatgatatatcccagaggacagctgtggaactaaccgaaactctcacatttagttacaggggtgaggtaggtgaattctccatggatgaaagccaaacaaatcttgaacttatctgagttaagttcttcttgagatgagtatgttaaatcacaacttaccaccagaataactggtggtagataaattatacaggctactcaaataatttacatgctgtgttttaatcccagaaacctcaattatggtgcaaaactttatttaggaaaagtgttaactaacacacagtaaagcttcaatacatcataaattgagattcagaagaaacttctcaattgttggtgctagcatcatgggcatcaggatgagaaagacgacagtatttgagaattttttgagacagagtctcactctgtcacccaggctggattgcagtggcatgatctctgttcattgcaacctctgcctcctgagctcaagcagttctcccacgtcagcctcccaagtagctgagactacaggtgcacaccaccatacctggctaattttttttgtatttttttgtagagacaggagtctcaccatgttgcccaggttgttcttgaactcctgaactcgagtgatctgcctgccttggtctcccaaagtgctgggattacagatgtgagccactgcgccagctagtaattttgagaattatttagagaatgcatttattctgaatgagtgttaataggcaattttaaaggacagaacctctggggaaccatcctgcagttctccatgtgtacttaagttgattttggaaaccagaaacatatactacttccttagaagttctacattgatgaaatgtgggtttctggcttacttgctaatcacactcttgtatgtttggccagttattaatgcttgctaccttctaggatcagatttaaaatgaatttgcttgaaatttcaatttgccatatctagtttataaattatgcttagaaattagctaacctaagaccaggcaccatggtgcacacctgtagtcccagtgctttgggaggccaaggcagatgaatcacttgagcccaggagttcgagactagcctgggcaacatggtgaaacctcatccctaccaaaaaaaaaaaaaaaaaaaattgggcatggtgacatgctcctgtagtcccagctactctcgaggctgaggtgggaggagttcttgagcccaggagacggaggttgcagtgagccgagatcatgacactgcactccagcctgaatgacagagtgagaccctgtttaaaaaaaaaaaaaaaattagctaacctagattcttgaagtatataccatcatgaggaatgtcctatttaggtacataaagcaaggattcccaaagtgaaataaagatgtctttgtttttttgattaacatttgttttgatttacatggtggtattcataattttatttgagtcctttttcagttcctttggggatcccattgtgttggggtatgaagagtaaaagtgtcaaggattaaacattgtttttgactacatatggtttctgctgttcatactctccatatagccttaaagtgaaggagtggaactaagtagttcagaaaagccatccttttcactaatttttacagcatgaagccaagtaaagtcatgttgctgattatctagaattttttcctggaaaggactatagttaaaatagctggaatctcttggtcatatattaaatttaataaatatacataaaaatatatttcctttaggtcacaacctgaagataaagctatattattggcttttgttgtaattacttctagccttacattggtaattacttccttcgatgatgtgattttttaaaatataaaggtggaggactatgttcttcaatcacgtttggcttacaatacatagtttggttttattttagtattaatagaatgttgcttcttttaataggagttaaaagttttaagtgcgttttattattatttcttttacttccatttcaatcatttttcttttcttttcttttctttttttttttttttgagacggagtctcactctttcgcctaggctggagtgcagtggctcgatctcggctcactgcaagctccacctcccgggttcacgccattctcctgcctcagcctcccgagtagctgggactacaggcgcccgccactgcacccagctaatttttttgtatttttagtagagacggggtttcaccgtgttagccaggatggtcttgatctcctgacctcatgatccacccgcctcggcctcccaaagtgctgggattacaggcgtgagccacctcggccgtcctcaatcatttttccaagtgtttagaaaagagccagaggcattggcatgttttattttctacaataggtttttggctcaatgcagtgacagttcacagttgaattatacagactcagtgtgatctattttaatctttgctgtattgtaacacagatttctgtgcatctttttttaagagtaaggattgataggaatgtctttatttttgtgtttttattccatctgtagatgtgaacaggaagtgctggtgtttcacaaccaagggaatgcatgcagtgggtcagtctgagatagtcattcttctacagtgtttaccggatgaaaagtgtttgccaaaggatatctttaatcactttgtgcagctttatcgggatgctctggcaggtaggaatgctttatgacttagtctgctccctttgtagatgacaaaaaaattttgaattcaaatacaaaataatagtcttaactttggacttaagcatggcaggggactttgatattagtggcaagttgaagctttccatggtttgaagaaattataaattttagtattgtacctggtatagtttttattttacagaggctggaatcaaagctgtaagagaatctggtgacctaaatgtaagaatattttctttttagtggcctggggtcaggatattggtacctggtagaaggaagcatatttgtaacttacttcttgtttctttggttaacaatatttatttaatcatagtgtaaatgctaatgaatattcaaatttcaaaaacaattagcatacatgactatggcttcaaaataaattgtaaatattaactgtaacaacttaaaagtaaaagcatagaggttagaagctgggaaagactaaggatattaacataaaaagaaactaagattgagagaaaagaaacacattatttgacattatagttatttattatgacattgtgttatttgacattacaaagtcagcctccctttgatttaacaaatgaggtagaaaaacggtgtaattgaactattctcgtttattgtaacaggaagtcagtacataatatctgtatttgataaatagggtttatctttgaggaagaaggcctggagagggtgtgagggtgaccggggtattaaaactattttcatgtattatttgataatatttcatacatatattaaaacaataaattattcagactttcttaatgcaataattttcattgtgggattctgtgccaaagacagtatccagaatataaaatgcacttctgtgaatgaaagggtttattgcaacattacctaaatttaacacaaaaattcagaagcaacctgaatgccttagctataggtggaaagtttaactgtgttatacttattagatgtgaggatctttttgagaactttttttggccattaaaacaatatttatgaaaagaatgtagtaacatggaaaatgctctttaaataattacagaagcaggatatataattgtatttttaatgtgatgtagattatgcgtaaaagattgtgcctttatgtcttcattagtctctacaataatttaggtgtagcattacataagggcaaggtgatacattggaaactgaccacatgatacctgtgaagtaccttttaatgtttaccctgtctgttccaaaatgtatagggttaaatctgaaatcatccaggtcctccaggccacataataccctggagctgaatttagtcctggaaataactgggaactttcacttttctcctcaatctgaatgtattcacttttaaacactctagaaaaatggcattggaggttcaagtaattgtagattcatgtgggttttgagagtgtgttagagactagggtatgggaggttcatgaatgtcttatttaggagcccatgctttattctgtaggcaatgaagaaccattgaaagtatttgagatgatgagtgacataatcagatttgcattttagaaagatgactctggaagcagtgtgaaaaatggatcaaagtccgtgagtctggtggcagttaagaagcaatttcaggataagcaaatgtatattcatacactagaatactgctcaacagtaaaaatgaactaactgctgatgtacacaacaacatgcatgaatctcacagacattatgctgagcaaaagccaggcacaaaaaagtacatattggatgattccatttatatggttttctaaaacaggcaaaattaatctttggtgatagaaattaggtcagtgtttgcctaaagtgaggtgggggtgcaggtgctagaactgactacagagagtcccagaaaactttctgagatgagaggtctatatctggattaggatagtggttatgtgggtgtttgccaaaactcattgaaatgtacacttaaaatctatcatttttataatatatagattatacctcagtaaaatttattttttaaaaagatattgcaggaatccagcaagaaattaagaaattatcaggatttaaattaaataattgcagtggaaataaagaagagtattggagagatacgaaagatgtggtgcttcaattcagtaggatttggtaactaactggatatagggggttagaggggacaagtcaaggttggcctcagattcctcgcttgagcacctaagtgtatgttggtcttcttctattcaccatcttgatgaataacagatttggcagaggtaagggaattctttgttcagtgtgctgaatttgaaataatgacatcagatgaaacatgaaaatggcagatgattatatgggtatggatcccagaagatagatctgagttaaaatacagattttggagacacagctttcctgtgatagttgagagtatcgttgtgaatgggataggcctgtgtgaagagactacggctgtagatggaatcctgagagatagacatcctctcaaggagaggatgtgaattattgcatgaattattaaaatatgtttagcataaattttttttttttttgagatggagtctcgctctgtcacccagcctggagtgcagtggcgctatctcagctcactgcaagctccacctcccaggttcacgccattctcctgccccagcctcccaagtagctgggactacaggcgcccgccaccacgcctggctaattttttgtatttttagtagagacggggtttcaccgtgttagccaggctgatcttgatttcctgacttcgtgatccgcccgcctcggcctccgaaagtgctgggattacaggcgtgagccaccgcgcccagcaatggttatttttttaaaaaggatacttatatgtcagttcagtccattttgaactattgcaaaaattttgaaacaacaaaaatacttggaactgattacaagatactaatgatagtctaaggtcagactataatacatctaagccaactaaaaatattttctataatgtaggatagggacacgaacatatatatgtatatctaaggaaataacatttcaaaagcataagtgagacgaaagagtttttccttgaataggaatcatttcacaactcatcaaatattgggactagaaggcattttagataatttaatacaaactcttcattttttagataaggaaaatcagacctagaagtgttaatggcgtacctaaatcacagaccaagttggtggcagaattgggactgtagctcccagatcagtattgtttacattatgtcagttgcctctgtgtaccattaataatatatcagttcttaaaaacacagatatattatctatatactatacatatttattaagaaccttatttttagataatcagggtaatagcttgatatatttcactataaattttttaataagtaaaagcatattttgggtgttctaaaacggggtccccaacccacaggccatggactggtattggtccgtggcctgttaggaaccaggccacacagcagaggtgaggggcaggcaagcaagtaaagcttcatctgtatttacagctgctccccattgctcacgttagcgcctgagctctgcctcctctcagatcagcagcggtattagattctcatagaagtgcgaaccctgttgtgaactgcgcgtgtgagggatctaggttgtgtgctccttatgagaatctaatgcctgataatctgtcactgtctcccatcacccccagatgggacagtctagttgcaggaaaacaagctcagggatcccactgattctacattatggtgagttgtataattatttcatgacatattacaatgtaataatagaaataaggtgcacaataaatttaatgcgcttgaatcatcctgaaaccgtctccccttccccacagtccgtggaaaaattgtcttccacaaaacccatccctggtgccaaaaaggttggaggctactgttctaaaatgatagcaggctgggcacggtggctcatgcctgtaatcccagcactttggcaggccaagccgggtggatcaccttagctcaggagttcaagaccatcctggccaacatggtgaaaccccatctctactaaaaatacaaaaaattagccgggtgtgatggtgggcgcctgtcatcccagctacttgggaggctgaggcaggagaattgcttgaaccctggaggcagaggttgcagtgagccaagatcgtgccattgcactccagcttgggcaacaagaatgagactctgtctcaaaaaaaaaaaaaaacgtatcgcaatttattatttttctcttctgtgtagcacattgagtgaaattgacaaattgtatcttaaatttctcctgagtgtgaaaccttgaatactgtattactagcttagggttattctgccctaaatcacagaaaagccttaggagctattgaatgaacttttttataacttcctgtgaattttaaaatctaaactacaggtatttaataaccatatgtgtgttgtatatctatatatgtgtgtgtatctgtgtttcacatatatatacacacacacttttttgtcatacacagtttttgcattctgcagtggagggaaacattataatttgtgagaaattatgttctgagagtttcagaatgccttctggttatgacagtgccatcggaggttgtagactatatattgtttctccctgtctcctattcattcctccatattttgtacctgtttttttgcaaacaatctattcagaacatagacttgaatgaaattggacttgtatctaccagattgttatttctggagttaatctctggttgtttccctatcttactcaaaagctactttggctttgtattgcctttagaataaactgtgctccaacattcagtattctgcatgatctgttcctatatttttagtctcatctcctgctagtcatctctccatacttccgttgtagccaaacaaaacatttattggttcattttgtgtatattctgatgattttccatttcattacccatgattatgctactcccaaccgtgctatttccccacaccccaactgtctcaatcctatcagttgtcctaaatcttaaagaccactttctccatgaattctttcttgatgaccctcccagacagaagtagtctcttctgaactcccttaatcttttatttttaatttaattaatttatttattttgaggcagagtctcgctgtgtcgcccgggccggagtgcagtgttgcgatcttggcaccctgcaacctctgcctcccgggttcaagtgattctcctgcctcagcctcccaattagctcccaagtagctcccaagtaactgggactacaggcacctgccaccacacttggaataatttttgtgtttttagtagagacgaggtttcaccatgttagccaggctggtcttgaactcccaacctcaggtgatccacccgcctgggccacccaaaatgctgggattataggtgtgagccaccatgcagtctaatcttttattaagaaagtgtttggtgttgttatggtttcaatgtttgtccactctgaaactcatgttgaactttaattgccattagaacaatattaggaggtgggacctttaagaggtgattaggccatgagggcttcaccctcatggatgggattagtgctgttataaaaggagggggttcattcccttcttgctctctctttgggaagctgaggcaggaggattgcttgaggccaggactttgagactagcctggtcaacataatgagaccctatctgtaccaaaaaaaaaaaaaaaaaaattaactaggcctaatggcacatccctgtaatcccagctacttgggaggctgaggtgggaggagtccttgagcccaggagtttttgaggccgtagtgagctatgagtgcaccactgcattacagcttgagtgacacagtgagaccctatctttaaaaataataataatatgtcatggttcatgtttttattttatttttcaaattctgaaccttttggtaaatttattagaattatggtattgtagttttgcaaagtaacttttcaactgatgagaaagttatatggaactatttatgaagaagtgatttaagacaaaatacctaacattttttgaacacttaatatatgctaagcagtatattcattgccttatgtacactattttatttcttcttaagtacaactcagattcatactgttactgtttctatttacacatgaggaaaatgaaagacaccaaaggcctaagtaacttaagatcacacagttaggtgataagtggctgaacccaggtttaaattcacctatgttgtccgtaaatctcatgtttcgaaccataagaagtactatagtgtctcttgagctgtttgtttaagagatagaagtcttgctctgtcacccaggctgtgtagcagtggtgccatcatagcacactcactgcagccttgatctccttgggcccaagtgatccttcctcctcagcctcccaaggggctgggattacaggcatgagtcacctgacctggctcctcttgagctttcatgatcaatgtcagagatacactaaactgaggacatgaccttttatgaagtagtcatgcataactgcagtttgctgcattacaaagaactccaagaagctttctaaattcttttgatggcttgagttttagtcatattaccacttagaaatttatttattggccgggtgcggtgggtcacgcctgtaatcccaacactttgggaagccgaggcaggcaggcagatcacttgaggtcgtgagtttgagaccagcttggccaacaatggctaaaccctgtctctgctaaaaatacaaaaattagctaggcatggtggtgagcgcctgtagtcccaactacttgggaagctcaggcgggagaatcaattgaacccgggaggcggaggtttcagtgagctgggatcacgccactgtactccagcctgggtgacagagcgagactctgtctcaaaaaaaaaaaaaaaaaaaaggaaaaagaaatattagtatttcttgaaatgaatgaaccatttgcttggaaatggttccacttgagttgatgtgaggattaataaatatactttgaaacaaaaggaagctattgacacatagatatttaagttatatttgaattgaatttaaagatggctggctacttataagcatttgaaaaacagtttaaattccaaattaaagatggaaaattgtaaattactgtatctgtatattttttgaaaggctgcatgacatacaaagactaggagattgaaagatctgctttctgctttctaggttttactttgccacttatttacctcgtcttttcagagttacttcacctctacctctaagcttcagtttcttcatttgtcaaataaaaccccaaatttcagggaaatggtaccgttctgcttacctactagcactgatctgatgattacctcattaatgttatgtaaaattactttataaaccattgatataaagcatttaacacctttgacaggtcacttagaagcaagatttggtatctattttggttatatgggttcttcactagtattggggtatatataaaattagttctgtggattcattacattgagtgcagtcgttgagaagtacctatataaattagtacattacagactttatgaattcaagagcttcagattaggtcttcagatgaaagcctttctttctttgtcaaattcttatacccactgttttatttttgccaatatctacacctgtgcagtgttacttgtttgtagatgagatggtacatgatagtctaattcagttattattggtaatctacattttttaaagtgattaatatttaaaggataaaagatatattttataatgagagtggacttcgtgaagaatctgtgattgggatgaagagagtgttaaatggaagaggcagaaaggaaatcagtatctgtggaaaataactaccaatagattctaggctctaatagggaaatcgcaaaggaataatgagtgaataccttgagtactaagccaacatatttttcacctctaagctatatttactaggacagtctttgtgaaatataaacattacactgtgtcttagtctatttttgctgctataatggaataccacagactggataataggtgatgaacagaaatgtatttcctgtagttctcatggctgcaaagtccaagattgaggggtaggcatctggtgaggacctttttgctgcatcatcccatggcagaagggcaaatggggtggggaagagagagaaagaatgtgcatgtgcgtgagggcatgtgtataagggagggcaaacttgtcctttcataacaaacccactcccaggataacagcattaatccagtcacctctcatgaggccttgcctcctagcaccaagtttccaacacatgctttttgagggatatattcaaaccacagcatgctgttgatagagttacaggaatgctgtcatgcaccctacattgtagagggaaagcatctctttaattccctattctcctccttattcaccaaagctagataaagagatgaaaaaaaatttttttctctttgacaaattatctgttgaattttgtatgaagtgtctcttatattgtatcctagaattccaggatctagggaggtggtaaagaagcaatggtaaatttggggatcttatctccctaaagttcctgacactctatccctgatcctgcagtggctgccagaaaaaatgtaaatttacttaaatcttactctaaaatcattgaaagtccccccaaaaatcatatatttggctgatcaatatatgtatatttgcattagaataataatagttataattttttgagaatacagtgttgctggtcctgttaggcattttatagatttcctttcatttattctttataacacatctggaatttaatatagtttctcctcccattttacatggacattgaggctcagagaagtaacttgccccagatcccacaacagtgaatgatcaaactagcattcaaacccatatctctgggactccaaaatctgcaatttatttttcaaaatgccatactgctacgttgatatgacaattgttttgttttcatagatctggcctagcagcttaattgtgcagccagacctgggtaatcctggagcaagagtactacccctaaattcctaaatgtactaccttaaatgcaaaatatagatgataatgtttaggtgaacatgactttcagccacaaagcttctctgagtttaaaggggaggtattcccttcacttgtggctgctactgtcaggatacctgtccgctaaaatcaaggatgcaaagacccataaccattataagaataaactctagttttcaagaaaagtaagcataaatttctctgatggagattgcttcattgggtgttattgctttcaaaggtatcaaaggaagctcgtacttggctagtgaacacattcgttgttccatcattgagcagctcttgtcagaaagtccttttgcaattctaaactgaggaaaatgtctccttaatgaagggttgatatgtttgttactgtttcattcacaaaagtattttgaattataaaatgctttggccaggcatggtgtacatgaattacatgctcacacctgtaatcccaacactttgggaggccaaggcgggtggattacttgaggtcaggagttcgagaccagcctggccaatatggtaaaaccacatctctactaaaaatacaaaaattagccaggcgtggtggtgggtgcctatagtcccagctactcgggaggctgaggcaggagaattgtttgaacccgggaaggagaggttgcagtgagctgagatcacaccacagcactccagggttccagggtgggtaacagagcgagactctgtctcaaaaaaaaaaaaaaaaaaaaagagaaacctgcttaatatgaatttagataagccctaaattatagagctatgtttcatatttgtctcaaaaaattataaacaataaatcctgtccaagcacggtggctcgcgcctgtaatcccagcactttgggaggccaaggcagatggatcatttgaagtcaggaatttgagaccagtctggccaacatggtgaaactctgtttctactaaaaatgcgaaaaaaatcagctgagtgtggtggtgcatgtttgtaattgtagctattcaggaggctgaggtgagaggaattgcttgaacctgggaggcagatgctgcattgagccaagatcacaccactgcactccagcctgggtggcagagcaagactccatctcaaaaaaaaaaaaaaaacaaaacgagaaaaaaacaacttgtctgtggtaccatcttcataaatcctcatcttcccttaatgtcttataactgtacttattaccataattcattatgttcatgagttgactttgttcacccagtgaaattataagcttggtgacagcagcttcctaatctgaacatttcttttttttttttttttttttttgagacagtgtcactctatcgcctaggctggagcgcagtggcacaatcttggctcactgcaacctccgcctcccaggttcgagcaattctcctgcctcagcctcctgagtagctgggattacaggcgcacaccactacgcctggctaatttttgtatttttagtagagatggggttttaccatgttggtcaggctggtctcgaactctgaccttgtgatccacccacctcggcctcccaaagtgctgggattacaggtgtgagccaccgcacccggccttgaacatttctttatgacctttgaggtgatagttcttgagacctctaaagcaattcatacagtaaagctgtacagtttaaccaaggaaggcatcaatatttttggcttttacttagacaaacttcaacaatgtgataatataacttagtttatgctcattagaagccctgataaaattggaaaccaaattttcatttaataaatgccatttatttaaaaatcagctttttaaatgtaagtctttcatagtgaaagattgggaattactgtttggtagtgtccatccagcccagagttgcataatgtttattaaaaatatgattaattggccgggcgctgtggctcatgcctgtaatcccagcactttgggaggctgaggcaggtggatcatgaggtcaggagatggagaccatcctggctaacacggtgaaaccccgtctccactaaaaatacaaaaaagttagccaggtctggtggcgggcacctgtagtcccacctactcaggaggctgaggcaggagaatggggtgaacctgggaggcggagcttgcagtgagccaagattgcgccactgcactccagcctgggcaacagccagactccgtctcaaaaaaaaaaaaaaaaaaaaaagaaatatgattaatttattgatacaaagtagctaataaacttttttgtttttagggaatgtggtgagcaacttgggacattccttcttcagtcaaagtttccttggcagtaaagaacatggtggattcttatatgtgacatctacctaccagtcactgcaagacctagtactcccaaccccaccttacttgtttgggattcttatccagaaatgggaaactccttgggctaaagtatttcctatccgtctgatgttgagacttggagctgaatatcgacgtaagtagtaaaaacacgtttttcaaggcatgatgactaaaataatgcctgaaatattcagagccctctgtttggtgatataattcagcagaaatagtcttttgaaatagctaaactaaatttggccagtgtctgcgtgtattgggcataatgggaagcactgaaaataacgaatgaggaagttgattatgtattaccttgtaaacttactgcttttatagttcattgataaaaaacacgatcatctttagaaaagtgaatttgaacttaagtaactttattttttatagtttctgtatatgatgagcatattctttgtcacttggttggaaaacagttacgatcaattatattttacttaacatactggaagctagtggaatggaaaccactctcagttggtaagatacaggctacagaagaaggagcttccttgctcatggctttagcagcgtaactaagatgtgatttttaaaaagacattaatggttaaatgcaaactttattttaaattttatatctccatctaattaaaagtgccctgtgctaggaatccgaccacttgagtaagattctcaactctgccacttatgagctctgtaactttgggcaagtcacccaagttctctgattgtgtttcttttgtaaactggaaataataatgcttgccttctattttatattgggttgttaacaggatcaaatgagagaataaatgaaacataattttataaaccataaaacagtttatgttctcagcaagtcaacttcattcttccaccaattatttatttattcagtaagaatttaataaaggcctcccatatatcctgaatcctgggaattctgaaatagctaagatgtgattataggctctcgggaacttttataaggaatacatacagaaataatgattgtagtggtatcttgtattaaaacctgtgctcaaagttaagttcattgggagctccaagacaggctctaacttgaccagaccaggaatgaaggagtagttggaccttcagttttcttggaccagagtgcctctggattaactctgaaggaggcatatgaatcagctaaatgaatcagggaaagggaaggattgtgtgcaaaagaagcaacatgtgtatcttcctattttatacaggcatttcaaaccataaaattcaagagatgagccagactgatttgcctctcctaaggaggatcctggttaggaggtatagaagaatgaactcttggctgagtgcggtggctcatgcctctaattccagcacttttgagaggtggccaaggcaggcagatcatttgaggtcaagagttcaagaccagcctggccaacatggtgaatcccatctctactaaaaatacaaaaaaattagctgggtatggtggcgcatgcctgtaattccagctactggagaggctgaggcaggagaatcgcttgaaccctcctaaggcaggagatcatgccactgcactccagcctgggtgacagagtgagactgtgtctcaaaaaaaaaagagtgaactcttaaacttgttggaaaaagaaaaagtgaactcttaaacttattgagcacagaggaatcaggagatatttatttcctggatcgtatcaattcagtttgaagaagattgctccctaagaccttgtgggtttgtttgtttgtttgtttgtttgtttgtttgttttggagacagggtctcattctgtcaccaaggctggagtgggctccagcccactctgtcacccattctgtcacctgggctcaagccatccttctacctctcagcctcccaagtagatgggactacaggtgcatgctaccacacccagctaatttttttgtttgtttttttgtagagacagggtctccctaggttgcacaggctggtctcaaactcctaggctcaggtgatccttctgcctcagcctcccaaagtgctgggattacaagcatgagccactatgcctggctattgtgtgtcatttttgaaacatttacatcgaaaggcttattctggttatcagaagacttaatatggctcagcatttgtctgctaccatgccaaatactttttgagcccaaaatttgatatgttctaatgagccattataattatattttgaaaattgtattagtcatgaaatctcttttaccaaagttttatgttgccaaatttaagtttgatcatttctcatttccatagtttatccatgcccactattcagtgtcagatttcggaagccattgtttggagagacggggcataccatcatgaatcttcttgcagtaagttgggaattttttttcctttgtccttactggagtttatatgggagaaggaagaaagcaattttattattttcttggtagctgtgcccaagctgcttaaggcaggtaaagatatatgctgaagaaaaagaacagtatatgtatgtgtatatatatatatacacacacacacatatacatatatattcatatgtatacacacacacacacacacatatatatattcttttgcaaacatgaagtgaaatggtacaggattccagcgcctgattatacacttaccgtccaaccttgcagaattattgtgaggactagaagtaatacataaataaaacacctagcattctgtcttgtttttattttaagactggcattctatgagtttctcttgtgtctatataggttattatccaagcaaagattggtcagagattgtacccagataccccaagccagtaaggctactgccctctgctgatggatctgaatatggactggaatttaaacttcattgttttcctttcttctgggctctctcatgtctcctacacacgtgcacaggttctgactctgttggccaagatcattggttggcttgagtccactaagttctctgctgcatatatgcacagactaggatcaatcctggatatttggaccgtttatgaagctccctatggttgtcttacctcccagaacttgccccaaacaggtttggtgaaatcaaggtaatcaagctactgggcctccctttttaataaccaccgagattaccactttgacaatgttccatagcaagtaaactccttcaagtagcaaagctcatttttttgtttgttttgttttattttgtttgagacagagtctctatcgcccaagttggaatgcagtggcacgatctcagctcattgcaacctccacctccgagcaattctcgtgcctgagcctcctgagcagctgtgactatgggagcacactaccacacccagctaatttttgtattttttgtagagagagcgttttgctatgttggccagactgatctcaaactcctggcctcaatgattcacctgcctcagcctcccaaagtgctggtattacaggcatgagccactgctcccagctgcaaagctcattgtttttacaaactaccttgccctggttgaactacctaactacctaatggggctagggggcagccccaggcaagaaggtcacagactcaattcaaagttcagtagttttcatgaaaaaaacatttctttttttttttttttttggagatggagtctcgctctgttgtccaggctggagtgcagtggcacaatcttactgcaacctctgcctcccaggttcaagagagtctcctgcttcagccttcagagcagctgggattacaggcacctgccaccacgcctggctaattttttgtatttttcatagagacagggttttaccttgttggccaggctggtctcaaactcctgacctcaggtgatccacccatctcaacctcctaaagtgctgggattacaggcatgagccaccatgcccagccaaaacacttcttaatgttaatatgcctttgatctaattccagagcactgaaatggttctttttaagccacttatacagcttttcggttgctttttgaggagtgggtttggtgatttcctccctctgtgatgcttaaaagctatatttccagttatctttttttttttatttctttaaaaaattttgttttgttttgttttttgggacagagtctcgcactgtcgcctgggctggagtgcagtggcacgatctcggctcactgcaacctccatctcctgggttcaagcaattcttgtgcctcagcctccccagtagctggaattacaggcacgaaacaccatgcccagctagtttttgtatttttagtagaggcgcatgttggccaggctggtctcaaactcatgacctcgagtgatccacccacctcagcctcccaaagtgccttttgcctgttttttaattgggttgtctttttgctgctaggttaaatttgttatatattctggatattaactccttttcagatgtatggtttgcagatattttccatttctgtaggttgtgtcttcactctgttaatagtttccttttctgtgcaaaatctttttagtttgatgtaattccatttgtctatttttgcttttattgcctgtgcttttgggatcttatctaaaaattcattgcctagcccaatattgtgaagcatttgccctgttttcttctaatagtttcatagttttgggtttaaatttaagtctttaatccgtttttagttgatttttgtatatggggagaggtgggggtctagtttcattcttctgcatgtggatatatccacttttccaagtactatttattgaagagagtcctttctgcagtgtgtgttcttggcacctttgtcgaaaattagttggctgtaggtgtccaaattcatttctgggccttctattctgtactgttggagtatgtgtttgttttggccactactatgctgttttggttattatagttttgtagtatatttggtcaggtagtgtgatatctctagctttgttctttttgctcaggactgttttggccatttgaggccttttgtggttttataagaatattaaggttttggtttttttttctgtttctgtgaagaatatcattggcattttgatagagattgcattaaatctgtagatacctttgggtagtatggctattttcacggtattaattcttccaatccatgaacatggaatcagtttcctttgtcaatgtttttttttttttttttttttgagacggagtcttgctctgttacccaggctggagtgcagtggcgcaatttcggctcactgcaagctccgcctcccgggttcacaccttctcctgcctcagcctgccgagtagctgggactacaggtgcccgccaccacgcctggccaattttttgtacttttagtagagacggggtttcactgtgttagccaggatggtctcgatctcctgacctcatgatccgcccgcctctgcctcctaaagtgctgggattacaggcgtgagccaccttgcccggccctttttcaatgttttagaggtttctttgtaaagatcttttacctcttaactaagtgtattcctaggtatcttattttttttatagctactgtaaatggaattgttttctttattttttattagcgtatagaaacactactgattttacatgctgattttgtatcctacaactttaccgaatttgttcattagctctaacaggtttttggtggcatctttagggttttctatgtatagggtcatgtcatttgcaaacaagcacaatttgactttccagtttggatgccttttatttctttctcttgcctaagtgctctggctaggactatgttgaatagaaaggattaaaatgggcatccatgtcttgttcctgttctttgaggaaaagatttccactgttcccattcagtatgatgttagctgtgggtttgtcacatatggcctttattgtgctgggctgcttgtccagctgggcacagcaggccagccagctgtgtgttggtttctccactgtacaggtctgtctgttccctggggcagggaggtgccatgtgagttcagtgccagggctccctcattctgttgggcctaggctctcagcagctggatgatggtgatacagctacatgtgtgtgttgtggactgacagtggagcttcagagatggagagatgcagtggcaattggcccccaggcaggatgaactctagcagtgggtccagtttcaagatggcaccatgctatgactgggaatgagggctgtatgacatgggctccaactctggagcagtgtagtcctgtgaactgcaggcaactacaaactggattcagggtttgtgaggaccgcgggacgaggctgcagtggtcatggggaccatgggtccccagcttaccctttccccattagaagtagtccttcctgactccaggccactccttgcagggaggcagtgcggcagaggcagagtgcttcgctcccgtctctgtggtgctatctggggcatctggtgctccacaggaatttcagcactcccctggtgctctccagcatacttccacagccactccagttgaaatatagtttgtttattgttgttttggtcccttttgttgagtagaggggagcaagagccagacaactccagtcaaccatcttgctgatgtcactgtcgtttagagagaacaataagaaaaaaaagtcttggctgggcgtagtggctcatgcctgtaatctcagtactttgggaggccaaggcaggcggatcacgatgtcaggagtttgagaccagcctggctgatatggtgtaaccccgtctctactaaaactacaaaacttagctgggcatggtggcacatgcctgtaaatgccagctactcaggaggctgagccaggagaatcttttgaacctgggaggcagaggttgcagtgagccaagatcgtgccactgcattccagcctgggcgacagagtaagactcagtttcaaaagaaaaagaaaaaaaatcttgtagatttacccatctagttgccatttccagtgtttttcattcctttgtataactctgtattttcatctggtgtcattttccttctgccaaaatgattgcctgtaatatttcttacagtgtaggtttgctgctgatgaattattttagcttttgtatttctaacaacatctttatttgatcttcatatttggaagatacttttggtggttggagaagtctaggttgagttttgttgtttaggttttttggttttttttttttttgagacagagtctcactctttcacccaggttgtagtgcagtggcacaatctcggctcactgcaacttccacctcccgggctcaagcaatgctcccacctcagcctcccgagtagctgggattacaggcatgcaccaccatgcccagctaatttttgtatttttagtagagacagggtttcactatgttgctcaggctggtcttgaactcctgacctcaagggatcctcctgccctggcctaccaaagtgctgggattacaggtgtgagccaccatgctcagcccgagttttcttctttgagtgtttttgagatgttgctccactgtcttctgctttgcattgttttccctctcatctttgttcctctctacataacaattttttcttttcttaacgttgtttttctttttccatctttttttttttttttttttttttttttggaaatagggtctcactctgttgcccaggctggagtgcagtggcacaatcacggctcactgcacccttgacccacagggctcaggtgatccccccgaccttggcctaccaagtagctgggactacaggtacgtgccgctatgcccagctaattttgtttattttttatacagacaaggcctcgcagtgtttctcagactggtctccaactcctgggctcaagctatccttccacctcagcctcccaaagtattgggattacatgcatgagccactgtgcctgaccttctctggctagtttcaaaagctttttaaaattacaagtttgaagcaaattgattataatgtgccatagtgtagttttcatgtttcccgtacttggggttcattgagctttttgaatctatgggtttatagttttcatctgatattttttctgttcatccccttctctccctgaaggagattactccaattacatatatatcaggctgcttgaaattgtttcacgtcttactaatgttctttttatttctttttcagtcttttttgtctcttgttttcatttaggatgaattttattgctgtgctctcaatttcactaatcttttattttggtttaagctgctgttaattctatcaatcttttaaacaatctcaatcaaatactttgattttcatctcttgaagttatacttgggtcttttaagatcttttatgtctctgcttaacattttgtacatgtagaatacaatataataactattgtaatgcctttagtaattctaacttcttgtataagttctggctccgtttccatggattgattttttttcctttattttgagttgtattttcctgcttctttgaatgtttggtatttttttattggttgccagacattctgattttaccagttgggtgctggttatcaatattcttgagctttttttgcaagtaatgaagtcaagttacttagaaaaaccctccatctcacatcatattctacatttcagtaaatggcagttccagtcttctagtagccctggctataaaatttagaatcatctttaacttttatcatttgttcacattccacatccacagtggcaaatattatcagattttcctttaaaatatgtctggaaacaggctgggcgcagtggctcacacttgtaatcccagcattttgggaggccaaggtgggcggatcagctgaggtcaggagtttgagaccagcctggccaacatggcaaaaccccatctctactaaaaatacaaaaattatctgggcctggtggtgcattcctgtaatcccagctacttgggaggctgaggcagtagaattgcttgaacctgggaggcagaggattcagtgagccaagattgcgccactgcactccagcctggttaacagagcgagactctgtctcaggaaaaaaaaaaaaatctgtatctatatatctagaaactgacaacttctcatcactttttaaactgttaacatcctggccaggtgcagtggctcacgactgtaattgtagcactttgagagaccgaggcaggtggatcacctgaggttgggagttcaagaccagtctggccaacatggtgaaaccttgtctctactaaaaatacaaaaattagccgagcatggtgacgcacatatgtaatcccagctacttgggaagctgaggcatgagactcgcttgaaccctggaggcggaggttgtactgagccaagatggcaccactgcactccagctcgggcaacagagtgagactccatctcagaataaataaataaactgttaacatcctggtctaagctctcactatctcctaccttgattgtttttatggtatttatctgatcttttcttccattcttcctcccttaccacctattcattaccaaggagtcagatctgttaaaacaggtcaaaagcctcctaaaggcaaaagtcctcacggtgacctataagaacctatgaaatctagccatttgctattactttgaccttgagtccaccactcttgttcattttgtttcacccatactggatagatgatgtgttagtgtgtgtgtgtgtttccttacagatattcattgagtgcctaagatgttccaggcgttaaggatatagcaagaacaacacaactgagagtttgtactctcttggagcttcagagggaggagacagatagttaacaaataaatacagaaaatgttaagtggtggtaaagcagggtagacattcaaaaatattttttaatgttgtgtataagaggtatatgataatgtttggtttacttataagagtttaaagactaaagagctaaaatacatatagtggggctttcattatacatttccttattatttaaataaataggatctttcaatattgacattttttccattcgtgttaattttattactataaattaaaccctaccattgatgaattaatttattctgcttcaatctgctttggcccaggacttcagaaattaccagtataccttgccagtagttcaaggtttggtggttgatatggaagttcggaaaactagcatcaaaattcccagcaacagatacaatgaggtaagatttaccatgaaggcgtatttttcatagttgaaaacatgagtgaaggtgaaaaatgcatgattatatataaattttacttataattaattaacaatgaaatcagttaataatattgtatggcttagttcaattatggggaatttcattacaggaagacaagatgtcaaatttctgacctagtggttcattggatgtgtcattttaccttttgatgttatgataattagtattagatttgcattttgattaggtcatgaaattagccttgtatctgtaatattagtggtgagatttttaaaatgtccccactcctactataaatatttatttatttatttatttattttttgagatggagtctcactgtgtcgcccaggctggagtgcaatggtgtgatctcagctcactgcaacctctgcctcctgggttcaagtgattcttctgcctcagcctcccaagtagctgggattacaggcacccgccaccatgcctggctaatttttgtatttttagtagagacgaggtttcaccatgttagccagactggtctcaaactcttaatctcaggtgatccacccacctcggcctcccaaagtgctgggattacaggcacgagccactgtgcccagccgggtttctttgtataaaataatttttccttcctttttcctttttttttcctttttcatttcattttttcttcatttagccactaaatcatttatgcgttgaataaacattatgtacttggtatgcacgtagaatcacacagatgttttattggatttgtgagctcagttctcagcattattatgagaatgacctctgtgaagaaagcttttagccatgactttccacgtgatttttttttttttaaggatattagaaaatagtagctagaatgtgtgcttacttttttctgggatacaactagcagtcttcagcatttagataatcctgccttggagtatcaaggagtaatcgatgagactaggtagagtcaaatctttaaagtgaactatttgtagttcacagatcttgctctgttgcccaggctggagtgcagtaatgcaatctttcatggcctaaagaattttaaaagagattgtgctttgaaaacctattttatttctcaaatttgaaatattattgtctatttcacaaacatgtattaaatatattctgtgatttgaaatataaagatgagataagaacattaggcctgctggccaagcgcgatggctcacacttgtaatcccagcactttgggaggccaaggcaggtggatcacctgacgtcaggagtttgagaccagcctggccaacgtggtgaaaccccgtctctactaaaaatacaaacattggctgggtgcctgtaatgccagctactcgggaggctgaggcaggagaattgcttgaacatgggaggcagaggttgcagtgagctgagatctcaccattggactccagcctgggcgacaagagcaaaactctgtctcaaaaaaacaaacaaacaaaaaccttatgcctgctttcggagcgtttgctgtccaggaaaatgatggcatcagtggcctgtctggagtggctgctgccatcatgctggctgcagcagggtggtgctgccagggctgcatactccgtggagcctgtaggagccggggacaagtgggagccccaccccttccgagttggtggggtgggcctcccaaggtgcagctgcccaagttatggctgcagacctgggccttctgctccatggagcaggcaggagctccccccttgcaggcacagctgtagctacccgagttgtggctacggacccaggcatcctcgtgcttgggaaggcccccctcccttacagccctggaaatgcctgctcctactgcctggcttttccctgctgtcagcacccactccaatctcagagcaaagtcggggcagtgctgacacaccagtgccctgccgccttggccccctctggactttgggcactgacaaacataggaagtaagctgatgggggatgtgtgcagctcaatgctggcctgcagacaccccatggaacctacagcttgggcaccatgaatagcaggaggcaaacacgttcctgagcagaagaggccaggtccccgatgaggttccaccttcaggctaggaagggcctgaaggctggggggccaggccaccagtcccatggactgtagtgggaacttggggtgccttttctcagcctgcccatggctgtccatgcaccagtcggtgcatgcttcccctcctctgaggcctgtaaaagccctgggatcagctagagctgagcagacatcgggatgaccagctgcagagaggagctgcccactccagggtctcctctctgctgagacctgcagacgctgagatgaccagctgtagagaggagctgctcactccagggccgcctctctgctgagagctgaatactcgatttgacaacctgcctgtagagaggagccacccaccccaggccctcctctattacgtcactcataaagctcctcttcactttgctcaccctccacttgtctgcatacctcattcttcctggatgcaggacaagaactcgggacctgccaaatggcagggctgaaagagctgtgacacaaacaaggctgaaacatgccccttgcttgccacattgcaagtgaagagaaggagagaagagctgcagccctttggggaacccaagcttgggagctccctgagccagggctgtgactccctctttggggccctgtggttactgaagtctccaagcttccgaatgtcaccacattccctggtggcagctgtggaagctgcttgcggtgcacctggtccagctgcagcctggcagagagccagggcctgtgcaggcacctggagctacctgcctcactgcagcagccagcatgcctgactgtgtgcagtggccggaacccacgcttgctttctcacacaccccttgctgctccatgcctggctcacccttgacagacatgggatccaggctggtagtgtaagcctagcacagcctgccaggctgagtggccggaacaagcccagcaggcctgagcaaaactcaggcaaaggcaccactggccacagagctttccagccagaaaagcaacacaccaaggatcctgtaacagttagatgatcagatgtcattcccaagcaaataacatattgctatccttgatgtttgcgaggtagtgctgtgtgtttagaaattttgtttgtacaagtatatctgtaaaagctgaggcgctcatagttatttctttttttttgttttgttttgtttttgagacagagtcctgctctgtcacccaggctggagtgcagtggcacaatcttggctcactgcaacctacgcctccaggattcaagcaattctcctacctgagcctcctgagtagctgggactacaggcatacaccaccatacccagccaaaattttgtatttttaatagagacaggatttcaccctgttggccaggctggtctcaaactcctaactgcaggtcttctacccaccttggcctcccaaagtgctagaattacaggtgtgtgccactgcgttcagcccccatagttacttcagtactgactggacactttcacaacaatagctcctattcatataacctgtttttatctgaactctgttgcctccgtttatggtgtgcaggttcagaatcctttgttctaaaagagtaacagtatttcttgtcatttattttatggattatgtatcaggtctttttcttacctgattagcaaactgaattttcttttttcttctttttttttttttttctgatacggagtcttgctccgccacccaggctggagtgcagtggagcgatctcggctcactgcaagctccgcctcccgggttcacgccattctcttgcctcagcctcccgagtagctgggactacaggtgtccgctaccacgcccggctaatttttttgtatttttagtagatacggggtttcaccgtgttagccaggatggtctcgatctcctgacctcgtgatccacccaccttggcctcccaaagtgctgggattacaggcgtgagccactgtgcccggccacaaacaattttccttctgatttaatttttattttaactcaacataattttatctcctacaatctcatacagttaaattgtgttgtgtctaataattccacttcatagttgaaaaagtaatttcttttttcttttcttttctttttggaaacagggtcttattgtgtcaccaaggctagagtgcagtggcacaatcatggatcactgcagtctcaacttcctgggctcaagtgatcctcccacttcagcctcctaagtagctgggactacaggcgtgtaccatcacacccagctaatttttgtatttttttgttttgtagagagaggatttctccatgttgtctaggctgatcctgaactcctgggcttaagtgatactcccatcttggcttccctaagtgctggaattacaggcatcactacacccggccataattttcttgtacattttatttaatcacaatattcttcttttcctctcattcattttttccatttatactcatagtctttcttattattgcccatattttgtgctcttttgttcatggcttttgcagagctggttccttattgattcatacttcccctactcttcacctgcctaacccccactcattattcaggtgtcaccgtaaatgacatttttttcacatatactttgatttaactcccaactggggtaactctattatatgcattcctagaattctatgcatactatttgtaataatcagtacatttgtaattccttgttgtgtgtctgttttctctgctgtgagttccatgagggactatgtctatcttgtataccacaggtatcatcagcaaacaccctagtacggagtgggttagcaagaaatatctgttggatgaagacatgaaacagatctaatatagataaaacaatatgaaaacaaatggtgaaatttattgcaagtatactaaaggtacagagaaagtagatctctagaggatgaatagaatagacaccaatgtttcttaatttcttattgaccctgaatccctaacagagcaacacattgcatgtaggagatgttcgtaaatgttcaccaaataactagatgaatgaaagatttgaaatggataatgaatgataactaggcactagaaagagaagggcagacggcatggtgactcacgcttgtaatcccagtactttgggaggccaaggtgggcagattgcttgagcctaggatttaaagatcagcctgggcaacatggcaagaccccatttctacaaaaaatacaaaaaattagctgggcatggtggcgcatgccccgtagtcccagctacttgggaggctgaggtgggaggatcacctgagcccaggaagtcgagactgcagtgagctgagatttctccactgcactccagcctgggtgacagagtgagaccctgtctcaaaaacaaaaacaaaagcaaaaaagggcagaaaagaccttaagtgaaaagggggatagatacctgcctacacaaaggaagggaaggagcatagctcatagggaaatgggagacaacaaagtgcctagcaaagagggggttaaagcagactgatggctttgtgggatgtgaggttgtactaagactgctggcttcaaaatccactcagaggaatttagattttaatatgataatttataaagagcttttataggttcttaagcagaaaaagtgacttaatgaaagcaggattttggaaaactgagtttggtggctatatggaaaatgaggagggagggagggactaaggaaagactttaagcttagaaagctagaagatagtacttctgacggcatggaaattttaataagcattgtatataaaatttctaatctcttttgtcaaggccattaaagatccttgttggttaaggtcacctggttcatatatatatgtatttttttgagacagagtcttgctctcgctctgttgcccagctggagtacagtggtggtgtgatctcggctcactgcaacctctgcatcccaggctcaggtgatcttcccacctcagcctcctgagtagctgggactacaggcacacaccatcatgtccggccaaattttctgttaatagggatgagatttccccttgttgcccaggctggtcttgaactcctgggctcaagcgatctgcttgcctcagcctcccaaagtgcttggattgcaccattgcactgggcctcatgttgttacaatgagattattttcaccattgtattaactaataataaatatttagtatgtaccaggcactattctaagcatatatgtatctttacactaactctatgacatgagtatgctaactacctttttacagatgaggaaattaagatacagagaacttagctgggtgccatagtgaatgtgtatagtcctaggtacaggctgaggtgggaggatcacttgaacccaggaggtggaggccagcctaggcaacatagcaagaccccatctcttaaaaaagcaaaaaaagacacatagaacttaagtaacttgcccatgatcgtacagctagcaagtggtggagctgccatcaaacctgggctttctgattctggtgtccctactcttaaccactgcactgtagactttagtttaaataattaccaatttagttttagggctgatgagttaaagtgattgtatgtggttctatttacattttgtatgtaaccagatcactggcatagctagtacatgcacttaaatactgaagtctcatggaacggtagaactaaaattacctctggggcatttcctaatatgtgactagttttttgttgttgttgtcattgttttcttttttgagacagggtcttgctgtgttgcccaggcaggagtgcagtggtgtaatcgtagctcactggtagcctcctgggatcaagggattcccccacttcatcccctgaagaagctgggactacaggtgtgcaccactgtgcgcagctaatttttaaattttttgtagagatgaggtcttactgcgttgcccaggttggtcttgaactcttgagctcaagcagttcttctgccttggcctcctcaaagtgctgagattacaagcatgagccaccatgtctggcaatgactgttatttaatatgtttgtttaagatcagaaaaatgatgagccatagtgaaagaagaagagatgttagaatcaaatagaccttggattgatttttttttttttttttttgagatggagtttcactcttgtcacccaggctggagtgtggtggcacgatcttggctcactgcaaccttcacctcctaggttcaagcgattctcctgcttcagcctcctgagtagctgggattacaagcgtgcaccaccacgcccagctaatttttgtatttttggtagagacagggtttcaccatgttggccaggctggtctcaaactcctgaccttaggtgttctgtccgcctcagcctcccaaagtgctgggattataggcgtgagccaccactcccagctggattgatgtttaattactagctgtattaccttagtgggttaatctctcttctggaatatgggtatgctcatattgtgaagttttgtgacatttcaatcacgtgtcaaataactagtgttgtgtattagcctggtatactataattgtacataaattgtatgctattgttgttgtgttcatttttatcattcagattaattgttcatatggttaatttttatttttatttatttattttttttttagatgaagtctcactccatcgcccaggctggagtgcaatagtacaatcttggctcagtgcaactttcgcttcctggactcaagcagttctcctgcctcagcctcctgagtagctgaaattacaggcaaacgccaccatgcccagctaatttttgtatttttagtagagacggggttttgctgtgttggccaggctggtctcgaactcctgaccttaggtgatctgtccacatcagcctcccaaagagctgggattacagacatgagccaccacacctggcttcatttggttaacttattgaacttgtgttacaaacttctcattttcatgtgcttgtaggatgtatctaacttcccaatatagctaaattcccttaggatgtagagggcatctgggtaaatctataagaaggtgaagtggcgaagactcaaaacatcatttaacaaaatatatattgaatctaactgtaggtatttaatataaggaaaagaagactataaaggaatagcacagcatccaccattaatatgcataggctctattacactttgagactcatgaggttatttggttataggatatacttaaccctagggttcccataaggatgtggaacatgaaccatagcttgatagtagtacagtgtcaggcgtttgttacctttgacagtctttgcaacaacccatgtagcatctaacgtagctaattgggagcatctttttgggccttcctccagccccagataactgctcaaatgacaagattcacatcaggcaggtgtaggagctgtcctggcttagaagtcttattcctgacagcaaccaatatctcttggaaaaacttcataggcatagattccagggtgtctctaggggacttgctctgctacaagagtgactattgaagtaagaccaaagttatggctatctatcaggggtgtacggttctccctgttcaaatataatttattatctttcacttttgcccatgttggaatagtaaggattgattgtatggattgaattgtgtccctctaaagttcatatattgaagttgtaacctcccagtacctcagaatatgactttatttggagagagggtctttacaaaggtaatcaagtttaaatgaagtcattagagcaggtcgaaatccaatatgactggtgtccttataagaaggggaaatatggaaacagacacacatatagggaagatgatgtgaagagacatagggagaagatggccaactacaagccaaggatagaggcctggaaacagatccttctttcacagccctcagacggaactatctctgctgatgttgattttgggcttgattttggacttctagcctccagaaatgtaagacaatgcatttctgttatttaagccatccagcttgtactttgatatagctgtgcaagcatgctatcacaccagtccaccttaaacaactaaatatcaagacaaagtatgataaaaacaaaagataatgggcagagaaggtgagtcttctgcttaccctatcttactgcctgtagttttcaggccatagagcgggtaggggaaacccaaactgacttagaggtctccctgacttgaggagacagagttgagaaatatagagagcctacgatggttagaatttgcaggaccgattgccagaagtgttttaaaaattcaggagatctggaaagatttctggagtcttagctgattacttactagtcagtgtgtctatacgaggaaagcactgcaaagaaatgggtagaacaattctcacagggccaggaatagtttgtattcttaccagccagagtgacaaaggttcttgtactacatgggccacattatgtctaatgactcaaattatgtacagattcaaactgctctgatcctacctaataagctttaaagaaagcttgaaaaggatgaaagaatgggcacattaaggagagctatggaagatataaaaaagacccaaatcaagctttaagaaatgtaggtggcaacgggatgaaaagtatgttggatgaaattaaatgcagtttagacaatgctgaagaaaaaactcgtgatcatgaaaacataacaacagaaatgatccaaaatgaaacacagagaaaaggctgaaaaattaaataaacagcacgtcatcgagttgtggaatgtcaggcagccaaattctgtaattgaagtacccaaaggagagaaaaggtggtggacctaaaaaatatttgaagaaacaatggttaaaaaatttccaaatttaatgaaaattataaacttacagatccaagaagctcaatgaaccccaattgcaagaaacaggataaaaactacattaagaaatgttatgatcataatcaaattgtataaaaattcacataaagagaaccttaaaagcagcttgagggaagaaatcttccttatatacttaggtattttgcaaatacaaaagtgacagcatatttctcatgaaaacaatgcaagttgcaagacagtgcagcaaaatctttaaaatgctgaaaagaaaaactgtcatcctatattttatacccagtaaaaatacgttttaaaaatgaaggcaggctgggcgcagtgactcacacccataatcccagcactttggaaggccaagatgggcggatcacttgaggccaagagttcgagaccaaactggctaacatggtgaaagccccatctctactaaaagtacaaaagtacgccaggtgctgtggctcacgcctgtaatcccagtagtttgggatgccaaggcgggtggatcatctgagctcaggagttcgagaccacctagggcaacgtggtgaaacctggtctctactaaaaatacaaaaaaattaaccgggtgtggtggcgcgcgcctctagtcccagctacttgggaggctaaggcaggagaatcacttgaggcaaaggttgcagtgagccgagattgcaccactgcactccaacttggactacagagtgagacccggtctcaaaaagaaaaaaaaaagcaaaaaccgccaggcgcggtggtgggcgcctgtagtcccagctactcaggaggccgaggcacgagaattgcttgaaatctgggcggcagaggttgcagtgagctgagatcgtgccactgaggcaaagcgttttctcggatacatataatttatcaccaacagacctgttccacaagaaatgtaaagtccatcaaggagaataccaaatattggaaatctggatctacacaaaggaatgaaaagtgacagaaatgataaatttataggtaaacataacatctttttaaaagacaattaactgtttcaaattaaatgtttggccgggtgcagtggctcatgcctgtaatccctgcactttgaggggctgaggtgggaggattgcttgaagccaggagttcaaggacagctaggcaacaaaatgagacaccatctttacaaaaaatacaaaaattagctgggtatggtggcacataccagtattcctagctactctctaggctgaggcaggaggattgcttgagcccagtgattggaggttgcagtgaactatgatcacaccattccactccagcttgggcaatggaatgagaccctgtctctaaaataaaataacatatattaaatagtaatgtattgcggaatttataccatatgtagagacaaaaatgtagaacggtaacaaaaaggccagggaagaggatatggaagtatatgacatgtgatgtggtataattttacttaaaagtttattgataagttaaagatacgtaatataaacccaaaagcaaccactaaaaaaatcaaaatgggtaggtatatctaatcaacaaaaataataaaatggaatcataaaagaaggctgaaaaagataacaagagatgggacaaataataaatagcaagatagtaaatttaaatccagccatattaaaaaaaatgactcaaatataaatgatctaaataccttcaagtaaaaggcagagattgtgagactgaataaggaagattcatctgtatgttgtgtaagaaacatacgtataagaaaaacacggccggggctgggcgtgatggctcacgcctgtaatcccaacactttgggaggccgaggcaggcagatcacttgaggtcaggagttcgagaccagcctggccaacatggcaaaaccccgtctctactaaaaatacaaaattagccaggcatggtggtgcatgcttgtagtcccacctactcgggaggctgaggcaggagaatcacctgaacccagaaggcagaggttgcagtgagccgagatcctgccattgcacttcaggctgggcaacaagagtgaaactccatctcaaaaaaaaaaaaaaaaaaaaaaaaaaagaaaagaaaccacagccgggtgcagtggctgatgcctgtaatcccaacactttggaaggccaaggcgggtgcatcacctgaggtcaggcgtgtgagaccagcctggccaacatggtgaaaccccgtctctagtaaacacaaaaattagctgggctttggtggtgggtgcctgtaatcccagctactcgggaggctgaggcaggagaattgcttgaatctgggaggtggaggttgcactgagccgagatcacgccactgcactccagcctgggcgacagagtgagactggtctcaaaaaaaaaaaaaaaaactaaatgggtagaaaagatagcatagtaatattaattaaagctgaaatggctatattaatatctaggttatttcagaacatatattacaaccagggataaagaaatacataccatatttataaagggatcaatttatcaaaatgatacaacaatttcaaaacatgtatctaaataacagagcttcaaaatgcacagtgagagaactggtaaaacaaaaggttaaatggagaaacccacaataatatttggagatttcaataaccctgtgtcactaattgaaggaagtagtaaatagaaaatcagcgggactatggaaaacttgaagaacacagccaattttacttaattgatttttataaaatgttccgcacaacagcatcagaatgcacattcatttccagtgcacacagaacatttacaaaatagaccattttctgtggtgtaaaagaggtctcaataaatgtaagatgattcaaatcatacagaatgtggtctgtgaccacacagctttaaataagaaaccaatgccagaaagatctctagaaaattcccaaatatttggaaataaagtgtacatttcccaataatccatgggtcaaagaataaaccaaaaggaaaattataaaatattttgaactgcttgaaaatgaaaacatgagatataaaaattggggatacagctaaaacaatgattagagataaatttatagcattaaacccttgtattagaaaaaaaggccaggtgcggtggctcatgcctgtaatctcagcactttgggaggttgaggttggggggatcacttgaggtcaggagtttgagaccaacctggccaacatggtgaaaccccacctctactaaaaatacaaaaaaattatccgggcatgatggtgcgtgtctgtaatcccaggaggtggaggttgcggtaactcgagatcacgccattgcactccagcctgggtgacagagcaagactctgtctcagaaaaaaaaaagaaagaaaaaaagacatctcaaatcaatgacctactcgtctaccttaagtaattagacaacaaagagtaaatgaaatacaaaatagaagaaataataaagataagcaatccataaaatagaagacaaaaacaataaagaaaattaatgaaaccaaaagccagttctttgagaagagcaataaaattgataaacctctagttagactgattagatagggaaagcacaaattacctttttaggatgtaaaagagggaaactatcattacaggtccgatagacagtatgaacatgttttggtcagtgtgcgttcaacttagataaaataggcaaattatttgaacagtaagttttcacagctctcaagattaaatagataacctaaatagccctgtatttattaaaagaattgactttattgtttaaaaccttctcacaaagaaaagtcctagttcagatggtttcactggtaacttaacaatgaaggaagaaataacaccatttctgtgcaaacacaccaagaaaatagaagagaaggaatcttactctatgaggtcagccttatactaataacaaaaccaaaaaaagacattacaaaaaatgaaaactatacatcatacctctcatgaagttatttgcataaatagttaacaaatttttagtaaatccactctaacaatacataaaataataatgtatattatgactaaacatggtttatttcaggaatgctaagttggtttaacattcaaaactcattccatagtttaggatacaggatcctttaacaggatgaaaaaggaaaaccatatgatacagcaaaagcagttgacgaaatcctacttccattcaagattagagagagcatgattgtatgtgtgtgtgtgtgtgtgtgtgtgtgtgtgtgtgtgtatcttggcaatctaagaagagaactttcacaagctaatgattatctatgaaaaatctataacatctctaatggtaacagactgagtgcttcccctttaagattggaaacaagaacgggatgttcactcctgtttttattgagcattgtaatggagcttctagcccatgtaataaggggaaaaaaaataagagtcataaaattatatatataaaaaaagactgtcggtattcatggataacatggctgtctatgtagcaaatccttatggagtctacaaaatggccactagatctactaagtgaagttagcaaagtcgtgagattattgtataaaaatcagtagtattttggtatactagcaatgaacaattgaatatagaaatttaataacgatacagtaggccaggtgtggtggctcacacctgtaattccaacactttggaggacaaggtgagctgattgcttgagcccaggagttctagaccagcctgggcaacacggtgagaacctgtctgtacaaaaaatacaaaaattagccaggtgtcatggcacatgcctgtagttccagctactcaagaggctgaggtgggaggatcacttgagcctaggaggcagaggttgcagtgagctgagattgtgtcactgcacttcactctgggtgacagagtgtgaccctgtctcaaagaaaaaaccacaacatcaaaaatatgacataatttgggataaatttcttaaatgatctgtaatacttatacactgaaaactacaaaatattgttacgagaatttaaagacctaagtagagatatataatatttatggattggtagactcagtactgttaagattgcagtagtccccaaattgatctgtagcttcaacacaatcccaatcaaaatacgagtaggcttttttataaataaaaattggctgggcacagtggctcacacctgtaatcctaacactttgggagcccgatgtgggcggatcacatgaggtcaggagtttgagaccagcctgaccaacatggtgaaaccccatctctactaaaaatacaaaattagctgggcgtgatggcgcatacctataatcccagctactcaggaggttgaggcaggagaatcacttgaacacgggaggtggaggttacagtgagccgagatcgcaccattgtactccagcctgggtaacgagcaaaactccatctcaaaaaaaaaaataaaataaaaacaaataaaaattgaggtactgatcctgaaatttatatggggataaaaagaacctagaagagccaaaacaactttgaaaaagaacataatagccaggcgcagtggctcaggcctgtaatcccagcacttggggaggccaaggtgggcagatcacgaggtcaggagatcgagaccatcctggccaacatggtgaaatcccatctctactaaaaatacaaaaataagctgggcgtggtaatgtgtgcctgtaatctcagctacttgggaggctgaggcaggagaatctcttgaacccgggaggcagaggttgcagtgagctgagattgcgccattgcactccagcctggtgacagagagggggagattctgtctcaaaaaaaaaaaaagagagaaaaagaaaataattccaggacttcttagatgatgttaagaccttttttttttttgacagannnnnnnnnnnnnnnnnnnnttatttttttttgacagagttcgctcttgttgcccaggctggagtgcaatggtgcaatctcagctcactgcaacctccgcatcctgggttcaagtgattctcctgcctcatcctcccgagtacctgggattacaggcacatgccaccacgcccagctaattttgtatttttagtagagacggggtttctccatgttggccaggctggtctcgaactcctgacctcaggtgatccacctacctcggcctcccaatgtgctgggattacaggcattagccaccgtgcccggctgttaagatgtattttaaaagtagagtgatcaaagcagtattgtttgggtgtaaatatatatgaatagaccaatggaacagaacagagagtcaaaacatagatgcttacagatgctcaatagcttttccgtaaagatgccaaggcagttcattagcaaaaggataatcttttgaacaaaaatggtctttataattgtatagccagttgtttgaaaaagaagatgaacctcaacctttacctcataccatgtacaaaaattaattggaaatggttcatagatttatacagagttaaaactaaaacttctgaaagaagacataagataaaaatcttagtgacctttggcttgaaggagggtgagggaaccatatattacaaaggggctcaaggaaattttggggggtgattgcaagtgcctttttatgagtatatgcacatgtcaaaattcatcaaattgtacactttaaatatgtgtaattcatcagttattttaaatataactgtaaaagaaaatacatcattttttttttctggtaatgtaatagacgttcaaactttgatcaggtcactgcagtgatatagccaaagagttaacctatcgaagtctcacacaaaaaggaacaaggttttgttaactctttactcaacaccaaaaagataggaatagagaagtttatgttggttgtgatacaagaatctgtgaaatcatgtatttgtacaattctccatcttgtataggacaggctgaaaaataggctgaatggcctcttgagattctttcccactcttaagcttctaaaataggagttttggtttattttaatttgaaactacacatattcttcagagaagtgtgaaattacaaaagcataatttcataggttctttgtagcactggcgagaacagatggcgctaaaatctgtttgaggaatgtttgattctctggccttcaaggaatacatttcttttagggaattaggagctgatagtcctcttcttaaaggaatgaaaggagttggtcaaaggtcctctggagaatagtgcagaggagagagatgatgttccattgattattggtatagcttttcctagtttatacataaaagacagtatttaacaatagatatgttcaaataaaagaatcctcaagaagaagcccatgatactgtacctccactgactgcaagaggaggccactgctgaaccccacatgcccaggatagtactgtcttctctcttgtgtacatgcccattgacaggagtggttctactacactggacttctagtcaaactcctggctttccctgtctcccagaactcacaacctcgctgccatatttgtccttgagaccatcagctctaatctcattgtgtttatgtcaagcaccacaagaagttctggactcctagggcatccctcatttatcgtaatttaatttctatctctgtacaccctcctttctgaccccatttcgtattcattttggaaaacccaagatattagttcttgtaagtcttatttgcctctatacatttccttggtaatcttatccagttctatgggcttaaatactatttctaagctgacatcttccaaatgtttgttttagcctaaatctctctgctgttttgtagacttgactgtcttattgcccacttgacatctccacttgcatacacatttcaagcttagcaagttcacctttgacatggtcatcttacaggcttctctatctaaattaatgacagtgctgtcatctttccagttacccaagcccaaaactttagagtcatctttgaatcttcttttcctcattccttgatagacaaatctatcaggaaattctgctgcctctactttctaaatatatctataatccagctgcctctcaatcctgggaccagtctggtctctgacctagatttctgcagtggcctcctaactggtcttcctattagtacccttgtcagtctgtttttaatgtagcagcctaagtggtcttttcttttttttttttttttttttgagacagagtctcgctgtgtcgcccagtggagtgcaatggcgcgatctcggctcactgcaacttccgcctcccgggttcaagcgattcttcttcctcagcctcccgagtagctgggactacaggtgtgcaccaccatgcccggctaatttttgtgtttttagtagagacggggtttcactatattggccaggctggtctcgaactcctgaccttgtgacctgcccgccttggcctcccaaagtattgggattacaggagtgagccaccatgcccagcctggtcctttcaaaactaagtcatatcatatcactcctctgcttaaaaccttccacagatttttcatcccaatcagaatgacacaagtcctctacaccatttgtatttctcgactcattatctctgtgatctctttttttcttttttggagacagagtctcgctctatcgcccaggctggagtgcagtggcgcgatctcagctcactgcaaactctgcctcccaggttcacgccattctcctgcctcagcctcctgagtagctgggactataggcgcctgccaccgcacccagctaattttttgtatttttagtagagacagggtttcaccgtgttagccaggatggtcttgatctcctgacctcgtgatccgcccatcttggcctcccaaagtgctgggactacaggtgtgagccaccacgcccggccctctgtgacctcattttttataactattccttttctgtcactcagctctggccacactgtcctcagtgttccttgaaattccagggcatgctaccttactgccctccagggccttgcacgtatccccatgcagtgggataaaagcctttggcttttccctcacttttttcagtaagacatcctctgactctcctatttaaaattgtacccaccaatactcccagtcctccttccatgttttatttttctctgtagcacttgtcattgtataatagttttatgtattttacttatttgtttattgtttttgtctcctcctcctacacacaagaatataagctctgtgagggcaggaatttgtttgcttgtctactactgaataaagcaagcactaaaacagtgtctggcacgtattagatactcaatgcccattggctaaatgaataagtattttctaaatgaatgagtgaaggcagcctgggcacatagcgtgagacctcagctctacaaaataaaagtaggccagagggccaggcactttgcctcatgcctgtaatcccagcacattgggaggccaaggagggagggtcacttcaggtcaggtgtttgagagcagcctggctatcatggtgaaacccatctctaccaaaaaataacaaaaattaggcgggcatggcagcacatgcctataatcccagctattcgggaggctgaggcaggagaatcactcctgaggtccggagttcacaaccaccctgactaacgtggtgaaaccccgtctctactaaatacaaaaaaaaaaaaaaaaaagccaggcgtgatggcgcatgcctgtaatttgagctacttgagaggctgagacaggagaattgcttgtacctggttggcggagattgcagtgaactgagattgtgccattgcactccagcctgggcaacaagagcaagactcagtctcaaaaaaaaaaaataaccacaaaaaaacaaatgaaaataaagatagctgggcatagtggtacatagctatagtctgtgtacctgggaggctgaggtgggaggctcacttgagcccaagagttggagactgcagtaagctatgattatgccactgcactccagccggggcaacagaacaagaccctgtctcaaaaacacacacacacacacacacaaaaacaaaaacaaaaacaaaacaaaacagattgaatgaagactcatagttgtcaatatgtagattcataggacttgaagatggggtctagcctctggacactagtgaatttcagctaactggaagggtacgtatttacatttttcttaaaattactccaagaaagtatattcttccaccttttccatcgttcttcagctcagtgtttctttctcacttctagttctgttcctcacttatgctgtttcctctgtccaaaatattctttttatatacctgatagcctttagcaaacctccctagaattctccatcccctagacagtgtcactgtttttctcctccattttcctgttgttctttatttctgtaacatgcacaggatgatgggtgtgaatcctgtcctctgaattgtgagcctcttgagggcagagagtaagtctttcatgcttccctgtatccttgtagttgttcacttttcatagatttttcacacctttgtactggatcttcctgtctaaagcctttgttaatcacttgataatgtttgtagaactgaatcactaaaacttattttatttggccgggtacagtggctcacgcctgtcgttccagcactttgggaggctgaggagggaggatcactttagccccaagatttgaaaccagccttggcaacatagtaagaaagaccccatccatacaaaattaaaaataaaagaattaggctgggcgtggtggctcacgcctgtaatcccaacactttgggaggctgaggcgggcggatcatgaggtcaggagatcaagaccatcctggctaacatggtgaaaccctatctctactaaaaatacaaaaaattagctggatgtggtggtgggcccctgtagtcccagctactcgggaggctgaggcaggagaatggtgtgaacccgggaggcagagcttgcagtgaggctgaggcaggagaatggtgtgaacgtgggaggcagagcttgcagtgagccgagactgcaccactgcactctagcctgggcgacagagcgagactccatctctaaaaaattaaataaataaataaatacataaaaaataaaagaattagccaggtgtggtggcacatacctgtagtcccaacttcttgggaggttgaggtgggagggtcacctgagccccagaggtcaaggctgcagtgagcagtgatcatgccactgcaccccagcctgaacgagaaggcgagactgtctcaagaaataaaaacaaaaacagaaacttattttattagatacccaatctatgtgacactaattacaagtgaatcaagatttaaaagaaaatcgtgctaaccacattaactctcagtatagttttatgactattacaagccatccaaatctattcctacttattcggtttactaactagtatattcagcaagtatttatggagtgcctgccatgacaaaggccctatgctaagcctaacacatatacaaattgtatccactcctcaacactctgcttaaactcctctataaatcctttccagttcaaatcgaaaggctagtcattttttaaacatgagatctcagagaggaaattggaagtacatgatgtgttaactgaaagatggattaggtgttataactcttcacacacttctgcagcataatcattcatagaactgtgttcttttaattggctcctgtgatttttccgggactccaagggtgggaaacaccgggaggtaaagctcgtgctgtttcacttgatgtgctaaaatggttcttatgagataatgctcctgtagcatttagctcagcttgctcagtgcctggttcatggttggtgctctggaaatgttacgtactttgcacattctgttgttacagcagttgtttctctgccttttactggtatgtcattctcaataatttgtaaacttttaggaaaggtctttaatttcattatcttataagaggtataggagctacctggttgaattatttgctgctgattttaaggttgctgtaaggttcagtaggcagggtagggaagatgagcatacaaattttatttaacaaattgtttgttaaaagagtacttattatatgtttgatgctgtcctaagcactttgtaaatattaatttatctaactctcataactctatgaaatagttacttttattatcacattttatagaagagggtcctgggacacagagaggttaagtaagtttaccaaagacacacagatagttagagcaaggccagtattcagatactgttggtcgaaggccaggcatggtggatcatgcctgtaatcccagcactttgggaggtcaaggtgggtggatcacctaaggtcaggagttcaagaccagcttgaccaacatggtgaaaccctgtctctactcaataccaaaaaaaaaaaaaaaaaaaaatagctggacatggtggcacatgcctgtgcctgtaatcccagctacttgagaggctgaggcaggagaatcacttgaacccaggacgtggaggctgcaatgagccaagactgcaccattgcactccagcctgggcaacaagagtgaaactccatctcaaaaacaaacaaggccgggcacagtggctcatgcctgtaacccagcactttgggaggctgaggtgggtggatcaccaggtcaggagatagagaccatcctggctaacatggtgaaaccccatctctactaaaaatacaaaaattagctgggcatggtggcatgcacctgtagtcccagctactcgggaggctgaggtaggagaatcgcttgaacccaggaggcgaagtttgcagtgagccgagattgcaccactacactccagcctggtgacagagtgagactctgtctcaaaaataaacaaacaaaaatactgttggtcttgcaattaagcattattcaaggttgaatgtgaatgatggcatataaaaagtacagagaatgtgctatggcatttcaaagaaggtaatggtcacattaatgtctcactgggggttaaagaagtcttcatgctggccaggcgcggtggctcacacctgtaatcctagcactttgggaggctgagtcgggcagatcacaaggtcaggagttcgaaaccagcttggccaatatggtgaaaccccatctgtattaaaaatacaaaaattagtggggcgtggtggcgtgtgcctgaagtcccagctactcgggaggctgaggcagaagaattgcttgaatccgggaggcaagaggttgcagtgagccgagatggtgccactgcactccagcctgagtgacagagggagacttgtctcagaaaaaaaaaaagtcttcatgctgaaattggcattttcaggggactactttttcaggtgcttggccatgggagaagaaaagggaaggtaggccgggcgcgatggctcacgcatgtgatcccatcactttgggaggccgaggtgggtgggtcacttaagctcaggagtttgagaccagcctggccaagatggtcaaactccgtctctactaaaaatacaaagaattagcccgggtggtggcgggcgcctgcagtcccagctacttgggatgctgaggaaggagaattgcgtgaactcaggaggcagaggccgcagtgagccaggaccacaccactgcactccagcctggccaacagagcaagactctgtctcaaaaagaaaaaaaaaaaaacccaaaaagaaaatagtaatgcaaagcctcagggatgggaaatggtaggccatcaggaagtagtcctacatgtaagcagcatgtaaggatactgtaggagggaggcaagatttggggttagagcataggaagcttgagattctgaatggaggacaagctggagaagatgtgacatagagctgtgctttgataagtacgaaaacattgtatgtgatgaatcagaactgatagagattcactgtaggaaaaccagttacaaggtcattatgtccagaaaagaggcaattaggccttgaactatggtgaaaataggtatagatacaagaacattacagaatttgaattgacagcagaataacacaaccaaaatggatagtcaaatatttatatcattatatgactagtgtaagtttgttttatggtcagtaaggtcctttgaatctcttgaaaactctgctcttgttgtaactgagcattatcttaagagaaaatatattcatttatctctaaagaaatatgaagtttctttcattggacttgtaatttacatccaaggaaatgatttcctttgaggccagctaatttattcagaatgtctggattgaaaatgtttcttagtctgcttagtgtagacaaaattagaaaccactttagcctaatgattcggaagaaatgatttctttaaaattgtgatcatctcagtttctttcatgtgatacaaatgtaaattgcaaatgagaacctaaatgtgtctgtcagttggctttgctaagcagaaatcttctagctgactcatcctatttacagaagaattatttcaaagtaacctttggaaaacctgggtagaagtggtttggattagtgaggttgataaatatcagtgtaagaggagtattcaattatagtttggatacctctggtgctttggaagagttataataaagtaaagccaagagatgatgatgatgccttagagttgtatggatacaatacctaggagtaaatttaaccaaggaagtaaaagacttgtaccctgagaactacaaaacgttgctgaaagtaattaaagacctgtgtaaatggaaagatgttccatggattagaagacttaatattgttaagatgtcaatattaaaagtgatctacaaatgattcattgcaagccgtatcaaaatttcaatggcctttttgcagcaatggaaaagccaatattcaaatcatctgtaattgcaaggggcccttaatagcccttcgtggatgttcttgaaaaaagaagaacaaaattggtggatttatacttctcaattttaaaacttacccttacctcacattatatataaaaactgactcaaaacaatcaaccaacaaactaaatataagagctaaaaccataaagctattagacgaaaacagtaatctttcgtgaccttggatttggcattggattcttagatatgaccccaaaagcacaagcaacaaaagaaaaaaaatagatgaattggatttaataaaaattagaaattttgtgcatccaaggacattagcaagaaaatgaaaagacaacctataaaatgggagaaaatattttcagatcatatctctcataagggtcttaagaattcttacatatcggccgggcgcggtggcacatgcctataatcccagcactttgggaggccaaggctggcggatcatgaggtcaggagatcgagaccatcatggttaatacggtgaattcccgtctctactaaaaatacaaaaaattagccgggcatggtggccagcacctgtaatcccagctactcgggaggctgaggcaggagaatggcgtgaacctgggaggtggagcttgcagtgagcctagatcgcgccactgcactccagcctgggtgacagagcgagactgtctcaaaaacaaaacaaaaaaaaattcttccgtgtcaacagcaaagacagcaaggcaaagtgggtatgtgcctgtagttccagctacttggaaggataaggtgggaggatcagtgtcaacctggataacataacataacataacatagcaccatagtctctaaaaaaaagacaacccagttaaaaaatgggcaggccaggtgcgatggctcacgcctataatcccagcactttggaagccaaggtgggcggaccacttgaggtcgggagttcgagaccagcctgacgaacatggagaaaccccatttctactaaaaatacaaaattagtgggtgtgctggcacatgccagtaatctcagctactcgggaggctgaggcaggagaatcacttgaacctgggagctggaggttgcggtgagctgagatagtgtcactgcactccagcctgggcaacaagagcgaaactccatctcaaaaaaagaatggctgctccataggcagagcagtgtcatgggctgcctgactgagtatagttacggtatttcctgattatatgctaaacaaagggttttctgggaaaggggtggggaattcctggaactgagggttccttcctttttagatcatatagggtaacttcctgacattgccatggcatttgtaaaactgtcatgtatgggtgggagcgtcatttagcatgctaatgcattataattagtgataatgagcagtgaggacctccagtggtcactttcatcaccatcttggttttggtgggttttggctagcttctttacagcattctgtttttatcagtggggtctttgtgacctgtatcttgtgctttcctcctatcctaagaatgcccaacctcctgggatgcagcccagcaggtttcagcctcattttacccagcccctgttcaagatggagtcaaacaactctgacagcactacaacttttttattttatttttattttttgagatagtctccctgtgttccccaggctggagtgtagtagcgcaatcttggctcactgcagcctccacctgttggggtaaagtgattctcctgcctcagcctcccgagtagctggaattacaggcacccgccaccacacccagctcatttttttgtacttttagtagagatggggttttaccatgttggccaggctggtctcgaactcctgacctcaagtggttcacccacctcggcctcctaaagtgctgggattacaggtgtgagccaccgggcctggcctgcaacactacagcttataggaggaagaggggagtaaaacaaaataagtttccagttagatgtttaaaggctcaattttaaaggattagatcagaaagttggacaaatgggatgacatgaaggaaaaaatgggaaataaaaacaaattatcattaacccagagctgggctaggtggcatgtgcctatataatcccagccattcaagaggctgaggtgggaggatcacctgagccaaggagcttgaatccagcctggacaacatagtgagatccctgtctcttaaaaaaaaaaaaaaagtgtcggccgggtgcagtggctcacacctgtaatcccagcactttgggaggctgaggtgggcggatcacgaggtcaggagatcgagaccatcctggctaacacggtgaaaccttgtctctataaaaatacaaaaaaattagctgggcgtggtagcaggcacttgtagtcccagctactcgggaggctgaggcaggagaatggcgtgaacccaggaggcggaggttgcagtgagccaannnnnnnnnnnnnnnnnnnnaaactcttttttttttttttatttttttttgagacagagtcttgctctttcctcaggctggagtgcagtggtgcgatcttggctcactgcaagctccgcctcccgggttcatgccattcgcctgcctcagcctcctgagtagctgggacaacaggcatctgccaccatgcccagctaaatttttttttatttttagtagagacggggtttcaccgtattaaccatgatggtctcgatctcctgacctcgtgatccgcctgcctcggcctcccaaattgctgggattataggcatgagccaccgtgcctggccccaaactctttatagaaataaataacaacaaatgatcattaacctgtttcagccaagggttggagtttaacatcaaggtgagttcttacatattacatgcaaaacagtggcccatgaatttttttttttttggattaggtcagaattatcatgttaaatcttttgagaagaataaagcaaaatattagtaactaatttcattgaagatctcaaacataagttagtaaaattaagaaacaatttgaatttcatatgtttttagagggaagttcactcctttgaaagttgaaaaagaaagcagatgtacttaaatatgggacattcttttgaacttagaatttcagattatatatcctcagagaatccagtatataggagaaactacaattagctaaactaattttagctacttgagttcaattcagcaataagacaaaaagtgaatgcaaaatgtatcatgtgcttattaggtcatagtacaaatggcttataaaatgtacagggaatttttgtgtacattgatttgttaatggtgacatttttttactttgtttcattatttggtggccctttttgtcactttaatacgtaatattctgttagttttgtttttgagaagatggagttgcaccatgtcagacagaaaaatgcccattcttgtcagaataaggttatctctttgattgcagatgatgaaagccatgaacaagtccaatgagcatgtcctggcaggaggtgcctgcttcaatgaaaaggcagactctcatcttgtgtgtgtacagaatgatgatggaaactatcagacccaggctatcagtattcacaatcagcccagaaaaggtgagcatttgagctggttgagattatgataatggaaaattatactggacttggacagttagatacctcagtcccgtaacactcactttctagataggtgaccacaaacaaattaattaacctttccaaccatattcttcaggattatgttgactccccaagtggccagactcagagttgcaaatgggatatgtgttattgagggaacaattttgaaaatatgcccttaggagggagggatagcattaggagaaatacctaatgtaaatgacgagttgatgggtgcagcaaaactaacatggcatgtgtatacgtatgtaacaaacctgcatgttgtgcacatgtaccctagaacttaaagtataataattaaaaaaaaaaaaaaaaatatgcccttaggatattgacaagggccagctctgacatttgaaggcacgactaggccccataatgagagtatgtttaggtaaatttgaagcttgttggatgaccattcccacagaatgctaattaacttgacaggattctgaaggaggtttcagtgctattcagaatgtggtctccacaccccagattcactaatcaaaatttgcattttaacgagatctctgtgtgattcaagtgcacattcgactttgagaagcattgctcaagaggcgttacccaaagtgttttctcaggcaccatggtgttaaaaacttcacatgaaaaaataagtcttgtttaatagatttaatctaagaaaccccgtgttaggccagccgcggtggctcatgcctgtaatcccagcactttgggaggccagggcgagagcatcatttgagctaaggcgttcaagacaagcctgggcaacatagcaagaccctgtctcttaaaaaaaaaaaaaaaaaagcagggcatggtggctcacgcctgtaatcccaacactttgggaggccgaggtgggtggatcacctaaggtcaggagttcaagaccagcctgaccaacgtggtgaaacttcatctttactaaaaatacaaaaaagttagcggggcatgctggcacatgcctgtagtcccagctactcgggaggctgaggcaggagaatggcgtgaacccaggaggtggagcttgcagtgagcagagatagcaccgctgcacgtcagcctgggtgacagagcgagactccgtctcaaaaaaaaaaaaaaaaacttagcagataaaatagttggcaaccatatttctatcttcagaatatatttgatctaaaaaaatctgaaaatcaatggattagattgggggtggcaaactttttttgtgaagggccaaatgataaatattttagactttgcaagctgtggtttttgtcaacaactattcggctctagtattatagtgcaaaaactgccatagacaataagtaaatgaatggacatggctgtgtttcaataaaattttatttacaaaagcaggctggaggccaggcaggctatagcttgccaaccccctgacctcaaccattaagattccttttcttgtaagatacttggattcttaattagaggaagaacaaaacaaaatgggggagtgtatcttaaaacctagttcccaaagctgttgtaagcatcagaattgttggttacatgtttattgtggaatatagatttgattttttaaaattttctgtgtgatgatggtcggaattctcaacttctgaatattttgttattattttcaatccctccagcttagggtctgtcttactaaactatttctattgctgttttagtgactggtgccagtttctttgtgttcagtggcgctctgaaatcctcttctggataccttgccaagtccagtattgtggaaggtaaagaatgaattgttcagtcctcataataaggactgaacttatgtacataaagggaatcctttacacttctgctgtagatgtctgactcctactgttttttcagtagcatctcttcagcaaattaaaactgccatgagagtgcttagttctctgaagaaaggagtaagtggtagggataccatgtgacaatgacattaaaactaggagatggcctttcagagctctgggataaggtacctgagggcatgtagtctgagttcaaatatatcattgggtggaaatattaatatctaaatgtgtagatgaaagtcctgtccacaagaatgctgtggtcatcatttggagtacaaaatggcatgtgcttgctgctagtgtgctataattagacatgacacatatgttgacaaaagttaattaaactaaaagctaattggcacaccgtttattttctttgttggttattcattgtgttttgattttgctactcttatttcataacagatggcttaaaacaaccattttatcatgcttgcttatcctctagatcagtaatcttgacagggcaatgcagggatggcttaacactgcttcatgatgtttggagtcttagttgggatgacttgaagttatctgatgactgggagctagaattatatgaaggtttgttcacacacacgtctgaggcctggcctgggatgatttaaagactaggagtggtgactggggtacttacgtggggactccttaacatggcttgataccattgggatagctggactttttacatggtggttcaggactccaaacatgaatgttctagcaagaaggtggaagctgcattgccttttgtgacccaccctttaaagttatattgtgtcatttccaccatactctggtgttggaaaaagggagggaaattagacttcacttctacatgggagaatgggaagatagcattgtagaaaaatgagatgggagatatgaccatttatggaaaatgtagtctgcctcacatgatgacaggttttcatttttacagtagctcactccaaagctctgtgtaaaaacagtcctttcttaggccgggtgcggtggctcacgcctgtaatctcagcactttgggaggccgaggggggcagatcacttgaggtcaggagttggagaccagcctggccgacatggtgaaaccccatctcaactaaaaatacaaaaaacagccaagcgtggtggcgcatgcctgtaatcccagctacttgggaggctgaggcaggagaatcacttgaacctgggaagcagaggttgcagtgagctgagattgtgccattgtactccagcctgggcgacagagtgagactctatctttaaaaaaaaaaaaggtcctttcttagggctggattccagtgtgttgattgaaatacgtagataatcttacatatatttatagatactagctttggtcttcttttggtaaatttaataaaacagtgagtgaaacacagagtgcactaatattttacaactaaaatttacaactcttgactacaaaacagaaacatgccgttaacaaattgttatgaaatctaagaggtttttttttttttttttttttttttttttaagatggaggcttgtagcccaggctggagtacagtggcacaatcttggctcactgcaacttctacctcaagtgattctcctgcctcagtctcctgagtagctgaaattacagttgtgcgccaacacgcccagctaatttttttgtatttttagtagagatggggttccaccatgttggtcaggctggtcttgaactcctgacctcaaatgatccaccaggctcagcctcccgaagtgctgggattacaggtgtgaaccaccacacccagcttaaaatctaggagttaaacagtcatttggtctaaagcaactagttaaagcctatatgatgaagtgttgactatagttgaaattgtgacttcacaaggtgattttaaaacaccccttaaatgttgttaaatgataaaatgagctgggcatggtggcatacacctatagtaccagctacttgggaggctgaggtgggaggaccctgtgaggccaggagcttgaggctgcagtgcattatgatcgtccctgtgaatagtcactgcgctccaacctgggcagtcatctcttaaaaaaaaaaaaaaaaaaaaaaagataaattgacctgacacagatccttaccaattcaaagcagtgtgtttaaaaattatgtgtttatgtgtctggcttgggaatttcttgggtcttgcatttcacttgtgtgtttcagtggagcgattggctgactatgaaattgttattgagactctttagaaattatttcattgtgtgtcagtgaagcagagtaattgctcagcatgtgacaacttttactgtcaatttcagtgtttgccttcaactcaggtaggtagcagctgaaaaagttaccatctgttggttatctggtagcccatatgaaactctgtggtaggtttgccttatttgctagtcaataaatggatttatctccaagcccactactataatttattcagtgatttatttagcaaacatttattgggcattcactgtatgccaggcagtcatagtaaggtgagagagatggagatgcaaacaaatgaatatgaccagaggatgataaatgcaggagtgaaaacaggaacaaaatattcagtgtgtccagaagaagaatgtgactgtgtttaagttttccccttaagtagtctcaggagaaattcttagttgtgtctgaagtgaaatcaacaagcatgtgttttaatcttggcattgcttctcacaacactttcagtaagaggttcagctcaaagagcaaaacctctgtatcagtcagctttggaaagcagagctaaggtttacatttaactcggaggaatttgctagatgccaggtgctgtgtttcatttgcctctcctttggctttgtactgattcttagatggtgttatggtccagattactgcagagaacatggattccttgaggcaggcactgcgagagatgaaggacttcaccatcacctgtgggaaggcggacgcggaggaaccccaggagcacatccacatccagtgggtggatgatgacaagaacgttagcaaggggtaaatgcagcacatgtccccctttgtggcttttagttataggttaggctctgggttttgtctgctgtctacattggtgttttatagttttactgaaagccctgcctaagagaaagactgctttgtatgcttaacgtagaattttaaatttctggttttgtaagttagtttctgaaggagtttctgtatgtatttttgagggaagtataagtagagggattgatgaaacaaaaaagtccctctatagttattgagataacagtaatacctgagccttttaagatttacaacacatttttgccaacattgttttgtttgatacaataacaggtgttaacatttccattctataaatgagtaaacaagtaccaaaaggctaagtgacttttcaggtctacaaagctaggaagtgataagactagctctgaaaaccaccttcttgggcttcaaactctgtattctttctcagtgttcggcaactctattctaatggttcaagccaaaaccttggagacatctttgacacttttctttccccctcacccctttcttcctctcatacccagacattcagggacaagctggaaaacattgcatttatacattacaaactgaactttgtatcctttctcaaaggattctacacaacaaagggtgctctttttttgttttgtttttaacattgctatttgatgaattagaaattaaacttaaattcaagtaattttgactaaatgaagtgaatgcctgatatggaagtttaagttagattcgacttttaatacatagagatttggccgggtgtggtggctcacgcctgtaatcccagcactttgggaggctgaggcaggtggatcgcctgaggttgggagttcaagaccagcctgaccaacatggaaaaaccccgtctctactaaaaatacaaaatcagctgggcgtggtggtacatgcctgtaatcccagctactcaggaggctgaggcaggagactcacttgaatcgggaggcggaggtttcggtgagccgagatcatgccactgcattccggcctggacaacaagagcgaaactctgtctcaagaaaaaaaaatagagattcaagaacataaacaggtttgaaaattgttagggaaagtttagaatctgtgtgccaattattttgaatcctaatcagaatgaatgtgtatctccatgtatttatacttgtatttcagggaggaaatgactatcagaagtggcctttttgtttaggaatctaggagtgataatttagcactaaagggaaggtgttatgacagatacatagatacttgtttacactagcactgtcataattagcaacttggtcaaataattcctttttttttttttggagacagagtcttgctctgtaacccaggctggagtacagtggtgcgatcgcagctcactgcaacctccgcctcccaggttcaaggtgattctcatgcctcagcctgcccagtagctgggattacaggcatgtaccactattgcctggctaattttttgtgtttttagtagaggtagggttttgctatgttgctgatgctggtctcgaactcctgagctcagacagtctacccacctcagcctcccaaagtgctgggattacaggcgtgagccaccatgcccagcaaatgattcttaataaatatttattagactcctaagttccaagcagtgggtcagtaatgggaatataagcacatagaggggaatatatcatattccctccccttcagaagttcatttgtaagtcaggtatgcaaacatgaagaatatatcatgacaagtatcattacagagtcaggagcagagtgaaaacaagattgagtgggtgaccatgcattcactgaaagaagggatactggaagaagagcaggtttgattaatcaatttctttacgttaaagagaactagctcctggaaaaatgattccttttttgcatgtgtgttctttgaactatttcagtgcatagattctttcccaagagctcagttcatgtacatttttatacagtggctgcttcttgctatgatgtgctgcacaggtgtgttcagcagggtacccagtgtaattagcaggaagacttctgcagcaaaacgtgataggaaaaatggcttttctaacttcaagagctgcttctatctttcctttgcctctattttagtgtcgtaagtcctatagatgggaagtccatggagactataacaaatgtgaagatattccatggatcagaatataaagcaaatggaaaagtaatcagatggacagaggtaaggaaatgaaacttggcatacttgacccactttgagcacaactttttgctaggccaagagccacattctgggttgactttgtaggataagaaaaaaatatctctgagaaaaatctttctcgtttatactacaattcctatctgaaatcaccaggaagaaatgctgccagttgcagcctgcacctgtctgatgtatcctccttcctgtgaactaacttttagatatttctttgcattggaactccagaagagtagatctctgagtggtacattccatctttgctgtattcttcagaaagctgggtcagttattctgtacttataaactattttagataacatgacggtctttaaaaaatacttatttcactaataagaaaactaggccaggcacagtggcttacacctgtaatcccagcattttgggaggctgaggtgggtggatcacttgaggtcaggaattcaagaccagcctgggtaacatggtgaaaccccatacccactaaaaatacaaaaattagccgaggcatggtggtgcacacctgtagtcccagctgcctgagaggctgaggcatgggaatcacttgaacccgggaggcagaggttacagtgagccgagatcacgccactgcactccatccagcctaggcaacagagcaagactccgtctcaaaaaaaaaaaacaaaaaaaaaaaaaactaggccgggtgtggtggctcacgcctgtaatcccagcactttgggggagaccaaggtgagcagatcacctgaggtctggagtttgagaccagccctaccaacatggagaaaccccgtctctactaaaaatacaaaattagccgggcatggtggtgcatgcctgtaatcccagctactcaggaggctgaggtgggagaatcgcttgaacctgggtggtggaggttgtggtgagccgagattgtgccattgcacgccagcctgggcaacaagagcgaaactccgtctccaaaaacaaacaaacaaaactaaagctcagagactaattaacttgctcaagattacaaggcaaataaataatgataaaatcctgattaaaacccagatctggccaactcctaagctctttcccactgtattaatttgctccttaacttgaaagctgtattagaggctcacctgggaatgagaggagcagggcagtgacccttttttgtatgtacatgtcatatagatcagaaagtttattctcttcatccccaagaggtctgagaaaaaataaaatacgaaaaaaattttaaaagttctcgtaagctggtagatcttagatccctttattacttttgaacctcatgtatgctcatttgtaaaggattaaattataagatctctaggattcttttcagctttgaaactcttatgtttttttaaaaaaattctacgacttctggcttttccatttcacacaaaaggaaacagagacccagggttgttaaatctcttactcaaattcatatggctagttcctgatagcagagatgagacctggttctccagttctgagcagtagtcctaagggactcatcctgcataacaggctccatgatttcatatgcagccaagggattttagttgcttgctatgtaatgattcgtccctttgacacattttgagcagtgcagagtctggaacgtgtaaaacactttatggcttataaagcagtttgacctctgttccctcctttttgctccccagtagcagtgaggtaggcaagctacccatcctaagatgcagatgagaagacaggctcaaacaggtcatgtgactgtaactttgtgactgatgttggttaatggcagagcaggggccagcgctcaggtctcctgactcccactctgtcatttcatgccaccactctccagtgcatccaggtacggggcttcggagctgcctcctttgtagtcctctcagtgtaagttccttatggagcagtaagctaggggttgctatatagaaacatcgtgtatttgcatttctgtgtcttttatattttgcctttttttttttttttttgagacagagtctcgctctgtcgcccagacggcagtgcagtggcgcaatctcggctcactgcaagctccgcctcccgggtacacaccattctcctgcctcagcctcctgagtagctgggattacaggcgcccgctaccacgcccgactaatttttttttttgtatttttagtagagatgaggtttcaccgtgttagccaggatggtctcgatctcctgacctcgcaatccgcccgtcttggcctcccaaagtgccttttttttttttttgagacggagtctcgctcttgtcacccaggctggattgcaatggtgcaatctcggctgactgcaacctctgcctcctgggttcaggcgattctcctgcctcagctttctgagtagctgggactacaggcatgtgccactacacccagctaacttttgtatttttagtagacagggtttcaccatgttggccaggctggtctcaaactcctgaccttgtgatctgcccgcctcggcctcccaaagtactgggattacaggtgtgagccaccgcacccggccttatattttgcctttatatagttttatctttacaataaccagagaagtcaggtgctttccactttacagaggcaaattaatttttttttttttgagacggagtctcactctgtcacccaggctggagtgcagtggtgtgatcttggctcactgcaagctccacctcccaggtccacgccattctcctgcctcagcctcctgagcagctgggaccataggcacctgccaccacgcccggctaattttttttgttttttgttttttgtatttttagtagaaacggggtttcaccgtgttagccaggatgatcttgatctcatgaccttgtgatccaccctccttggcctcccaaagtgctgggattacaggcatgagccaccgtgcccggccgagacaaattaattattaagaagtcctcagcctggccagcatggtgaaaccccatctctactaaaaatacaaaaattagtctggcttggtggcaggctcctgtaatcctagctacttgggaagctgaggcaggagaatcgcttgaacctgggaggtggaggctgcagtgagccgagatcgtgccattgcactccagcctgggcaatagagcgagactccatctcaaaaaaaaagaaaaaaagaagtcctttgggccgggtgcggtggctcacacctgtaatcgtagcactttgggaggctgaggcaggaggatcacctaaggtcaggagttcaaggccaacctggccaacatggtgaaaccccgtctctactaaaaatataaaaattagccaggtgtggtggtgcacacttgtagtcccagttacttgggaggctaaggcaagagaattgctggaacccaggaggtggaggttgcactgaactgagatcgcaccaccgcactccagcctgggcggtgggcaacagagttgagactccatctcaaaaaaaaaataaagtaagtcctttgggccaggtgcggtggttcatgcctgtaatcccagctctttgggaggccgaggtggacagatcacctgaggtcaggagttcaagaccagcctggccaacatggtgaaaccccatctctactaaaaatacaaaaattagccaggcatggcggcacatgcctgtaatcccagctactcaggaggctgaagcaggagaatcacttgaacctaagaggcaaaggttgcagtgggcagaggtcatgccactgcactccagcctggtgacagagtgagactttgtttccaaaaaaaaaaaaaaaaagtcctttaacttcctttagtcctctaacggacttgctcatgacccttcctctatggtgctaggacttaggtcatcagttccaagtgtgttccacttctgcctgtgcacagtgctgacacagttcccgcctctatagtggcagggctgtgtggtggaaaaagctctgcaataaaaggctcagatgccaggctcagcctggctcttcctctgtctcttaaattcttctgtgcccttgagccagtcaattcccttctaagactaattgtaaaataaagcagctgggtcacgtcagctataagagccattctcttagacttaagatcattttctaggtaaattgtccacatacagggattaccttttagtggcatacaatgcaaaatggaggccttttctagttctgagaagaatgtgccattgcaaccatggaggcttgcagggagttaggcaggctgctgctgtcattttgtggatgcagagatggagagacagggattgttttttttttaggtggaagacaaatgcccaacttttcctggaccagggactttatggtgtcctgttcctgtcatgtcttcttgcacatcttggagaatcagggtgctcatatacagtgagctaatctacttctcccaaaatctaggcacaagtttaaaagtctcttttgtttggggaacaggtgtttttcctagaaaacgatgaccagcacaattgcctcagtgatcctgcagatcacagtagattgactgagcatgttgccaaagctttttgccttgctctctgtcctcacctgaaacttctgaaggaagatggaatgaccaaactgggactacgtgtgacacttgactcagatcaggtatgatgtgtcttccgcagcttttaaagctggccttgggcaacgtctgtatttctgacgtgagtttttctgcatcaccccagagagcttaattctccgaccttctggcctgactggatatagtgtttttggccctctctttaatagtactatacccacatgtgatgcttggtcagattctctcagaaccatttgaactgtggcttcttcacctgcatgccttccaaggagctggtttccttcttagtgtggggtaaagaggggagcatgtggtaggacctgccaggtcctgccttgatgtttacaaattgccagacctctctgttccctcaaccctttagctccgagtcacttggaacttgggtgtaggctcagcttgatcccccttccccactgagtgagtgttaattctgcccagcaagctgcttctggcctgagtgcttatgaggagaaactggttcctgatcacagggttgtgccattatcagggaatgatgaaaggttctgtgtctggccccagttcctgactagtcatcaatcaacaaatatttattttctgcttaacggcttgcccaatgctatactaatgaagtattctggtcctatctcacataaaacaaagaacaagcatttttctgctaaatatgtgagcctcttgagggcagggccctgttacattcatctttggatccctgcatttgtagttgctcagaatggtgcatggatgaacagatggatgcaagaacaaatattcagttcctactaggttagggagctgtacattgtgtatttctcattttaattttcacaaccaaagattaaggtattatttctgatactccatacctttttacacacctctacccttccccagaaaactaagaccataacaggttaagtggcttacccagtgcctcatggttgtcaagtggtcaggaggagtaaacaacaggataagtgatcacccagaaaagaggataaatttgtattcactgccatatgtttagcctatggccaaaaaggacatctcctttcctgctcagcctccttgccctcagccctggagaggccttctctgttcagtaacctctcctccttttctctctgtggtataggttggctatcaagcagggagcaatggccagccccttccctcgcagtacatgaatgatctggacagcgccttggtgccggtgatccatggaggggcctgccagcttagtgagggccccgttgtcatggaactcatcttttatattctggaaaacatcgtataaacagagaagacttcatttttttctgttcagacttgttgcaacagcagtcatacccaaatcatttgcactttaaaactggaagattaagcttttgttaacactattaatggggtggggaatagggtgggagtgggggtttgggagacgggtgggaaagggtggttggggggaccgatgttccataattctaagtcttctatgcattgtccaccaagaagatctgggcagcttctgttcctgcacaacagttatgctatccttgcagctaatccccttctgttactgtttagacaagaattccgctcctctctcaagatttacttatggtcatgtgctcagaaatgctcaaatgggtacaaccatcaccaagggtgggatgggagggcagaggggaaataaaatataaagcatcagttcttgcactctttgtacagaattggtataaaaaggataattccacactgatcttgtcccagttacatcacagctgtttatcaagtagaagtcacacttagatttttgtttttaccagattattcattgaagtgaatcgaagactcaagggcttaatctactcttccagtttcggaagggcaactcagtgtaaatgtcatgtggagagcagaggtgagttcaggattgctggagatctgcccgtgtggatggcaggtattcaactgggtatttctgtgaatgctgatggaatacacccaggacatttttagttataaatactggaggaatttaaaaatacattttattgagaaataatttaaacttctaggaagttgaaagtacaaaaaaccccacgcacactttacccagattcccctcttgttcacttattaacattttgtcccatttgatttgtcagggtttctctctccctttctccttctccataaaaaattgaggcatttgagagtaaattgcgtacatcataggcctttcctcctaaatgcttatttcctaaaaataaggatattctcttacacaactgtaggacagttctctacttcagtcaaacatggatttgatactttaacctggcatctgcccagtgatgttctttgtagcattttttccctccagtaaaccttccagtatagaatcagacatggctatggctgtcatgactcatcttgatcttttatgtcattgatatgtattttttttgagacggagtctcgctctgtcacccaggctggagtgcagtggtgcaatctcggctcactgcaatctccgcctcccaggttgaagcgattctcctgcttcagcctccggagtagctgggattacagacgcccgccaccacccccagataatttttttgtatttttagtagagacagggtttcaccatgttggccaggcctgagctcaagtgatccgccatcctctgcctcccaactcctgatctcaagtgatccgccatcctctgcctcccaaactgctaggattacaggtgtgagccaccgcactcagcctcattgatatttttggtgaatgtagccacccccaaccccaccctgtttttttttttttaacagaaaacaactcagtttgatatttcctcatatttagaatcagtttatgtgtttttgcccataatgacttgatatccatctgccccctcattgatagtggtaaattttgatcacttggtcaaggtgtccaacttctctgtatatccccctacctggaacttataaccagtatatgtagactttcagaccatgcaaatctcttgcctatgaaagtgtcccgttaaattagcatgcattgatgtttcttacctgcactgatcttttactatgtttgcaaaatgattttccaattctagcgcattctccagctttacaggttgcacttggtaatctactataagcagaagcccttccttcccaatttattcatttaattttcattatacactcatggactgttgttttgctttgttttgttttgaaacagtgtctcactctgtcacccatgctggagtgcagtggcacaatcttagctcactgcagcctcaaacttctgggctcaagcaaaccccccaccttggcctcccaaagtgctgggattacaggcatgagccaccaagcctggcctttttcagtggttccaattcattattttggtgcacaaatggtctcagctttagctagacaagagacccttcaagctggctcctacatcctggtgatatgctattttttttttttttttttttgagtacttcttttttatttctatcctaacaagatgcttcaggcttatcttgtgcttatcctgccctagccctggaatcagctatttctgcaaggagccctggcttcttttaatgggagtggtattagaaaccaaaatctggtttatccatgatatgtgtgatgcactctgacctttt

SEQ ID NO: 12425 - DNA, 7291 bp, Human
ctctccacagcgtaattactctctacctgcgctctttctagaatgcctccaggccagggaggcttgggaccccgcagagccgccgcagcagcgggcccccagcgctccctccccgcgtgcctccggctccgcgctctgccctaccccagcgctgctggcgccaggcgccggggagagcggggggtttccagcccgcctcgggcaggaaaccaggacctccctgcaccacccccccatgcacctccagggcccacagccctgctgagctcccacaggtggaaccagcaggcccaggcttttgtctccgtcactcctgtatgtaaccccccacccttcattcactctcttgtccaggagtggaattccactcatccactccctaccggacctcgagaaaatcgctcttcttctctgggcttcacgttccatatctgttcaaggagagaatgggcctttctccctctgtctttggactagtaactatgataggcacatagtaggcatcaataaataattgttgaatgaatgggtgaatgatttgccttctaaaaagagcactcacattaacttctcctttccccctcccctcgactttgctttgaagagaggcacactccctctaccacaccgagggagggggcgttgagctgagaaaggttgagagaatgagggacccaggtaggtggacatcggccaagaaaggaaccacagcgggaggtaagaccgagagtccccagcttgaagcgtcaccactccgggattcccagattccaacgcgagcctggggaaagcccacagtggagagagtccggctggcagggaatggccctacccccggggtgaaatctcggagggtcgtgcagccgagtcgcgcctctgcgctgatgcgtgagagatgccggacgtcgcgtttgcctgtgcgagcctcgcggatgctgtgcagtcttggtcccctctgcgtgtgtctaacgccgaatgctggtgtctcgaggtgtgagcttcggggccggtgtctttaaagaaccaaagattcttaaggagtgatgatctgggtagagcggcccgacgtagccgcgctcccaggtctcggtgcgagtcctgcggacagaccagaggagacctgctggccagatgccccgggcccaaggcggacgccagactgtctctgcgccagccgggctggccttcggaatggatcaggcacccgggaggccggagtggatctcagaccctcaagccgggaacaaacccgtcgatgcccgtgggcctggagtccgcctcctccttcccgccccacccctacccctgcctccgaaaggcttcttcgctggtcagtagctgcgtgcccgtctgcctgaggctgggtcagaattggcgggctggtaacgaccccgtgcacaagcggctcccagtctctccagaaagggccgatgactaaggggtgggggtgggggcggagggctggaaggtgttagggaagaacgttagcggcctatcctgtcttcagcagcgccctctcatcttctagctctgacgccgagcagagcagttggagctcgggactgggaactgctggaattcctatttagacttctagacagtctagaaacaagaacctttctttccctgggcctcagtttccttgtctgtaaaatcaaaaggcgggctctaggtgtaggccttcttttcgcttggtgattctggattcctttccttggatccgtggggagggggtggcagcaacagtccagggcgttggccgtcctgtgcctcaagtacgtagtccccgtgcccgccccctcaacacccccagcagcccgcccccctaagcccgcagagcagggagctgagtgggaggggcagaggcggggccggttcccagtccctgctggcggactagagtggcgcgggctgagcgtaaaacctgggatagccactcccccttttccttatccccgcccccctgccattggctcccgggagaggttgacatcaaagccgcggtctatataagccagatccgcaggggagtccgcagaagggttaaacaggtctttgggcttcggcgacctcgcccgcggcagaaaccggtaagaagacagtgggctgcgcgtctcattttcagccttgcccggactctcccaaagccggcgcccagtagtggctccagagcccacaggtggcccccggcagtctctggggcgcatggagcggcgttaatagggctggcggcgcaggccagtagccgctccaacatgaacctcgtgggcagctacgcacaccatcaccaccatcaccacccgcaccctgcgcaccccatgctccacgaacccttcctcttcggtccggcctcgcgctgtcatcaggaaaggccctacttccagagctggctgctgagcccggctgacgctgccccggacttccctgcgggcgggccgccgcccgcggccgctgcagccgccaccgcctatggtcctgacgccaggcctgggcagagccccgggcggctggaggcgcttggcggccgtcttggccggcggaaaggctcaggacccaagaaggagcggagacgcactgagagcattaacagcgcattcgcggagttgcgcgagtgcatccccaacgtgccggccgacaccaagctctccaagatcaagactctgcgcctagccaccagctacatcgcctacctgatggacgtgctggccaaggatgcacagtctggcgatcccgaggccttcaaggctgaactcaagaaggcggatggcggccgtgagagcaagcggaaaagggagctggtgagtcctggggcttgcatgctccagccaagggtgcaggagcggtgagcagcctcaggccatgcaggtagtcgaaggaggctgtgttgtcctgtgtccgatttggaaaggttgggaagagttctgagatggttggtcacagcgtgcgatcctgtgcatggagggaggcagattcgtcatagaattcatttgtaatacgggagagtgtttgtaatactgagtgaataatctgtttggagcctcggaccctccaaaaatgcacacaccacaggttttgcttccaatttggagaagtcctgattcattcctgggctctcctggaagccaggttaagaatatgtgttaaagttctttactttgagtttgaatttatgtgcccgggctcggttcctgttttcaaagggcctttgctggaccggctagtctacttccatcattgtataaatagggaaactgagggcccagagtgggtcggggcaggaaaagcacctatctgaggagtccagggtggaggtgaggtaaaacagatcgggtcttctactcagtccagggccagttctggttctccccatggactggttctgaggacgacttcagtggctttgcatgtaaataagagccacttcttttagctttggagagcgcagtctcgtcttggccttcttgatcctctccggttagggtgacacttcctggcactcggtctggctgtccggggctgggggcttctgagcgctgggttttcaggctggccaatcagtttctctaggttggggggcttaaggccgtagcggagtggagccagctgaagcgccccacctggtttatccaacctgcgggggcctgtggtaaactgacgaaagctcatccagggacgagggaaagataaataggcatcgagtctctaaacggctgccccggactggggatggtgcaggccggcttctttcgaggtgcggcgcctcgaaagaagttgttattgggcggatcccggcccccacgcgtcgccgcctccttcaagtagcaccgcttggttcctgctgaaagagcgggaaggaggacgctaggccagctcgactccccgctcttttacctccgtatctgaggctcccagctccggcttagggggccccaagcctgcatccaagccctgatgtttaaaccaggttgggaggctggcggaagtgtgtggggtgcagcgagagcgggagaaccgtggatttccacccctcccttccaatatcctgggatctcccttaggtgtcctaaagccaaatcaacgcgcgtcagtttcaccagacgcagaacattttccttaccaaacctcccgaagctgcccagcccatcccgggtcccaggaactccgcgcataaaggcaaatttacgagcctgtttgcctatttcgcaaacagaaatccgtcacttatttaaagactcccagttactgctcccgacaccttcccctcctcctcatcttaccccatgccgggcgatcggagcagaaaaattaaaacctgtctctcccgcctcttttcttctgtgtgtcctttggcagcagcagcacgaaggttttcctcctgccctgggcccagtcgagaagaggattaaaggacgcaccggctggccgcagcaagtctgggcgctggagttaaaccagtgagccgaggcccgcgccgaggacctggccaggccagccactcctgaagccccgggaggagaggaaggcagcggcgaacgccaggctctgggctccggcgactggtgctacgcatcccgcggagcttctgctgagcgccggcaggtcgtcggctgcaaccacacacttggatcgcacgtgcaatgtcctttgattttttttaatacattaagagaaagagaaatatatatatatccacccccagcccaaccgagggcggcccttggcggcaacatgcaagaaggagggactgtcgaacccaagggctcaaagacgcactcttccacccttttggagcgaatttagaacctcagccctatctccatttccctatctggctctttctctcttgtccctccatatgatccgccccgacgccgtcttctctaattaaaatgcaataaggaatcaattcttttctgcctgagaaagagaaccagacgcaggaagatgaaaggctgccctttgttcttcgaatcgtggtggttttattttatttttctttttgtcgctgcacttcctgtttagttccaagggaaacactttctctctttctctgtctctctcttttcttccttcttttccttcctttttgtttctatctaaataaaagctttccctgtgttggaaagtttttatgtatttaaactacctaccatgcctgttgtgctcaggtgtttgttcatcctgccatccccaacccttttctacctcaagtctgtgtgaccactcacagcccccctcccttcgccaaagcagtgtctatgctcttgattaataaaacattttctgaaatcatctgaagcctgtgtcatgtctcaaccggggtccctcaccgactcccatggcttctgctaggtggaaagcctctgttcctgctcctcttcttttgataaacacgaaaccaaacttgaaatcaagggaagccggcagataaagaatgtatttcaagaacaagagcaaagttctctttagactagaacgggaggtgggggtaacttatgggaacggggaagaacaaaaacggaaacgaattagtctcagagggcctgggctcgggtttttgtgcgttgagtattcgtgcttgtctggaggttagtatgcccactggtgtctgcaaagagtggtttggagtgtttattgggagggaagggggcctagcacacaggtgaatcctatccctggggcagggtagctcaggagagggggtgttggtggggaatatgttcatgtatgtgaaattctcaacatatagatgtacatgtgacagtgcagcaactcatacggagcctgaggctgtgcaggggccaacaagggtctgcttagtacagctccaagcacacagtaaggacttgacaagtcacagcagctattattattttatacctgagtaaaataagcttgtgagtgcttatatgttaaattgaggtatttaggtttctctttagcaacgaagcactcgacagaaggttgtgagagcatatggatttgtgcaaagggatggggtgtatgtgtgtatgcgtgctcattcgggcacttgtgcaggagagccagtctttgtgttctctcatgcgcacccatgactaggtgtggtgggtataaattcggtgcatttgccaaggatcttggatgcgtattgggctaaactggggcgggcaaacgcagtggtttatacttccaggaataataatgtacgaatactttggttgcgtgcaactgtgtgctaggcactgcgctaagcacttctgtgtctcccaacagctcccatggttgccccacggagcgcacgctctgcagcgcctgagggtctgcggcgctcactgcgaaggaggaggggagacccgtgaggctgtcttggaactttcgctctgcgcacctggagcctgagcgctcggcttgggaacaagaaaggagacctcaggcagctccggggcagggcctcgtggggcaccaggcgtgccccaggcgccttgtcccagcgtcggggtgaatatgggaccccattagtcttggctgtaaacaccgtagcaggggctgagaggccacgcgggcctttccggacgcgaaggagttaataaaaggtgttttatgggcgctaggaaacagtgggggaggtgtgagcttctctctctactctcgcccccctacttttttcttttttccctctcgccacccgccgccagatcaaacaggcccgcgatttaactagggcaacacttggcggtaatgagcccgtccgacgcaccccttcctcggcctcagtacccggcccgaggccccagggcccttggggaggagcagagagaaaaatcaaagtttctttcttgttgttttgtttttcttttctttaccttctttctttccgtttctttctgggagtccgtttagaaattccggcgcgcatggagaaacagactcagggagggaggtgatctaagccccacagcacggagggaagcttatctagattcgaacccaggactccaacttcgctcacacacaaacctctggctatacacaggtcccagctcccaggactatttttagcaccgtgaagtatcctaggcacgggaagaatgcgcaccctggtctagctttcttatagccggggaaagaagagggggtgctgagggagacccgccagcggccgccaaagccaagtctggcataaccaggcctcttcagaaaacccaatcctgctggccccaaaccctctttgggaagagagccttggagccctaaactcggtctcagaaacgtgcagtccctgaacccgggagccgagacggagccggcg

SEQ ID NO: 12426 - DNA, 65424 bp, Human
  misc_feature (1)...(65424): n = A,T,C or G
ctaggtgggaccatcttgttcttcagtttaagattaaactgcttgatcagtgtcataaatccttggctgactctcagcgcctctaagacagcttcattattatccattcagggtgaattccatgaacttaacttttatttttaaaatacaaaccaccatgcctcctatggtcactttgcatgttctccataatatcacgctgaatgtacacataatattgtgctttttggtagctctgcggtcataagaaaatcggatgtgtcagccagtgccttctgggtcctggctccgttttcccgtgtaggcttttccctggctccacttgtgagcccgctggtgcctcgccgggtgcagctcactcctccctccagcgttgaattcccttggacagaggctgtgggcttgtggcgctgggatcagtaaaagcagaggaaagctagatccagccaggtttaagtggagatctcctttgttgaacttgatgtcactttaaaagttcactttcatcagctccctgctccgtccactctccctactccacacaaaaagctggattgatattcttgtgaagagccaagtcctgctttaggaaaaccaacttgtttcttctttatgtgactatatttttgtccatgtgaattttccttaatgtagtctggcaagatcagaaaaataattagttacaccagagtcacttaacctttccttttcttatttgcatttaaattaatttttatgtggataaaagctcttcctgtgtatatttttcatttctctggtgtcttgtctcatgttccttaaaacttggaggcaaaggacttcatcgtagcaagtttccaaaggaaaagcgggaagcaaacaggaagatgaggtttcatattaggtcaccaggtatctagagcagctgactttgtgacgaggattcgtggtttgcagtttgcagggtaattgcaacaaaaatattctgcacctttgtggttagaacaaaattctttcaagttcatggacagcattaggcttttgaagtctgccggaaccagtagctgccactgggttttaaggaccaggagacttctctccccaaaagtgaggtttcttcttcctcccacagagggagaccgggggccctgcccaagcagtgccccaggggcaagaggatttgggagagaacaaagtgagccagtaaacatgccccatgaccctgacctgtaccccattagtccttcaaacgaaggtgccattcaaatgagagagacctcagccatggaaagcagcacactggctgcccaacttcaggtccctgctgcctccttctccccaaacgttcctttgacagtccctacatcttatgtgattttccagctgtttgatatttccagattagtaaatgtcctttaaaggaagagttttgtttaattataaagtctttttagactaattatgtggcaaatatcagcctccttccctgccatacccaacaacagccttgaattcaattccaaagaaacaaatttaacttcagtacgttgcatggcaaacatttgagtgttcatacattttgatttcaagtttaaaacacacttggctgaagcccacagaagcaggggctacttgggagaggaccgtcccaggcttgaaggcagcccctgcctcgcctctggttccttgtgccttgatttgcagctcccttggttaagcctttatggtcctgggaagtttctactaggcagagaaagcatttctgtaaaggttttcttttttaaaacaaaacgagtctctgtgtgcaccacatccatttctggcatctcagggctcactattcagaatggccagttcccattccctgaaaagggaaggggctctttgctccagagcatgctggttcattcataccccgtccagaaagagccaccagcttcaggtgaagtcaccattccaggcaaaagtaaaaataaaatttcagttccaaaaaacgccttcagcctatcaaaatctaagtttcgacttaccaatatctattaatattttagaagcagatttttttatacaaatatatgggcatggaggcaaggatatatgaaataattccttttactgtttttctgtagaattaccttcttattaccttgactttgatcatcgcttttatgttaatttattgccccatccgtggtttccagatgtcagcctgggcaacggctataacagtttgccttctgttccataaggcagatgaaattggagctactcagattttggaaacagctgttccttatcattgagagacagttcagcagttttaccttttcatgagtcatcagttactgggcctaggaaatgtatttccatcttgtgtcattgaccccatatcttcaaaagatgacacaactgaaatagcttcatgtagttcttctaggcttatttcaagagtctgcttaaaaggttgtctgacactctgatcattaaaccccagtgtgatctttctaagaatgcctcaggctctctcatttagaaagacttagtgcaactcattcatttgaatgagttaattcttgctcaatgcaaagatcccacaaaccttgggggctaggctgaggtccagccgctaaactctgcaattcctcactctcctgttcatacacacacagacacaaccctcctcacctccctgacctgcccctgccaaaaaatatgagtcatccgtcagtgtctcggggagttgagtggggagctatctcagatgctgagtcatgattttcagagaagatctgaacagattgctgtggttttaaattgctgaattgtagagagcatctagattgttattttcagtattaaagatgggggtcaggtttagaatccagcaagtgaaaagctgtccttactctgcacttctgatctagaactcagcctgcactgaagggactatcttgtgtttcttcttttctccactgtgtgaaatcataacaagaaacaacctctgagcataagatcagcttctagtatttaggggaagaaaatgcacattcctaaagtggtatgacaccaagctaccctacattgaaaagcagcctacttttccagcctgatctaaagcaaatcccaaaatagcatgggcttgatttattaaacctctgtcctgtgcagaggctgccccacgcctgaccccactgtcctccgaactcctgctgcagccgtaccctccagccctcagtggagcaggatgtgggtacaggcctgagccctgtgctgtttgctcttcttgtttgcgggtcgcatgtcttgagccagcctgtgacactcttgtctctgtatcccccagactgttcagtccacttccacataaactcaggaaatagcaattattgccagataatcagtgagctgtctgaaatcatgaaccaaggccagacccagatcccagggtttttgtgaaccctaatccaccaccgtacacttaacaccaggcagtcttagtatgccctgggccagatttcctctgtgacagcttcttgatttgtcttgtgaagcccagaatatgtactgggctcctgtgtcttcgagggaagacaggttggggagcaagatgtgttgtttatagagcccgagagccacctgcaaattccagtgcagctcatggctgcatgttaccctgtggccttcacgtagggcctgtagtgacagccactacatgcgtgggctccaggctgtcaccaaacctttacaacacgtagtaaataagtctagggtccacaactgctggggaaggccttaaacaaatctcaagtcttcaggatttccgtagcatttacatcttggtaaattgaattccataatagacttttcctttgctcaaatatgcaatgttttgagtaattccccatttatttttcattttagaaacttcgtgaatactttcattcaatttaagaagcccattattgtagcagtcaatggcccagccattggtctaggagcatctatattgcctctttgcgatgtggtttgggctaatgaaaaggcttggtttcaaacaccctataccaccttcggacagagtccagatggctgttctaccgttatgtttcccaagataatgggaggagcatctgtgagtacctttttaaaaaaaaaaaaaaaaagtcattctagaaagcttcctgaagaaatctagtttggttattgtttttctaaagctgtacagtgtgtcattctgtggggactttccatcttgtaattcagatttgggttcatagacgttgttgacctttgttgcatcattccctagagaaggacttcattcactgaggagcctaccactttgcataattcacatggatatctactgttagtaaatacccaatcagtaacccaaccaacaatttgcaattgaaaagttcttcacctaataacttaaaagctgcacttttaagagaaggcaattttaagagggagcaaagttacataggattagagggttgtcgtccatataattgtgtgtttttatttctttaactgtttaatccgttcattatagtagtttgtgtttgtattgtagcttgtgatttatcaagcagttattcacatctcattctctagtccttgaaatagggcaggaggtggtgtcacaggtcaggttctccagaagcagacactgagatgagtttggcacgtggagaattagcaggtagtcagtacctgtggaagggatgggaaggaagcaggaccgcacagaggaagaggtcaaagtgatactatgcccatcatccttaggggtgggatgtgcgggaagcgttgcaccctggacgaggtggctccctacagctgagggcatccctaaaggcgccctgtggccgtctgctaacagcagcacccgcagccaggcagccaggcctccccaggagcgatcatggcagcacagttccatgtccaccacagttcaccccagggccattcagatcattgatgcaccttttgggggccagctccttcaggttccaaggggctttctttctgggagaaacttagaggaagaagattaggcagcaataacttgcaggccagaacctgaaatgtttaacctggatgttataatcagtgggtaaaagtgtgatgagaaaaaggatatttggatcctctcattatttgcagtgggaaaaatagtaactttacagtaaagaaacctggcagctaccaccttgccgagtggtcagagttcacagaaataagacaaaagccaacatgaagcactgaggggaacacagccttcgtcgctgcgtgggatttctcctgaaggtgcagcagctcagtctcatcatgaggaacgtcaggcccagactggggggcagtctgcagacacccgcagtgctccaccaaagcgccaaggtcggagaagacgtggaaagactgaggaaccgtctcagactggaggagaccaaggggacacgacagctcagaacatcagggacccaggatgggctcctgggccagagaaaggacaagagtgggaaggctggtgaaattcacatcatgtttgtagttgagtgactagcacattgtcagtggctttggtcatcttaagatgttatgtgacattttttaacctagggagagctgcctgaaggtttatgggaactctgtactacttttatcatcttcctgcatctaaacgtacttgaaaaccagaacgtttaaaataaaggaatacaagagaggaggaggaaggtgactaggccagactgtgtcccccagtgccgcactggtctcagagctgccctgctcctcaccttctcacaccccagggtagttcccctcacccatagctcccacctctgctggcttcagcagccgcccaaatgctaaaacactcacccccaagggatctgtggcctgctcactgtgcccagctcagagttgctgcacttgtccacttaactgctatagttgatcaggagaggaacaagcggcaccggcctgcatcccatttcccaggccacgtgtccttccagatagaggtctttgtactgtatgtgctacaaatcagaaaacgctgctgcccaccatcatggagccacctccaaactggcacctctcaggccgtgccgacgccctaccaggctggcggctgtggcaggtgctatatgtgacttagccacaggactctcgggtcctgtcccctgacatggtctttgctgtgaggctggtgttctggtcacaacgcaccaccctgaggcaccccatgctggtggactagaccttccatagccacagagagtgatgctgcctgaggatctgcaggtgggacaggcagactcagacccagaggatatgcccatgcctgttggagccgtcagcgtgctgcccagcgcccacaggcgggcctccctgggaatggtgtcttgtgggccgatcacattggcatctcctgctggcaggctggacactcagtagcaacagcgactgcatcagcctttggtaagtcagagactgtgctgttgaggcccctctggccagccctgggtggccagcgaccaccagccatctctcaaagctgttcagtgccccctccatggcggatgctctcaggtggacattaatgtgagacagcaacctgcacgcttcccattcctccacccaccacacgcctctgtccaggacacccacccctgctggcagctagtgttattctaaccttgatccacttttttttctacaccagggggtgaccaggtgcatctgcccccagtgggggcattttcctcaccacattctctttgaggcctgctggatgaggctctggtgaagttgctgtcccctttttggcttgcccatccacccagtgagccaacccacccacaggccacactcggtcacagggagtccccccatggctgtaggtatgagctgaggcagggcgcaggtactcaagggtctgggggtgacgcaggggtctaggctgccggcccatgccctctggagcttgccaagcccagctgtgcatctgccgcgggccctgcctgaccttgcgcctgtggggctgatggaactcagctcgtggtggtcactccccacatgtggtcatgtggggtcccgtggtcgggcgctttgcctctcccagtcccagccagcactccaggcatgcccttccctgctgtggatggccccaccggctgtgctgccctcctccctctggcactgaccacaggctccatatgcatcttgtcccacccctccctactcagccctggcctttcagcctcactcagcagggcccccacctccctcgtgcttccagtagccatcccagcagccaggtcagaccatctcctgggaacctagcagggccaaatcagtatcgcaggagagcccccacgtcagtgaatctcctgtccagcttgtggttgggccccaggtcaggcgccctgagaatccaggccctcgtgttttctcacagctcccacctgcacccttggctgggtcgtgcagcccgtttcagggaagaggcgagttacaggcctgacgccaggagaggggatggggcaggttttggggggcagtgttgccttgctgagagatatttgccttatcttctagcaaggggggcttacgtgttctgatagggatgggtgggccatgtccgtaggctcgggatcagaggaagctggacttcagagttgggggcattcacccagaagcgcctataccaagttctagggtacctccccacccctcacaagctgacagaccctcctccagtggctgattaacctgggtggagcttgtccactcttgctgacaagtccaggggctaaggccaagtctcagccctctctgcctcttgctcccggctgcccctctgcttgcacccatgtccctgcccctcacctgtgagagtgttagcacgtggacggctgcctgtgccaggtactgtggcttctccacctggcctgttggggggtggtccctcattgccagctggggagccgtgcagtttctaaacctctctcttcaccctcggtctgtccactcccctcgtcacaaggtggtttctctggaagctaagatagatttgggaagcagggtctggtagattaggtgccagcgtccatggaagggcagaaaggaagcaggattgggcagagctgactgacagggagctctggaaccacgtggcctcacggcggttcccggtgccccactgcagttggccgtggggttggcggccctgggaagagcggtccatgggggaggccctgagctctctgttgcctgctgacagcacttcccacagcaggcagtttgctggggtggggacgtgggtggcttatccaagtcatttgctttgtcctttacaccgtactgcacgcacctgacaccaccagactcccatggtagagtcattatcagtaaaatcagttcatcgtagtgattactgtaaacgagactgtgtcctgccagttaaccctgtcccggcaggaaagaatcctcatcgtctggaacatcccgtgaatctcattttgagttatttatccaaaggaggttgagatctgaggttctgacccctcccactgtatgatctatgtagatgtgtggtgtcggtgcagatgtggggcaaatactaaaccaccttgatgttcagacacattttggccaaagacattttggaagtggagccctggagctgaatgctgctcaggggtagaggtgtcagagttcaccattcccagaaagggccgtgaggcttgaagtcatcacaggacgaatgcctgccctctggtcagccgtgtttctccctactctacaagccttggcagatctttactttacgcttcccctggagatgtactggtgcctcttgagctgctgctttcaactgggcagttttcacccccgacctcacccctggggaacaatgtctggagacaacttggttgtcacacatgaggagatggccgttagcagaggctggggtactgctcggcaccctccatagcccacgggacagccctgctcagcaccctgcatgtagcccccacaggacagcccccacaccaaacaacagtccagcccagaatgtccctagtgtccagggggagaaaccctgctctaactcaagagcgaagagcctgcatttcactcggcgtgaattctacactttctgagcagagtatctgacgaagcctctctacagaaagtgaataaacgttgttcagatgacttcgacaactcttgttgaaagtgactatgcagatgatgtaaatgatgtcgttcctttcatgagcctttggtgtacttgagctttcagcagcctgaggcaagactggacaagtgtggttttccccactttgcatgtgcagagctctgccaggaggataagctaaaggaatcacattatcaagataaaaagaatatgcaaatagtgcaggctgtgtggcctctcctttcttacagcaggccctccgctgtaggcgagggctacgtaaatcagccaaggagtctcttccagtttagccttcctggtgcccagtagacattcatggagtgcatggaggatggcacggtctgacgcccacaggctcccacgtggaaatcttgcacctctcaggggcctgctggggtgtgaagctggagaatgcccagcgagtacctgagggccttaccccacgctcacaccttgagagccctctcttggggacttcagagactggcctgagggagcaggtggtaaaacctctgccacagcagtccccataaggctgaagattcctggatcccctctgctcatactgggccagtttcctcgccacccgtcctgctgtactctggccaaactaaaaagacatctctatttaactttcctcggcatttcccatctctctggatggttccaggataactttcttttaatagttggacaactttgaccacatcatggggtgatgtaggttgtctacagggagtccctgtgcactcagccatctcagagcaacgtgctagctggtcaggttcccaccgcctgcatctgtgtgaatcggttatttgggtagaagtttgaaacctctcattttgaaactactgaaaatagtgtgtttatataagaatatgctcacgcaaattgcgtgtatttaatcctataatacatatcttaccaagggagatttgttgttgttgttttcttgggtgactgtcgttcaaaccaactcactggccgtgtttaagtgaaaaagctttaacaacctagcgtgagccctgtcatttttgctcttgagtaaattgagaaatgcccttgcttgtcctgcacatccaaccacctggaatggagaacaccgaaggtagggaaaggatctccagggatgagcaggcctggagccggcggggctgcggaggaagaccggccgcaatgagtgagtgctgagcagagagaagggccgttctcggctggtatcaggcccaagagagtcaacaaaggggggacgaaagggagacagggaagagaacagtggtggggctgtaagttgacctccaggtggcagaaaataaagttggaagaattgactgggacagacagccagggccctgcaggaagggcgggagaggaagcctgcggacacctgccctttgtgattgaaccgcagacaccaggcctggcggggtcgcttgcctccgctgcccaagctaaggctccgctaagctggtcctgagaacatacttcatgctcaacttcagggatgtggctgtagtgtcctcactctatgctgagaatgaaagaagcacagtctatgaaaggaaaaccccgacagcacagagcacttcgtgcggcagcagcacaccgggagtcccactccctttcctgctgcgtttggatctgccgtgacaaggactatcagaaccactcacagtaaggtcgggtcgcgtttctaaatccactgtttatggaccgtcttttcactgagaagaagctcgtcagttcaggggtttctagaacttctccagactcttcaaaaactcatgactttctccaagttggtaatcccagcactttgggaggcccaggcgggcggatcacgaggtcaggagatcgagaccatcctggctaacacagtgaaaccccgtctctaccaaaaaatacaaaaaaaaattagccgggcgtggtggcgggcgcctgtagtcccagctactcacgaggctgaggcaggagaatggtgtgagcctgggaggcggagcttgcagtgagccgatattgcaccactgcactccagcctgggcgacagaaggagactccgtctcaaaaaaaaaaaaaaaaaacttgcaaaccctcatgaggagcctgtccccagccctgttttccagcctctgcctgcatgggaggggcagtgagtcagccacgtgtttgctttgccgcctctgcctgtgtgctctccaagctgcgggtttcacatgcagtaaacggcatcaagacattgacagaaggtgtatgggcagtcttacactgtctcagcgacttcagggccaaaactgtcttttgtgattttgcctcttttggaaatggaagccacctaccgaaattgtgttttaccagagccccaggagctcatagtcaaggctttgtgacatcagagttgttaggaaggttaaccgggcaagataaacgacagaccaaaaattgtcccctcaggccagtgtggagtttctttatcagacatgtgtgcaccccttcccgccttatctcggcatctgtgagcctgtcatttgaatgatgtaaaatccatacatgttgtactgagaccttaaaagtgatctagttcagtgtcatgtattaaaaaataaagtgatctagaatccaggacaaggttaaaattaatttcatatatacacatatatattcttttaaagaaaacctaatgttagctttctccactgagccgtgtgaggtgactgtagccagcccctcaagcagattacggtcatttttcgccacattcaagccctggatagttctgtcttttcgtatccaagcgatacaaggcagcctccaaggtacgctctagcagaaacggtcgctgccattagaatattttttctgtatattaaaaacaagtcaccattggcctcccagataaagaaaaggtttggtaggaattctgtgcctggttcaaatccttaaaattataaattgcctaactttgcatatgctgattttcccaggattgttttgtgtattaaaagagctcacacgtgggaagggccggcattagggggaggaaggcagatgggaggagaggaagctataccagtaactttttaaacgaatggcaaaaagaccttttctattttagatttctttattgagtccctgtaattctgtagtaggttgtaaaataagacactttttgctttcctttttaagaaaaaaatcatcagcccgatagattactttcccacctgcccaatggactgcaccttgcacagggtctgttcccagcggcccctagaggatgtgccccatttccctgcggggctggtatttgtgaatgtctcccttcggtgtggattttaagggatgggtcttccccgcccgcctcccaccgcaattcatattacatccactcttcttccttgcaggcaaacgagatgctgctcagtggacggaagctgacagcgcaggaggcgtgtggcaagggcctggtctcccaggtgttttggcccgggacgttcactcaggaagtgatggttcgcattaaggagcttgcctcgtgcaatccagttgtatgtctaattgcttctgttacacgttactttttaaaaaatagaaacttttccctcagagagctcacaaatttgcaattattcctaagtcctttacgtttgtcctcaacagagcaccttcccgtgaagtcctgccagaacctattgccgccactgcccccacgcacgccttgccttccctttgcaaatacccaggaaccacagaaatggacttcagtctgaaatgtcagcaagttagcaaatgtcctatgaaagtcaacaacaactaacatggatataattctttactggttccaaagcctttcagtcacattattagcttctcccccgtttccccacagtgggcctaagttgtttttgggttgttgttgtttgtgagatggagtctcactctgtcgctcaggcttgagtgcagtggtggaatcttggctcactgcaacctcaacctcccgggttcaagtgatgcttgtgcttcagcctcccgagtagctgggactacaggcatgcgccaccatgcctgggttatttttgtattttcagtagacacggagtctcaccacgttggccaggctggtctcgaactcctgacctcaagttgatccacccacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccaacatggcaaaaccccgtctgtactaaaaatccaaaagttagccaggcttggtggtgcacgcctgtaatcccaactactcgagaggctgaggtgagagaatcgcttgaacccgggaggcggagattgcagtgagcggagatcccgccactgctgtccagcctgggcaacaaagcaagaccctgtgtcaaaaaaaaaaccacaaataatttttttttaaaatatgcttgtaacaaaattgcatttggcaaattataggatgtgaaatgtataatattaactgacacgactcccatcccaggcagacaagcaaccctcattatgaaaattacattttgtttagaaaaattccctcaacaggcatccccagagctttctgggcatcagcagagcagacgtccagttcgggggtccacgccagtatgcggcagtggcgcggggccgaggctgctcacaggctgggtgccgacagcccagctctcctttgaaataagccgttttgaagttaagaatgcacccagtgccaagtgtgaaatgtgctttatacatatgttaggcccgacatattgtgagaaaatgtctggtaacctttttaacaggtgattgctggaatttgatgattgcctccgtaaatgtggaggcacaggggacccgtgtctgcccgcatgcaccctgctaactggctgcttgttttccggtgcaggtgcttgaggaatccaaagccctcgtgcgctgcaacatgaagatggagctggagcaggccaacgagagggagtgtgaggtgctgaagaaaatctggggctcggcccaggggatggactccatgttaaagtacttgcagaggaagatcgatgagttctgagtgtcgggctgcccactggtgacaccgggatcgggctgagcaggagaacatcaccggctccagttcccctgatccattctcacagcctgaaacaagctcacccgtagcttacgcttggaagcaggactgggaacatccacgctatttattatcgaggagttttaaagtactgtaactttaaaataaataactacaaagcttctttgtccaaacgtcattattttatacttatatacacgcaggtgtaaaagtataaaggtgagcactagactgctcttagaagctctaatttttgttttctttggctagtactgtataaaaaacagaattgtgttttattggttttggatgacagaaaagtctggaataatgtttgttttcctcatttcttccttctagaacacagaatctaaaggggtattagccagcctcgcctccctgccccacgtagagacacagagtgatgtgaggcgttggctttttctccaagaaggtacagatacctcagattcgggaaactcaaaatcaaaagacttagcttctaggataaatacttctgatgaaaaatccgctgaggagcataccccaaaccagacatatgcttaggattcatgctgagatatcaattggtttccccttctttttaaaatacgtccagttcttacccagttaacatgaagaaaccactgtctctagaagaaagcttgttttgcagtattagtgaatcactgaatagcttaagtatgactatctaagttataagttagtctttagtgggttttaaatagtttttctgacccttctgaaaaataactacataagtgcttcttgttgctgggtgagaaatactactttatagacagttttggttttctgtttgcagatatgattgatgtatttcaccaaaataaaatatttttatgtttataaagtgtaatttttaggttcacttagaatatattttatttaataagttaaaattcttttggcacactattaaatgcaaaaactcctttcaaaacaaaaaagaactaccttatattcaacatttaatgttcttggcctctgcttttatgtctatacaatatactgagttcagtatggtgtccaagagtgccctgtgtggatagacatgtgcactccttccaggagtgggtactgattccagactccagatgcctattattagttaggcttctgagcttgcaatcatattgaatgtatgaagagcgaaatcaaattcttatttttgtacagttttgaagtttatacttagaactgaccacctccccggccacgcggagagctgtacagtgtgtaaatctgcctttatcttggattgattggtacagtatttttgcatctgtgggacctaccttttcgttcagtagtttgaactatatataaactgtacaatctgtaaagtttttatagaataaatattcagctgtgaaaactggttaaataaaactaatatttcttaacacatttgaaatgtttctctgattcttgtgagatttctcatgggatgttttctctttcgtgtgtgtgtgagatatacatgtgtgtataaagcatctgtacagttcaatggaatgaaaccctgtgtgactaacacctaggtaggacctaacaatttgaccagtatcctccctggtcaccttcacccgggtgaccatttcctcactttgtgtccatcatccacttctccttcaaagaacttattcctaaaataaattacttttagttctacatgtttttaacctttatatcatatcacaaataagcttctgtgactgactgacttcattcactgttaagttttctcttacgtagagttgtaacttactccttctttacccaaacctgtcgtggctgttttcactcctgttttacagatgaggaacctgaagaattaaacacttgcccaacgtcatgtaggtaatttgaacaggagtagcatgaagcttttacccaaggtcgatgtggcaaagcacatattctggcaaagacaccaagatgtcagtgttgtagaattcacaaatagggaactgagtaaaatctccaagttgtctgtctgcatcatccgagactttgaatcctctgggccttgtgagccacctcccctttttctgaagcaaaccttccaccttccaacttcttgcacaagaattgatcccaactagaagtagcactggcgacagcagtgaagtgcttctgttttgtgccctgcgtgggtgaggaggaagggaaatgcgactgctcaggtgggtgaaagtctcggtccaacttttgaagagaatttgacagtaactgtcaaatataaaaagcctggacccagcaactccatcaataaggattcatcttaaggaatgagtggtcataggaaatacaacaataaagataggtacgcagttaagttcatctcaggattgttcctgacagtgaagcattggaaactgcattcatgttcctcagtagggttttggttaaataattgtgcaacaccatcacagtggaatacacatttattgaaaaagaatgttgatgaaatcttaggtttaaagaaaattgtatgctttaaaaaactttaaaggatatgcatgaaaaacatcttgtatatatccagttctctcccctagagcttcccagctcctgggcttaagactgctcagcccctcaaagccaaagtcgggagcctgttacccctgagagccagagacaggcacaacagccaggcagccttgcttcctcgaccatgagggtaacagtgatgatggcacttaacactgcagcataaaccaggctcgcttcgaaacacttgatgtccgtttgctcattcagttttttgagattattttgcagagaatattaatgtaatacacattaatatgcttttcccagatccactcactgagcccatctggtggcctgtctgtactgacctctcctgtaaccaactttccccagctcgtggccttcctgtcctagcatcactctataaaatgagaggtctcaaatagtctttaggcaggctgatttagtttgtgatgtccccagcaatactagtgacagctacagaaatgagaagaacccagaactctgacgatcttggagggaaaagtgtgccaactacgtaaacgggactgtagatggcctcagacgggctgctcccattctctcgccccatatttggtcaagagggagtgaggggtgcccccagtctctgggcacagcaggagcctagggggctagggccagcctcatggccaactccctctcattgggctcctcagaggctccaacccactggtacacttcttcttacactagtatgaacaagcgttacagcttctccaaaagaaaatcaagttctctcccctagaggtaaatataaatatttataaatattctaaaagaagaaaatatattttctgtgtgttgcaagagaattggcacctgccaaatagtgacacacagcttaagagggaaaaaccctggggacacaggattctgtcattgccctagggaaactcagtctctgcttttcccaggtccgctcactgagccatctggtggcctctctgtgctgacctctcctgtaaccaactttccccagtgcatggccttcctgtcctagcatgcagacaggagctttctgaggcttttccgacaacagccccaggttcatgccccaccaagtgtgagaagctgtttctaagccgaaacttttcaaatggactccaggacatgccagggagtcccgccctctagaggaagggagagactcgggcaggtgaaagcacagataactgggaatatgagaccctggagtacagcccagaactaaggaggagaggagatctccgatgtttcgtgcacccgtttaactttacatgtgaagaaactgaggcccagaagggtcaggccacttgcccaccatcacacagcctgttggtgacctagcacctgggaagagagggctacactccactgctctatgcactcttcccttaagtgggaaggcaaggaggggaccaatggcctgtggtgtccagcccatcctggcatcccatgggcctgtgattctctgcaagtgagagtggtggggcagcatggcagaacgggtggttccagcctgcccagtggctctggatttaggctattttcaagtcaacgctaaacttaccagggaattctgatggtctacaagctttctgcatctgtaagagctggaccagcccaccgagctctctcaatactaactagcatttaaaaataaataccttcactatttggcaacaggggaatcctctcctatcacaggaatcctctccctcttccctagggaacgttctgacagcatgtctgtctgaagaagcaaacgaatgtctgctttggtgaaaatgacattgaatgatttcaaccctggtttaaaacttacttttttggcaagataagagactagcatttcaaaatttaaaatctgttttatgacctttagagtcacaagcacttaaatggctaataaatggtttaatacaggtattagaataaaagctaagatctaatgtatttaacattaattcttattttcttaaattttatatactaaaactgggtaaattatatacatatatatgtctatcacctgtatgaaacacactgcataggacaactagacagaggatcaacaaggaaatagaagactggaacaacattttaaaccacctagacgtaacacacctatacaacccttcatccaataacagcagagggcatatgcttctcaagtgcacctgggacattctcgaggatagaccatatgttaggcaataaaacaagtcttaaaagtttaaaatgattaaaatcatacaaagtatgtcctccagcctcaatggaatgcaatgagatatcaataacaaagaaatgtggagaattcaaaaatatgcggaaattaaaccacattcctaaataacaaatgggtcaaacaagaaaccacaagagaaattagaaaatactttgagatgaatgaagatgaagacacaacataaccaaatttatgtaataaattatataataaaacatctatatgagaaaagtagatgccaaatcaataacctaatcttctaccttaagaaactagaaataaagaaccgcaaactaaacccatagcaagtagaaggaaagaaatgaagattagggcaggagtaagtaaaatgaagtacagaaaaacagtagagaaaaatctatgaaacctaaagtcatttctttgaaaagatcaacaaaattgacaaattttagttagactgaccaaggacataagagactattcaaatcaccgaaatcagaaatgaaaaggggggacactactaccaaccttagagaaataaaaagaactataagagagtgctgaggaatcgtatcccaacaaattagattagctaaatgaaatggacaaattcctagaaagacacaaacttgaaattgactcaagaagaaagaaaaaactaaaatagacaaaaagattgaatctgctgtcaaaaaactttctacgaagaaaagcccagcactagatggcttcactcataaattctgtcaaatgtttaaaaaggaatcaatgccaatccttcacaaactcttccacaaaataagaggagtgaatgcttccttacctctataaggctagtgttgccctaataccaaaaccagacaaagacatcacaaggaaactatagaccatatagactatatatttatgttaacattccttattaatacaaatgcagatattctcaatgaagtaatctgacaacatataaaacttatatgtacaccattaccaagtaggttgtggtgaactgcaaatgtgccactgcactctagcctgggtgacagggcaagaccctgtcacaaaaaaaaaaaaaaaaaaaaaagatgctcaatgtcagccactatggaaatgcaaatcaaactacagtaagacatcactttatcccactagaatgactataacaagaaaataccaaaaactgaactaatacgttcagttataataacaataacaaatgttgatgaacatgtgaaaaaattgaaatcctcacacatttgctggtgaaaatgtcaattggtacagccacagtagaaaactgcttgatagttctcaaactggcataaggatgaagttaaacttcttaaggaactcttaagccttgcaattctacgtctagtatatatccaagagaattaaagataggtactcaaatacttgtatgtgaatgttcatagcagcattattcataatagccaccaaatattcaccaactggagaaaggataaacaatgaattggcatatccaatggaatgttatctggcaatacagatgaatgaatgaggtattgatacatgctacagtgtggttgaaccttgaaaacattacgctaagtgaaagaagccagatgcaaaaggccacatattgtatgattccatttatataaaatgccaaggattggtaaatccatagaaacagaaaatagattcgtggtttccagggacagggggtgacatggggcaaccggagtggggagcggcaggtacaggtttttatttggggggtatgaaaatgttctggaattaaataatggtaatgttcacacaaccttgtaaatatcctttaaaaattgaattgtttgcctcttaaaatggttaattttatgttgtttcaattatgtctcaattttttgaacgtgtgtgtatattatatatataatcctctaaactaacataaggagactatggaaaaatacttaactgatccgaaatgtgcaagaaagatgtgaaaaagcaacatagactggcaggacaaataatggcacatagaaaatatggtatattttatctcaaaatattaacaaacacattaaataaaaatagactaaattcttgtgtgaaagctaaatattttcaggctgtattcaaaatatattgacctagatatacatatatgctgttgacaagaaaagaaaacgcatcggaaactgaaaagttgaacgtaaaaaggtagaaaatatatactgtgcaaacaataaccaaacaaaaactggtgtagctatgctaatatcaaaatatctattaaagcaaaaagcatggtaggaaaaagtttttcataatgacagcagactaagttctattgaaagatatatagttctaaatttgcgtgtaccttgttacttatcctcagagaagaagaagaaaaggaagaacaagaagggaggagaaggaggagaaggagaaggaggaggaggaggagaaggaggagaaggaggagaaggagaaggagaaggagagaaggagaaggaagtgcgttcagcagcttctaaactggctcccagtgatcccgacctcttgctcttcacatctgtgtatgatgtacggctagacctggtgactcgcttctaacaaacagaacatggcaaaagcagtcacttctgaaatctggctgtaaaagactgtgacttgtggctggtgcacacatgttctctttttgcctcctctggctggcttactatgggagagtccagctgccatgctgggaagtacccataggacaggcccatgagccaagggaccgagggcgacctcccaccaacatccagtgaggagctgagtcctgccagtgcccacaggagcgggcttgagagagaatcctttcccagtccagcctggttcaccctttaaaccgcagccctggagagacctctagacagaggatctggctaagctacatctggattttttgttccagaaagtgtgagtttgggggtaatttgctattcaacagtagacgactaatacaaccagggtggtcattctcacagctcacttttgataaatatacagatagatagatagatagatagatagatagatagatagatagatagagataaatacaaacagacattgatatagatggggtctcagacaaaattttcatcttcacgtcctgtaacagcttgctaaaatagtctattctctgcatttaaatgtccctttatgtgggattggatgtacaaatgatcttatgcccatactgtgcaactctttaagagaacatgtagcaatgatggtgatgaatatttattactgtcttagatgagaattacaatcagccctatttttcaaatgagaactctgagaccaaaagaggttatataatttacgtaaggtcaccccccccagtaagggctggaacagagatttcatagcaaccaaaccacacccaagaacagcattctctcctttttcatcctttgcgctctatagaccccagggtaatggtgtgtcgtgggctcttggcctttctctgtctttctttcttttttttttttttttttttgagacagagtctcgctctgtcacccaggctggagtgcagtggcgcgatctcggctcactacaagctctgcctcccgggttcatgccattctcctgcctcagcctcctgagcagttaggactacaggcgcccaccaccacgcccagctaattttttgtatttttagtagagacggggtttcaccgtgttagccaggatggtctcgatctcctgatctcgtgatccacccgcctcggcctcccaaagtgctgggattacaggcatgagccaccacgcccagcctgggctttctctttctatgacaataagtaaatgtgacatttcttgccccttgaattttagaagcaatttgtagacttgtcatatgtatgttattataggtatttttgctagccacgctgtcactgtcaagctcctgggtgaaataaaattaggtaagtttttagacaaagccttggtatataaacttttgctactcactgtcttaaactcaggaatgcaattcatttggaatgtgtgccatcactcctgatgcaagcttggtgcctgacactcattatccccagcaggaacttcttggtgatttccacggtgagggacagtcatgtcagcacagaaaagacaccaaactttcggtttgatcatcactaattacctctagtgggtgtgattatgagaaacttttacttttcaaataaattggggaaatgttttcattgttacaagcatgtttacatgactaattcttacaaaatatacctatagatagatgcttcttgtccctgtctcaagcttccccaagggggttttgcctgaatatatggaaactgatgccctcggagatatgaacatcagctctgtttcccttcttcctatttaaagatctgggctgggcacggtggctcatgcctgtaatcccagcactttgggaagccaaggcaggaggatcacttgaggccaagagttcaagagcagtctgggcaacagagtaagacccccatctctaccaaaaataaaaaatagaaataaattagccagacgtggtggtgcatgcctgcagttccagctactcaggaggccgaggtgggtagattgcttgagtctgggaggtcaaggctgcagtgagctgtgatcacaccactgcaattcagcctgggcgacagagcgagaccgtgcccaccccaccaaaaaaagatctgagttcacccgagggaggcctctggcttgctggctggacgttccccgttttagaggtgtccacccacatgtcacaagagctttttaggttttactatgaagcagcaaacagtttcctccccaggccctcggtcactcagggtccatagccgggtgtttccttttttttttttttttgagatggagtctcgctctgttgccccggctgcagtgcagtggcatgatctcagctcactgcaagctccgcctcccggtttcacgccattctcctgtctcagcctccccagaagctgggactacaggcgcccaccaccacacctggctcattttttgtatttttagtagagacggggtttcaccatgttagccaggatggtctcgaactcctgaccttgtgatccgcccgcctcggcctcccagagtgctgggattacaggcgtgagccaccgcgccccattgccaggtgtttctaagagtggggggtgggaacctttccaacgttttgctttggggctcagctttactgctcttctctcttcttcctctggagctggcgctcagagctggtgagagccctgtgctgatgaggtgtggtcctagtttgaggaaccatcgcaccccagcagccccgattcccaccgaagaccttggttggccaccagcagcaacgattgatcagcagagagcccatgagaggcagaatgaacgcaccaggaccagtgggcctcctggagaaggctgctcaggtcagcagtcggctactgtcgtttggtaaaaggaaagataatctgttgatttttatgccttgctgtaaatgtttgctggtagcaatctgttagtgtgacagtcaccactgttttttatttttctgtatcactagagatgttctctggagctttaaagcctcctgcagtgagaaactattacataaacacactgtttggagaggagaaaattccctataattcttgttctctagaggtgtgtggtgatcatcagaaccacaatcctcagctccgtcctgggggccccaaatacggttcattcccttggtgtgttaacccccgaacccctcattctccgtttttaattttcccctgaagaaggaaagaagacattcccaatgcctgtgaggacagggctcctggggtgagcctgccgattgtgaagtttaagccacaagctcagtgatcgtcggggttgtaagggtggtgaggatgagacagatgcagattcaagagtctgccctgctctgtgcacctggcagttctctccttggctcgggccttcccagatcctggaatactgaactttaagtggtatcacagtcacactgcagccacagagtcaggccgtctcagtgttggtttgtctgtcttgtgacaagggcacaaaagatccatgactcctgcaagcggggaggtttgccgagagagaggtgcgcactgcacgattaaagtgtaacctgaaccactgccctgcagactgtgtcagagctcgcgtgtgtgtgcctgtgggggtgtgtgtgtaggtgcgcacgtggagtgtatgtgtgtgagcacatgcatgtgtgctggggggatgttaacagcttcactgaggggtaattgacatacgatcacactgtgttcaaagtgtagaatctgacaagtgttgacgtatgtatacacccatgaaaccaacactatacagtgaacacgtccatcccccccagagattttcctgtgcttctttgtgatccctccctcctgcccctcccactctgccccaccccaggcaatcactgatctgctttctgccacaatacgaagatttgcaaaccgcttataataaccatttctgagcccagcaggcaaatactttctttttggcgggtgggcctttcattgattgtttaaacttctcaattcagagagagagggggagaaaagaggacaggaaagactggtctgggccccttctgcgaggcctggccttaaccacaaccccagcctggctcaagtgccctggagcctctgcccacaggacagccctgacttcccctctccaagctttgcagggccctcattacctttcctggtcaggctctgtacaatctgggactcttagccagtcctgacaccaaaacaacaaaaaccagagacagggggattggagccaatccctgcaacctctctctcattcctgcagtgctgacctgctaaaccaggtacttccctctctttcctttcttagggctttgctcctggcgctctgctcctcttcattctggatctctcctttacttgcttctctcccaccttctgccacccctgcagcccatggcaatgcaaacagactcatgtgtgtcctcagtctgtttgcagaaccatagccctggcctggctctgctcaagggcaccctccctccattcgccaagtcccgcacctgcgggatgcaggtggggctgggaatgggcactcccctgaccccactccagcatcaatccaatccccctccgatgcaggaaggttccagatgttggggagccatggaaattgttcagtgtacatatggtgttctggcttgggcaaatcatgatgaagacaattttcccacaaaataggagggaacatccgtgatggtgcctggttcatttcctggcacatgtaggcatcagaacactgaagggcttataccagagatttattggggttgtggaaaaaacaaaaatcggaagagtagagtttagtaggcagatgtagattttaaaagctcggtaagaggtacataaacatttcttcaacaggacacaaaaatcactaacccaaaagaaaaagattggtacattaggtgatagtaaaattaagaatttcttttcatcagtgagagagtaaaaaggaatatacagtagctaaaagacccatatctggaatatataaagaatttctacaaactagcaagaaaacgttgatgattcaatagaaaaaaaaagagccaaagaaataaacagctagaaatggatggcagcaatggtggtacatcaacgtgaatgtagctaatgtcgccgagctgcacaactggtaaaaatgggagctgggtacagtggctcatgcctgcaatccgagctactcaggtggctgaggcaggaggatcacttgagcccaggagttcaaagacagcctgggcaacatagcaagacccccatctcaaaagaaaaaaagtaaaaatggtaaattttatgttcatatatatatataatcagagttaaaaataataaaataatttaattaattgtaaaaagaaattaacagctgcttcacaaaagaaagaaaaaataaaagcaggaaggaaagggaagggaaggaagaaagaaacaaaaaaatgatgtaattggccaagaaaaaattaaaaatgctcaacctcataaggcatcaagcacattaaaaccacagtgagaaaccaatactcacctaccagaatgtctaaaactataaggattgttaatactaagtgctgggagaaatatgaggtaactgaaatgctcatacactgctagtgagaatgtaaaatagcacaaccacttgggaaaactctttggcagtatctactaacaccagcatattccactacccagaaatgccactcctaggcatagccccaaaagaaatgtgaaaacatgttcaccagtgatgtgcaaatgtccatcaacaggagaatggctggccaggtgctgtggctcacgcctgtaatcccagcactgcgggaggccaatcatttgagcctaggagttcaagaccagtctgggcaacatagtaagatccccatctctacaaaaaattttaaaaattagctgggtgtggtggtgcacacctgtggtcctagctacttgagaagctgtggcaggagaatcacttgagcccaggagtcagaggctgcagtgcatcgtgattcacctctgcactccagcctgggtgacagagcaagcccctgtctctaaaaaaaaataacaataataagttaattaaaaaaaaaaccaggagaatgcctaaatacattgtaatatacttataaatgaattcttatggtaatgaaagtgtattagcaactgctaaacccagctgatgaatctcaccaacatgctgaacaaaagaagccagatacagaggaatttataccgcatgattacatcagacaaggttaaaacccaggccaaactatggcgttaagagtcagtgagctgcttagtgcttcagggaatggtgcttgcagggagggaggctctggtaatattctctttcttgatttgggtctggtgtcccaggtatgcctactttgtgacaattcatcaaggtgtactcggggttggtagcttttctgtatatgtattacacttctctctctctctctctctctctctttctctctctctctctctctctctctctctctctctctatatatatatatatatatatatatatatatatatatatatatatatatatatatatatatatatatatttttttttttttggatacagggtctcactctgtcacccaggctggagtgcagtgttgagatctaggcacactgaaacctccgcctcccaggttcaagtgatcctcgtgcctcagcctcctgagtagctgggattacaggcacgcgccaccatacccagataatttttgtatttttagtagagatcggatttcaccatgttggccagggtggtctcaatctcctgacctcatgatctgcccacctcagcctcccaaagtgctgggattacaggcatgagccactgcgcccggccttaagtttatttttaaaagctcctactgattgaagcataattgattgattggttggcagagtctctctctgctgctcaggctagagtgcagtggtgtcatctcggttcactgcaacctctgcctcccaggttcaagcgattctcgtgcctcagcctcccgagtagctgggactacaggtatgcaccaccatgcctggctaatttttgtattttttgtagagatagagtttcaccatgttgcccaggctgatctcaaactcctgagttcaaatgatctgcctgcttcaacctgccaaagtgctgggattataggcgtcagctactacacccagcctgaagcattatattgtatttaaaacaaactcttctggctgggcctggtggctcatgcctataatcccagccctatgggaggctgaggcaggtggaacacttgaggtcaggagtttgagaccagtctggccaacatggcaaaatcccgtctctactaaaaatacaaaaattacccaggtgtggtggagaacacttgtaatcccagccctatgggaggctgagccaggtggattgcttgaacttgggagatggaggttgcagggagccaagatcatgccactgcactccaacctgggcaacagagcaggactgtacctcaaaaacaaaaacaaaaacctcttctcattgtcatcctcacgtgttctttttgccccatataaaataatcaaaagcaggatagctctcagcagactaatttccatgtaatgatatgtacatctcaacaatgcatgcattctttgattataaaagaataagcattattgattctggaattgattgataaaaggaagggtaggtcttcaaaccaacaaattggccaatggataaaagtgcaaactgccaagcggagaaaggtgggcaccagccatattttcttttgaatctttactttgatttatggaatgagggtgttctttcccttaaagagatgtgcagctccgtagagcagataggaaagatattttccatgtgtaggcaggttcctttcctacagaacttgtgtaggcaggttcctttcctacagaatcccatgtggacccactcttacctaaggccagtcctgggcatagggcaggagctaaagccaggaagctggtgtcttgcctttgccagaccaggtggcctgtgagaggttccattcgattctgttcagttcttcatggcaacaactccttatcatgttacttatgctgagccttggggatccaaaaataaattagatgtggctcctgttctcaagggcagtgtcttagtctgtttgggttgctgtaacagaataccataaattgagtggcttattaacagcagaaatgtactattcacacacacactctggtggctgaaagtgcaagatcaaggcgctggtggatgtggtgtctggtgagggccgactttctctttcatagatggcagcttctcactgtgtcctcgaatggcgaaggggcacaggagctccctggagcctcttttataagggcattaatcccattcatgaggtgtccacactcatgacctaaacacctctcaaagaccccacctcctaatactatcacatggatgattaggtttcaacacatgagtttcggtgggggaccacatacattcagaccatagcaggcagtacaaaggaggaggagattagaagatgaggtcatgatacaaaggatgaataatgctataatagactatgaccctggacaagtggcttaacttctctgcgcctcagtatcctcatctgtgaactgaggataaggtagtacctcctccacagggttgttttaagggtcaaatgagattaaacacgtgcccaacacgaccattgctcagtacatgattttgctgtataaactgtactgatgatggcaagaccctggtgatgatgatgatgatgatgagggcaccctagatgtgttggaactatcaagaaggggcactcaacacagcccggaaattcaggggtgccttcttggaggaggtcatgcccaagctgagtcttagaggataaacagtttgagagaggatatggtaaaaaaaaaaagaaaaaaagaaaaagaaaaacgagaatgtgttgcagaccaggcacagtccaagaacgtcccagagccgtgagacagcatagccctccaggagccgggctgtggggcacggagtggtggggcactggaggggggccttgtctaccagattgatgagctgcaatctcgtcctgtgacagggaatcactgaagggattttgttaaatgcctttgaagtaaaatcatcaggacgcggtgtttgattggttacggttgaaggaaagaggagccagtgacactggaaacaagaagaaattgggtatggcagaagagggccactcattctgttttgacctggctgacttggagatcttggcctctccaagatcttggattcgacttggcctgtggagctgtcttaagcgaatgtctggcaagcagttggcacacccagctgaggctcgggaagggtgtgtgagtgatgccaggactgtgagagaggaatgccaggcacagcgaggaggggtcatctcagagcagcagcacccagggggcaagcagagggaaaggggaggacaaggaggacaaggaccagaaggagcctggtatttgtttgtttgtgtgctgccataacaaagtatcacagaccgggggcttcaacaacagacattttctctcacagttctggaggctgggagtccaagatcaaagggtgggcagggctggttcctcccgaagcctctctgttggctcacagatggccaccttcctgctgtgtcctcacacactcactcgggatgtgcttcggggaatggtgcttgtagggagggaggctctggtaatattctctttcttgattcgggtctggtgtcccaggtgtgcctactttgtgacaattcatcaaggtgtactcagggttggtagtttttctgtatatatattacacttctctctctgtctctctctctctccctatatatatatatgtatatatatatatatattttgagacagagtctcactctgtcactcaggctggaatgcagtggtgcaatctaggcacactgaaacctccacctcccgggttcaagtgattctcatgcctcagcctcctgagtagctgggattacaggcacgcgccagcacacccagctaatttttgtatttttagtagagatggggtttcgccatgttggccaggatggtctcaatctcctgtgtgttgtctatgtccaaatttcctcttcttatgaggacaccaattctactggattaggggccactctgatagcctcaccctaacttaatcacctctgtaaggagcctatctccaaatacagtcacattctgagacgctagaggttaggacttcaacagtgaattttggggggacataattcagcctataacaggcctgctggacttggcattgggaagtcattgatgggctcgatacaaacaaggggagagaagaggaaaggagccggctgcaggcctggagggagtgaaaggagccggctgcaggcctggagggagtgaaaggagccggctgcaggcctggagggagtgaaaggagccggctgcaggcctggagggagtgggggggacatggggcagcccaggagctgaccgtgggcaggagctggatggagaaggagtctccaggctcaggagggacttgagcagggcacaggctgagggaagcgtggaatgagggagggaagggatgaaaggtagggtcacagagccactggccgagcatgcgtgtccacctggggtccaggttggcccacatcaagcacactgagttaaatctccaggagagcatggagcctgcccagagactgtgtcaaaccctgatgcatcctgactgtcactccctcaggaatagtgaccaagggaagaactgttcaccctggaacaccagagcttgtgtcactgtggcttcatggaacagaaatgtcaaatctgtggattcagctgataattctctcgttagccacaagatattttctaaattaaaaaaacaattttttgcacttacgtgaggttcctagagtagtgaatttcacagagacaaacgggggttgccaggggacggggagaggaggagtgagaagtgagtgtttaatgggacagaatttcagtttgggacgatggaaaggacctggagatggatagtggcgacggctgcacagcagtgtgaaggcacttaacactgttgaaatgcacactgaaaaatggttaagatggtacacggtgggaggccaaggtgggtggattgcttgagcccaggagttcaagccagcctgggcaacatgctgaaaccccgtatctactaaaaacacaaaacatttttgggcatggtggcgtgcacctgtagtcccagctactcaggaaacggaggtggaaggattgcttgagctgagatagtgccactgcacttcagctgggccaacagaggaagactttctcaaaaaaataaaaataaatatagttaagatggtacattttccgctgtattttaccacaatttaaataaataaattgttaggccaggtgtggtggctcatgcctgtaatcccagcactttgggaggccgaggtgggtggatcacttgaggtcaggagttcaagaccagcctggccaacacagtgaaaccccgtctctactaaaaatacaaaaagttagctggatctggtgatgcacacctataatcccagctactcggaggctgaggcaggagaattgcttgaacccgggaggtggaggttgcagagagctgagatcacaccactgcactccagcctgggtgacagagcgagactctgtcgcaaataaataaataatgggtaaataaattgttttaaagaaagatttctatggagttagttttcccccttgacatgcattttttgaatatttgagacaaaatatccctaatggtcttgatcagcaaagctgttttttaaaaagtgtcagaagagttgctcggaacagtccatgaagtacaaataacttgacctttccaacgggcgaaaagagagttaggaagttggtactcagtgaggcgatcttgtcaacaaacagttcgactgaactgacattgactgggcacccactgtgcgccaggcgtggtagggagggagatttgtctgtctgatgacttggttgtttctcgtgctctgctttttgatgatcggcatctgctttcgaggtggatagccgagtgtcgagcagtgctgtgatgtggggtgctccctgctctcccatttctatggcctggtcttttcccagaagcggctgggatgctccatcttgccctcccttcggtccctttgtgtcttgggtgtccttccaaagtggggaggcagatccgagtccttcccatgtcctcacctcagaggcccaagtgccttccaagtgtgaagacttaaaaaaaaaaaacaaacctaccatggagggtggtgggggaggattggaattccagaaaattctgaatgaaaacagcagttgcaaaacggaatggctttgcaaactgcagccgattattcagtgactgtcttgggctttggccggaccactcgaaaatctgccgctgaaggatccagggagagtggcagaaagcacagggaagctggaaccgaggggctggacccagctctccaggaggccccagctcccagcccaccagctcccagcctcaggccctgtttggctgtgactgaggaagctcaagccccaaagccagcataaagcaagcgttggggcagctccggtttcagccggacttgcctgtgtgtaatcctggggctgggtaatctgatgccccaaactcagagccggttctggctcttggctccggtggcctggggagctgaggctacttttcagggacaccagaaatgtctgtattctttctcagatgggtcggcagactgttctgggtgccaggtctttgatgaaatggatttggatacaaatcaaatatttaaattggtgttttccctctttggaaggaccattccagctggacctgtggacttgtttttacataagatttggactcctttaaatgtgcatttttttttccatcttgaatacgcctggggcagacagtggctgtatttggaagccccgaggctgctggtctggctgagacagggagcaggcacctcagctaaccctcttggccgaaagtgcacttgttagaaaaccaattcatgtgcctgctggctccccatggttatatattatttaatcacgcaggtcttgggtttatgccaagcagcaacttgctgtctgccatctttcagggaagaataagcaaggcaaattcattcagttctgtctctttttcagcttcctgggctaaatgaaggcaagaaagtgtttatgaacatcccaaagtgctgtgaaatatccatcttggtgaaaatagacaccctgcttccttttgaaaaatagcattttgtgaaaggaatttttacccatacatttagctcagatatttctagatatttcaaagggcctctcttcttccctttactttagacagagagagagagactaaagatatgtgaaattcctttagccacaagcttgtttgggacctggcctggggcacgagtcttcatcctggctggtgacggctgacaccagggcatacagtggcagttatcagagaatttccagggaggtgcaaaaactcggtacctttactcctacagagcccacaaagccctgtgcacaaagcccccctgcatcttggaaggagcaggtgggacattttgttttggggatggggtccgggacgagctgtgagctcctctctgtcccgccatccaggtggtcttggaaggagcaggtgggacattttcttctggggatggggtccaggacgagctgtgagctcctctctgtcccgccatccaggtggttccactgttgccctgctgagagctggaggccccattccccctccgagcccagcctgccagccccttcacacgcctttaatctggcgccttcctcctagcacgcacctttctttttctaaaaataaaaataaaagttttattttatttcaatagttttttggggaaccagtggttttcagttacatggataagttctttagtggtgatttctgagattttggtgaacccatcacccaagcagtgtgcactgaacacaatatgtggtcttttattcctcatccccctcccacccttcctccctggactccccctggagtccattacatcattcttaggccttttcgtccacatgatttagttcccacttgtaagtgagaacatatgatatttggctttccattcctgagttagttcacttagaataataacctccggttccatccaagttgctgcaaaggccattatttcatttagttttacatttgagtagtattccacgttgtaaatacaccacattttctttattcattcattggctgatgggcatttaggttggttctgtgtttttgcagttgtgaattgtgctgctataaacatgtgtgtgcaagtgtcttttttgtataatgacttcttttcctttgggtagacacccaggaatgggattgctggattgaatggtagttctacttttacttctttaaggactctccacaccgttttccacagtggttgtactagtttacagtttcaccagcagcgtaaaagtgttcccttttcaccacatccatgccaacatctattgtttttaaatttttaaattatggccattcttgcagagtaaggtggtatctcattgtggttttaatttgcatttccctgataattagtgatgttgagcattttttcttttttcttttatttatttatttattttttgagacggagtctcgctctgtcgcccaggctagagtgcagtggcaagatctcggctcgctgcaagctccacctcctgggttcacgccattctcctgcctcagcctcccgagtagctgggactacaggcgcccgccaatgttgagcattttttcatatgttcgttggctatttgtatatcttcttttgagaattgtctcttcacgtcctttgcccactttttgatgggattatttgtttttcttttgctgatttgtttgagttccttgtagattctggatatttatcctttgacagatacatcatttgagaatattttctccccactctgtgtgggttgtctgtttactgtgctgattacttcttttgctgtgcagaagccttttagtttaattaggtcccatttatttatttttgtttttgttgcatttgtttttgggtttttagtcatgaattcttttcttaatccaatgtctagaagagcctttccaatatgatcttctagaatttttatgtcttcaggtcttagatttaagtgtttgatccatcttgagttgatttttgtataaggtgagagatgaggatcctgtttcattcttctacatgtggcttgccagttttctcagcaccatttattgaatagagtatcctttctccactttatgtttttgtatgctttgtcaaagatcagttgactgtaagtatttggctttatttctgtgttctctattctgtttcattggtttatctgcctatttttattccagtaccatgctgttttggtgactatagtcttgtagtataatttgaagtcagctaatgtgatccctctggctttcttccttttgcttggtgttgctttggctatgtgtactttttttggttccatatgaattgtgggattgttttttctagttctgtgaagaatgatgatagtattttgatgggaattgcattgaatctataattgctttgggcagtatggtcatcttcacaatattgattctacccatccatgagcatgggatgtgtttccatttgattgtgtcatctatgatttctttcagtagtgccttgtagttttcctagtagagatctttcacctccttggttaagtattttcctaagtattttattattattattttaattttttgcagctgttgtaaaagggattgagttcttgattgagtctcagcttggtcattgttggtgtatagcagagctactgatttgtgtacatgaattttgtatcgtgaaactttactgaattcatttatcagatctaggagttttttggaagagtctttagggtgttctagatatacgatcataccatcaggaagcagtgacagtttgacttcctcttttccaaattggatgccctttatttatttctcttgtctgattgccctgggtaggacttccagtactatgttgagtagaagtggtgaaagtgggcatttttgtcttgttccaactctcagggagaatcaagcacacacctttctccttccctctttccaccctttgtgcagtctggcaggagtcgtattttcctacagcgactctttctgtgtcatttattgccaggaatacatattcccagaatcccctttatttactctgtcatttgagtgtcacctgcatggtgtccaggctagagaccagcctcttctgtgtccgcagtttaaagtttctgtctcggcacagccaagcacacatcagatgctgggtcagactcctcagagcaatatccaggagtcaggggacacaagcgcttctaagcctgttgttccagtgaggaagccttgacttaaaactatggttgtgggaattgaaaactaacgagaagctcaatgcacagacttgctaaaaagagagagcactggtgtccctacctcatggggtccttgggagaactaaataaggaaactcacacagttgcttagcgctccctggcacacggtaaactgttgatactttaatctccttgaactgcaggcatccctcagaattcagtccttggagatcatatgtggatctacacagtgtacagaagaaaagtgcaagaagactgcacagcatctaaaagctaagcttctccagcttgggtgaattctgggatcagcagattctccctttaggatctgggggctgccacccagaatctagaatcagggctgacagtcactgctcgacctctctctctctttctctctctctctcttctctctctctctctctctctctctctcacacacacacacacacacacacacacacatatggggaggcccagggggctacagtgtccagagtcagcccctcctggaaatccacagcccaccaggtctgtgtcaaggctttgaaatcacatccgagtgttttgattgagagcaagtatgctgcatggaaaatgatttctttgtaatcattcagtagaaaaacgaaactgtctcctaaataaaatgtcaaacatcctaaagtgcctgggagcgtagtagtgacatcagcttcagagtttattatttcatcaatggagccagacttggtgcaaaaaggcaaggacactttatcagaaaaggaatttttgggggaaaaaaaataaaaccttttgttttatgagaccagcattactcttatagcaaagcagctgaggacactacaagaaaagaaaattaaaggccaatatccctaatgaacatagatgtaaaggtcctcaacaaaatactagcaagctactcttacaccaaagtcctacagactgctgctcatgctgccaccatgtctttagtgatccttgagaagttccagcacattttgtgagtattcaatgggtgacagaaaatagcctttgccatcactgccattaagggtgtgggtcgaagatatgctcatgtggtgttgaggaaagcatatattgacctcaccaaaaggtcaggaaaactcactgaggatgtggtggagcatatcatcaccattatgcagaatccatgccagtacaagatcccagactggttcttgaacagacaggaggatgtcgacgatggaaaatatagccaggtcctgaccaatggtctggagaaactgaacaagatttgggtcaataaaggaccgcaccaattctgggacttttgtgtccaaggtcagcacaccaagaccactggccaccagggccataccatcggtatgtccaagaagaaatacgcctgtaggccttgtctgttaattaatagtttgtatacctaaaaaaatactagcaactagaattcaacagcacagtaaaagaaccattcaccatgatcaagtgggatttatccttggaatgcaaggatggctcaacatatgcaaatcaatcaatgtgatataccacattaacagaatgagggacaaaaaccatatgatcatctcaatatatgcagaaaagcacctgacaaaattcaatgtcctttgatcataaaaactcttaacaaattaggtataaaaggaatccagctcagcaaaatgaagaccatatatgataaggccaaagtcaacatcatattcaatggggaagagttgaaagcttttcctttaagatcaggaacaagacgggcatgctcattttcactacttctattcaacatggtactggaagtccttgtcaaagcagttaggcaagaaaaagaaataaagggcatccacattggaaaggaagacgttaagttgtctctgtagatgacatgatattataaccctttgggcagttaacactcccacttcacccttgcaagtagctgggactactggagcacagcaccatacctggctctattctttttttttttttttttttttttttttttgagatggaatcttgctctgtcaccaaggctggagtgcagtggcgcaatctcagctcactgcaacatctgcctcccaggttcacgtgattctcctgcctcagcctcctgagtagctgggattaccggtgcctgccatgacacccagctaatttttgtaattttagtagagatggggtttcaccatgttgaccaggctggtcttgaactcctgacctcaagtgatccacccccttgccctccgaaaatgctgggattacaggcatgagccaccacgcctggcctcgtctactttctgtatctatgaatttgctcattctataagtgaaatcatacaatactgttccttttgtgactggcttacctcacttagcatatgtctttggttcatctgtgttgcagcatgtcagaattgtaaccacccaaggggttcaccttgcctgctgcctagacagagccgatttatcaagacaggggaattacaatagagaaagagtaattcacacagagccggctgtgcaggagaccagagttttattattactcaaatcagtcctcccaaaaaattcagggatcagagtttttaagaataatttggtaggtagggggccagtgaatcgggagtgctgattggctggctcagggatgaaatcatagggagtcgaagctgttttcttttgctgggtcagttcctggatgggggccacagaactggctggcaggtccaggtagggccgtctggatgttagaaatgcaaaaacctgaaaagacacctcaaaaggccgatcctaggttcacagtagtgatgttaccttcaagagtaattggggaagttgtaaatcttatgtcctctggcataatggctggtaatatttagaattctagcccctctcatcttaccttggtggctggtggcctttcatttgttttacaagaacagtttagccttttgggaaaggctattatataaacgatacactaaatttcttcccaaagctagtttggcctacacccaggaaggaagaagaacagtttagaggttagaaacaagatggggtcagttagatctggtatctttcactgtcataattttctccattatgatttttgcaaaggcagtttcaggattttcttcctttttaaataaatacatgtattccagcctgggcaacatagtgagaccctgtcactacaaaaataactataaacatcagctgggcatggtggtgcgtgcctgtagtcccaacttctcagaaagctggggcgggattgtttgaggccaggagtttgaagttacagtgagctatggtcacacctctgcactccagccttgagcttgatctcaggaggctgaggctccagtgagctgtgattgtgccactgcactccagcctgagaaacagagtgagatcctatctcaaaaaaaaaaaaaaaaaaagaaaagaaaaaactccaactatggaatcaaacttaattagtaattttggtttgactgcttacttagccatgcggccttgggaagactacttagtttctctaaacttatttgtaaaatgtgagtgtcagggaggaaatagaatttgtccttaactctcataagttcatagttaggacagacccctgtggaagaaaaccagattaacaagagaaagataagccaattgatgaacacccacagtgcacaccgtgtggagaaatctcagtgagaggtcacttggagcagggacttagaactctggcttatctagcatcttcaacaaagaacaatacagtttggagaagcagcaagacaaagcagaactgtgggtctctgtgggcagcaactcgagggaaggcaagccatggccgatgcaggttcgtcagcaaagcttgttggcgtaaacgtctgtggttccttctccaggctgctgggggcccacagctgtcttcggtggcaaaatttgttctccctggcagagccagggacaggacaggataccttttctctttgtcaatctatgtcctgccttttggcagacagagggcgggcatggagctctcctgcatcagcttcttatcctcagcgcaatctacaatcctttgcgttctggaccggcatgttctgttctcctgtgtgagcaaaacctgccttgaggggctatagggggcatgaactgacggagggtagatcagacgctcagcctgcctgaacacacaggaagtgctcagaaatgtcagctattattatgaagtcaaatataccagctgtacttttattctgataactttaaaatgaaataggggcaaagtttcccagttgagaaaaagtgacacattttagaagttcagaaggcattatatgcctacgactttccctcgggaacaaagagatggaggcctgttagagacctaaaagaaacatgacaaattctggctgcttatagatccaagagactgccccctattctcacgcctcccaatcttccctgggtgcagcgtggcctgagagccaagaggcactaagatgcagtgtgccagatgtgagcacctcctaaatgaaagaaaggcctccaacttacctcacctgttgagaaagacaaaatctgtaagaatatacttttttttttttttgagatggagtcttgctctgtcgacaggctggagtgcagtggtgtgatcttggctcactacaacctctgactccctggttcaagcgattctcttgcctcagcctcccgagtagctgggattacaggtgcgcaccaacacgcccagctaatttttgtattttttagtagagacggggtttcaccatgttggtcaggatggtctccatctcctgacctcgtgatccgcctgcctcggtcttccaaagtgctgggattacaggcgtgagccaccgcgcttggccgaatatacattttttttctgtgtgtattttctcctcagacagagctcacagatgctaatcgaggcatggcctgtgtttccagtccctgaaccatctgacactcccacatttctcgcggagctttccctgccagtggtgctcaggtgactgcagtgggctcctgcagctcgttcccgcccagcttgcccctgatgtctctcctccaaccccctcccatggatattaaaagagaaagaaaaaagctctaccccaagtccagccacctttccatgactctccctgtcctaaaacaaggaaagccgccatagacacaatgtgagctgctaatccatcactgcacgtggagttttatccgagaaaactgttgcttctgtaaagtcaagcattctgctgagaaaagtttccattcaccactacaggaaaatggtgcttgtgaagctccagccagtgtgctgttgagcaatgtctttctaaacagctacactggggcccaggcatgggagaaaggtcagggagggggagctccaagaccaggaagttcccgggtggctctcctccccggggaaagggtcccagctgactcaaggctccgtctctttccatgtgttcatgcacctccttggggataaccgtctagcacatcagcttgagccaagaactgatgaggtcaaggtagggatggcagtccccttaaaagtcttctcctcaaagggaggagcaggttcatcccatcctcctgtcctcacagcccccacaggaactggatggagtgtaggccaagtgctcagtgcacgttacaatggacccaagtaattcatgaaggagcctcgtggtgaaaatgccacctgggtttaggggcaacatgccattggggccaacaccaaagttggccacaggaaaacgagaccattatttctctaattataagagatgaaaagcaccctctttggcctcagtcatttcctcggaattgggtggatctcgctggctgccaactaactaatttaatttgacctcttcgctaaagcgaatattgaataactttcacccagaggagaaactattttccgtaacctgtattctgaggaatatgcttgcatggacactctactccccatgatccagcaggttacactgagaattcagcacaatcttagctccttaaaaggagggcttctggtgtagttttgtgctgtgttactgttcccttgctccaaacctaagagaactgcctgggtaacttgtagagtatttttctccacagaaacctcttgacacttgttccttgaagatttacaagtttttcttcctatctatatcatttcctcaactcagtcttttaaaaccccgctttaatatcagtcttttctgtcttttgtttttgtttttgtctgttttttaagacggagtcttgctctttcgcccaggctggagtgcagtggcatgatctcggctcactgcaagctctgcctcccaggttcatgccattctcctgcctcagcctcccaagtagctgggactacaggcgaccaccaccacgcctgactaattttttgtattttcagtagagacggcatttcaccgtgttagccaggatggtctcgatctcctgacctcgtgatccgcccacctcggcctcccaaagtgctgggattacaggcgtgagccactgcgcctggccagtcttttctttaaaatggaagatagtctaacatggtattaactggcaggtatagatagtttgaaaacatgagtcaatatgggatgactaaagagaattaacagcaatttatcttatttccaacttcaactgacacctcctaagttccttgttatatcacttcctctctgttggtgtgcattcttacagattataagagtaacacactgtaacaacaccgccttcctggcttcctgctgggctggttccatcaggttgagggaggaagaacccagcagctggaagctttctcagtcctttgtgacaggactcctcaggatggtgatatattgtcaaggtccaagcggtcctggatgcatgagtcactgagctagaaacttcaggagagtcagcggctggagacactgacctgccctcaagacttagagccaaggaggagcctgaagatagggtggagaagctccaagacaaaacgagcaggctgtgtcctcagtgtgcagagtgctccagagaagagaaaggcaacttctgctggggaatcatgcaggaggtgacaaccccctggggaagtgatgggctggggttggaggtgaggaagacatagatatgggaatgccaagttgagaatcggaaaatacaagagcagtttgcttggagtggagagtgtaggtcagaacataacctgacaacaatgtatgagaaacacctggctgacctcagtatccgtgagcacacccagcacccagaccttagtgtctagtgccattttccaaaagaaatggaaccaagattcctgagagaaatggttgattctaggactgaggcaggaaatgtgaggtgagcctggagcatcttatggtgccaggaagtaaggaagtgctcagcataacagtaaacacacacacaccccattgatgggtttatgttgaaggagcacaggagccaactgaaagagctcccaatggccacagctggaacagtttgagctacaaaataaagaaagcagtattagaattggattatcacaaagtagaaagatccttgagtccatactgatagaaataaatgattgaatacattaatgagtgggggaaaagagagctccgctgcagaatttgaaataccttatgtatctcttccaccctaaaggaggggagcagaactctgcactccttaaggatgggctgcacatagtgacttccttccaaagaggacagaatggaaaggggaccagaggagagtaatttcacagtggagatgcctgacaaccaccacctcggccagctgatcaaggtcaacagcaacagccctaaatcacgttgagactatttgctcttgaaataaggtgatggcaatggccttttacctctgtgggcttcctccccaaaacccaaagctccaatctaatctcaagaaaaaacatcagacaaattgcaacaaagaggcattccacagttcccctgagtagcaccctgaagaactgtaaagaccacccaaaaccaggagagcctgagacactcacagccaggaggactcaatggaatgtggggtcctggagggagctggaacaggaaaaggactcagggggaaactaagggtgtctgaatatagtctggatcctggataataataacgtatcaatattggttcattaactgtaacaaatgtatcataccaatgaaagatgttaatattaggagaaattgtgtgtgtgtgtgtgtgtgtgtgtgtgttgggggaagtacataggaactctctgtactgcttttttcccataaatctaaaactgttttttaaaaaagtcttttttttggtggggggatagggtcttgctctgtcacccaggctgaagtgcagtggtgtgatctcaactcactgcagccgctatctcccaggctcaggtcatcctcccacctcagcctcctgagtagctgggactataggcatgcaccaccatgtccagctaatttgtgtattttttgtagaaatagggtcttgccatgttggccaggctgatcttgaactcctgagctcaagcaatccacctgcctcagcctcccaaagtgctaggattataggggtgagacaccatgcctggcctctaaaaaagtcttaatgaagaaagtggggtgggggggaacctcttggcagtaaggatgggtgtggctaagtggttagtggagaggggaggtggtagatgctcctggatggatatcactgttccctctgaatgtgactgccagagatgggggcttagctcagcttgccataaccaaatactgtagactgcatgccttaaacaacagaagccgatttctcacagttctggaggctgggaagtccctggagctgggtgccagcatgactggggtcctggtgagggctcccttcctgacttctccatggctatgtccttgctgtagcctcacatgaccaagagagctgtggtctcatctccttcctgtgaggacactaatcccactgtgggggctccaccctgacgaccttatctaagcccagccacctcccaaaggcctgcctgctaagaccatcacactggggttagggcctcagcattatgattttcaggggacagaaacattcagtccataacagatgggcaaagagagcatctcgtcccagagaagatatccacttggcaggtaatgtgatgctcaacaagtcatatacagagtagctttgctaaaaatagatacaaaattttgtggtcaacattactgaaggaggttgccccagctagagcagggggatggccaatggctggggttgggggcataaaggagacatgggaggggagtcctggggattgatcctaggtttttggaagctcaccacgagtgccctccacatcctgctccaccacagccctcttcaaccagtctaggcattcctccccacagactggcccacaactccttcccagcagaggctgggcgccagaacaggctgctgcagagcccagccctgtgccccacctcactgtccttggggccagcccctggctgcctgcctttttcagagagagaccagccttagcttcggtgcaaaaggcggttcatgctgcagccttgtgttctgagcactacctgccttctttctgttttgcttgttgctatgctcccagttgcttctcatcctcaggaaatccaggactaactccatctactgaagacatccacccaccctcattcccttccaccccctgtagacttcctccaggctcagtgcacagggttggaataaccactgtgattttgcattgattttgacccattttcatcagtgttcctgtgcatggccatttatttatttgaatattgtaataaatccacaggaatcatccattctgcaaggaagtttgagtcaggacagcaatttacatatacctatatgggcctccctcctcctatcaccttttctctttcctaaagttgtgtttaccttttgaaacaattatacattcagaggaagtggcggatatcatacggaaaggtcctgtgtaacattttatacctccagtagtaacatctcatataactgtagcacattgtcaaaactaggaaactgacactggtacaatccacagacctgattcacatttccttagttgtagtgtgtgtgtcagaggcggcggtggagtgtgttctatgcagttttatttcatgtgtaggtccatgtactgacaaccacagtcaagatatacaagagttccatcaccatgatgatcctttttattgccctgttacagccacactgacccctccccacccccaacatccctaatctcaggcaaccactaatctggtctccatttctacaattttttcatttcaaggatgttatataaatggaatcatacaatagtaactttttggtctgggttttttttcactccatataattcccttgagatccttccaagttattgggtgtgttaataacttgctcctttttattgttaagcagtatttcatggatcacaatttgcttaaccattcacgcactgaaggacatttgtttttttcctaggtcttgctcattacacataaagctgctatgaacatttgagtatgggtttttgtgtgaacataagttcatttcccaggataaatgcccaagagtgaaattactggatcatatggtaatttcatgttttcttttataagtaaactgggaggtatttttctgaatggctgtgaaattatacattactgccagtaatatacgggagataaagtttttcagcatagttgtcagaatttgatgttatcactatcttttaccattctaataggagttagtgatatcatgattttaatttgcctttgtaaccattctaataggagttagtgatatcatgattttaagttgcctttttcctaatggttaatgatgttagaacatcttttcactcatttatttgcagtttaagtggactctttggtaaaatgtctgttgatgtctttccttcattttccatttggtttgtttgttttcttattgctgagttttgaaagtactttacattctggacacaaatcctatatcattgatctattggtatatccttcatgtcaataccacactgtcttgattactgttgctttagaataactccttaaaaatctagtaatattagtcgtctaacttggttcttcttttgtgaagttgtttggctactctaggtcctttgaagttctacaaacattttagaatcagtttgtcattttacacacacacacacacacataggctgctgggattttgattgtgattgtattaaatctatattgaatctatattttgggaatatgacatgacatcttcacaatattgagtcttctgacccatgaacaaggtatatcatctatttaggtctctttatcatatcagtattttgtagttttcagtgtacagtatttttctcatttttttggtcagacttatcccaggtatttatgctattgcaaaggtagtattgtttatgtgattgcaaatgttgattttttgtttcaattatcaatttttcattgctaccatatacaactgatttttgtacactactctgtatcctgcaaccttgacaaactcacttatttgttctagtagctcatttgtagagtccgctgaattttgcataaataatcatgtcatctgtgaatacatttttctttctttctttccaacctggatgtccattatttctgtttgttctctgattgcacagtctaaagccttcagtacaatgttgaacagaggcggtaaaagcaggcatccctgatttgttcctgacgttgggaaggtggggaatattgtctttcacaattaagtgtgatgttagctgtagggtttttgtagatgcccttgatcagattgaagaagtgttgtttattcctaaccttcttgattatcagtaatgaatgctggattttgtcaaatgcctttctgtattgattgattatatgattattcttttttagcttgtttatacaatgaattatattgattgatttttcaaatgttaagtcaaccctacactccttggatattccctcttgatcatgttttattacctgtttcttatcttgtaggactcaatttgataaactggcttagaattttaccctatgttcatgagaaatgttgatctgtagttttctttcctggtagcatgtttgtttggccagggtcctaggataattttggcactaggataattctggcctcagataatgaggtggaaaatatttcttcctctctctctccttctctccctttctttgagtcagggccttgatttgtcagccaggctggagtgcagtggtgtgatcattgctcaccgcagccttcaattcctaggctcaagcaatcatcctgcctcagcctctcaagtagctaggactacaggcatgtgctaccatgcctggctaatttttttttttttttttttggaatctcgctatgttgtccagtctgtccttgaactcctggcttcaagtgatcctcccacctcaacttcccaacatgctgggaatacaggtgcgagccaccacgcctagccctagattttcgttacatgtttttaaactgtaatttcaacttctttaacagatatagggctattcagatcatctacttcttcttgggtgagctttggtaatttgtgcctttcaaaggatttgtcaatttcatctatgttgaatttattgctataaaggtgttcctaatatttccttactatccttttctatctgtaggctcttcagtgatgccacctctctcattcctagtattggtaacttgtgtcttgtttcttttttccctgatatatgtacctggctggagatttctcaatttaaaaaaatttcccccccaaactccccaaattttgattcattcatttttctctattttaaaaatttcattaagtcccactttgacctttattattccttttcttctgcttactttgagtttttctcttttctagtttctgctattgatttctaatttaattccgttgtggccagacaacatactttatgtgacaaatgttttgaatttgagactttttaaatggtctataatgtagtccatctctataaatgttccatgtgtacttgcgaaaaactcttaacccactttacttttacatatattataaatcccgtactatgatttttgtttgaacagctaaaaatttttctcaagttatttctcaagaaacaaaattgagttgtttctccattttctcaagaaaaattttctgctattgtaagatgcaatgtcctgtaaatgtcaatcgggtcaagttgattgataaaattgctgaagtctactttattattcttattgattttctgcctacttgttctgtcaattattgagggtggggtattaacgtctgataatagtgggttgatctatgtctccttgaagttctacttgttcttgctttatgtgttttgaagctttgttatgaggtgtgtgttgtcagtatgaaataactttctttaatcctgggtgatacggtttgggtctgtgtccctgcccaaatctcatgtcaaattgtaatccccagtgttggagttggggcctggtgggaggtgattggctcatgggggtggattcccccatttagtgctcttctagtgatagaattctcacaagatctggttgtttaaaagtgtgtggtacctcccacacccctccctcctgctctggccatgcttctctttcaccttccgccatgattgagttttcctgaggcctccccagaagccaggcagatgcccactgtgcttcctgcacagcctgcagaaacgtgagccaattaggccaggtgtggtggcccatgcctgtaatcccagcactttgggaggctgaggtggagagatcacgaggtcaggagttcgagaccagcctggccaataaggtgaaaccctgtttctactaaaaaaagaaaaacaaacaaaaacaaaaaaacgaaacaaaaaaaaactagccaggcatggtggcgcatgcctgtaatcccagctactcaagaggctgaggcaggagaatcatttgaacccaggaggtggaggttgcagtgagccgagattgcgccactgcagtccatcctgggcaacagagggaggctctgtctcaaaaaaaaaaaaaaaaaaagaagaagaagaaatgtgagccaattaaacctcttttctttataagctacccagtctcagatatttctttatggcagtgcgagaattgactaatatgctgggaattactttttgctctattttgattaatatagccacttcaattttcatgtaactagtgttagcatatcttttttccatcctttaagtatttgtatctttccatttaaagtacatttcttgtaggcagaatataattaggtcatgtttttttcaatccagtctgaaaatctatgccttttaattggtggtgttcacactattcacatttaatgtgattattgatatgcttaggttgagtctctcatcttgctacttgtcttcgattcatcctaactgttctttattcccttttacctctttttctgtcttctttttgatgaatcaagtttttaaaataattccattttatcttttgatagtttaataggtatgattttttggtatgtcattttagcagctgctttagggtttacagcacatatctgtaacttatcacactctatcttcaaatggtagcacgtcaccttgtgtatgagaactttacaatagcatgattctcctctcctaatcttcaagctattgtggtcatccattttactcttacatatattataaatcctacactatgacttttatttaaataactgtcttttaaagaggtttaaataataaatgctacatttacccatgttgttactatttccagtgcttatttccttcagaaggcaggcattttccttctgcccaaaggacatcctttaacttttcttgcagtgcagacctgtgggtgacagtctttcagcttttgcaaatttgaaaagatcttaatttcttcatatccattattctattttcagtggcgtctagtctgctgttaaaccaaccagtggaatttgcaatttcaattatatttttcattcctagatttgtttggcactttttacaatctgcttcgttgttcttatactcatgccatttaaccctccttatttctgtaagcataaagcatactttatggatgtgcttgctaactttaacatcttaagtctttctgagacttaacggcctgcttctgccccttgtttctgctggttcttgtctattttacacttgtgatttttttctatgaacttacattccttgaaactctccgagttcctccaaagacaatctgttttgcttctgccagttacctgtaaggcagtaaaatcctgttatcacttgaaatttccctcttgagattttttaagactatccaggtggtgcaaacaagccaccctaaaaactgctgttatatataaatcctgtggttatatataggctctcaagtaagatgttttcccccaggacagaaatcttccttgctgttcacaggggttggggggatgggtgaagcagatggatttattcctagtttacccctacattgcatctatccttttggagtctcactttatgaggtctcctgttagttttcctcccttgggcaggccctgagctttgtgtgctgttctgcagccccttcccaccccaggctatgagaagaaaacttcaatttggcatttggcagatgcactaaggcggaaaagtggcgtcagtactccacttacttctttgggtttctgcttccatttacaaaaaaaaaaatttttttttccctttaagaactcttattttgcagctcttgttttttacattaaaaaaatggttcttcagacaaaaaaccaaacaccgcatgttttcactcataggtgggaattgaacaatgagaacacatggacacaggaaggggaacatcacacaccggggcctgttgtggggtggggggaggggggagggagagcattaggagatatacctaatgttaaatgatgagttaatggatgcagcacaccaacatggcacatgtatacatatgtaactaacctgcacgttgtgcacatgtaccctaaaacttaaagtataataaaaaaaaaatggttcttcatatgtattctaaagttttagttgttttcaactggtccttatcagccttactgctggaaataaaattctttcaacctgttctgtaacgatttacagtatccactgatccctctctgatccagaggcattagcgtgagaacacacttaggaactaggctggcctgagatcaagtctcaggtccactgccactataacttcggtagtgtatttacacactgtgcctcagtttcctcaaagggttggtgtgagattctaacatggtaatatataaacagcacttacaacagggactggccctggtaaggatgagatttctttttattatctgaaaaagttgtaatgaacaaaatatatctcaaccaatggggtgagatggggaccaatatccccggtccctggacatcctggcccagtgtaccacgtagtaacccacaaccctgtgcttatgttgacagagagaaatcaactatgagctattcactggacagcaggccttgctgccatcacagatgggtctcaggtgcagggcaggatgccagcaaatgctgatctgagaaatgtcaccatcacacaagcctgagtggacacacagaccttttaccattaagaaatctgaaagcaagcgtaaatgtaagtaaacacgatttttaatttttattttttatggtggacagtgatcatttgccccaacagccatctgaagccaatagtcctgattattaaaaatcacaaagttatataaatgttctcctccttttcgaaaaccatgttcatttttttcccaagaaacagggctgtctgcaaagccttgaacggacagtgtaacccatggagctaacttcggttcatcaaagtagtgactgaaaaaaaggtagttgttaaacagagttttaaaagagagttaggaatgtctgcattttaaaaaatttattcaggataagtagtatttctgatattctaataaagcttagatcttagctttaatttttgaaaatcaagaggtgtgtgataagttcctgatgtcacactgtgaactccataaggattaactaatatacaacacacgaaacaaacctcagctgttcccaccctcattctgggaggtctttaagacaaaaagaacccaaaacaaaaaaccccacaggcgtttaaggatcgtttccctcctattaagagtactgttctcagagtctcagttaactgaaacgttgcaggataattcaccagatttttcatatccagccttcctatcgaagaaagtcaaagtactaaaccaataaatgtgaaaaaggatgttgggcttaaaaaggaaaaccttcaagacttaaatctgacatttcaaaagggaagactgagaagatatgcttactaaataggattatactcaatgtacggtctttgcaataggcgatttgagttcctttcaatgtacattttatttatataccacctcccaaaatgaaaaaatctatactattcgacatactgttctatagagcactgatgagcgatataaaaggtaaagagttctcaccagagatgttccaataggagacagatcttctctggaagtatgaagccagtgattgtacacaaataagcttttgccaccactgtgcttggctcaggacagcaataggttgatatgaaattattaggctcattatttctgtcaccaaaaaaataaaagagagagagataacacatgtatatccatcacatgatcacttccaaagtattaaactcctattaaaaacaagcagcaggccagagccctggaagacacagggagttcagatacccacaggtcgacattactgaagacggcgccgagccagtcgaagagctccagagcccggcaggacacctctggcgttccctccagctcgctgctctgcagcactgggcactggagatctctcaacgtgctcagtgctacttttggctgatgctcctgaatttggtacttggaaaaatatgacatcattgtcgattcttctgaaccttaaaaacacaccacacaaggccatttgaatccatctgaccatcgtaagcaagtttagtgaatacctgaacccacccattcccatctgagcggtaagattgagtaagatggaagctgtgcagagctgcattcaaattaaaatcatttaaagctgctttcagctccttttgctcaagttctgtaaacgttcatcgtttttcacacttttcctggaaaagcacaacagtttctgatcagacccaaactagtttcactgtttgtgctaataaaaaaatttcaacttcacacttaaaaccaaaagcattcctgatgtatgaataatattagtgaactccagagagaaggagcttatctgcacaacctctattaaagaaaaagaagagaaactgaatggtgattgaacctcatcccagcttgactttgaaaacccaataaaatccagcgtatcttttcagggatgtttgtgtagccaacggccttggaagacagagatagtactccctccacggcaaagggcaggcttgcttactgtccagtataatagaaataatgtcaccctccctctctccgggcagatatcagcaggcttactgtcccttacaaaggactggagttcttaaactccaggttcctctcctgtaatgcaacctactgcatgtgccagcatcgcttggtgtcactctggaaatgggacttggtgaactggtgcaaatggtgatattcggtgtgatggttaattttaggtgtcaacctgactggatgaagggtcatctagatggctggtaaagcattatttctaggtgtgtctgtgagggtgtttctggaggagactggcaggtgagtgggtaaactgagtgggaagatctgccctcactgtgggtggcaccatctacccggctagggccccaggtagaacaaaacgtcagaggaacagtgaattcgctgtcccttggagctgggactcccttcttcccctgcccttggacagcagaactccaggttctctagcctttggactctggggcttgcaccagcagatccacaggttgtcaggctttggccttggactgagaattataccatcttctttcctgattctcaggccttcatatttggactgagccaggctaccagcatccctgggtctcccacttgcagacagcctgtcgtgggactcctcagcctccataactgcatgatcaatttccctaataaatctcctctcatccatccatccatccatccatccatcctattggtcctttctctctggagaaccctgactaatacattttggctactaccattcctctgaggaattaagtcctgtgtctctgacccagggcttatgtgtcttctgccagcatccctgagactgtagcaggctacctagttagcctgcaagtatgaggaaatctcagaactttcacagtcctgacaaatccttaaaacagttaggagctttaggaatagggagctatccagaatccaacgtctggatgatctgcatagaagacttcacgcaactgaaacttcaataagcctttttgccctcttttctatctaccatatatggaaggagaggcaccgaaggccagacctaggactcatgggagcaacttggagcacccagtgaccagacacttcccatgaggagcagacagatggggctatttctaaaacagaccaccatgcttcctatcctccaaaagagagtactacaccataattcctgatgacttgatccattattatctgggccaaagatacacttctaaaaggagcaacatacatggccgttttaggcagattacgctgtgtggtgaatagcaaactttgaactaaatttagtgtcctaatcaattaaaagttagaataaattcatctgacatttaatggtaggcctgagtcagtaccctgtgataataaataagcagattgtgtatataattggtgctacttaaaaatattatagtcaaggctgttcaaggtaagctggagagaggaaaggggagaaatagataaaatttagctgctctgaagccactctcaagatctctggatctacatataacccaaagagacgcaggcagaaaggcctgcgtgcctacatgatcctgaactatggttttcagagatgtcagaagggctagtttccttaataatatttttatatatacgtatagaatattccttgactaaagagtgaatcaccattcaatcctccattactcctctttaattaacaattactttcaaaatcactgtatcattacataatttattcctcatacctgttttatgccaagccaaaagaaaatcaaatttcaatggcttcttttctttgaaagaccaagatattctttcatacttcttagaatccaagtttaaggataattccatcaaatcaatggaaacaactttaaaaatgaaaaaaagaacatatatttcattcatatacgtacagcttctaccatggaaaaagtgttacatttttaaaaactagaattttgggaaattttatggatagtaaaattgttttattcttcttccactccctttggtttgccaaataaataagatccctttggtgggcacttctaaccttgagagctaataaaaacagacattttcaatttatatgtttcctaggtcaaagaccaagggcagaggaccttgagaggtcaggtttaatctacttatggatgtggcggccttagctattgatgttcagccagacgctgtcagcaaaacatctcttcactcatgggtgaatttctactagtaatcataaagacttggggaaaccaaaggaaattctttattaagaataagttgtagactcctatcttgggttcagtacttggaattttttttttttttttttttttttgagatggactctcactctgtcgccaggctgaagtgcagtggtgcgatcttggctcactgcaaactccccctcccgggttcaagcaattctcctgcctcagcctcctgagtagctgggactacaggcatgcgccaccacgcccagctaatttttgcatttttagcagagatggggtttcgccatgttggtcacaatggtctcaatctcttgacctcatgatccgcccgccttggcctgccaaggtttaacccgaaacatatatatttaattgaccagtccaagtctacaatctttattaaatgcatctacagctgaaaagaaatgaacttaaaagcatcatcctatcctctgtgaagctcgagtcagaagtttgacagattttttttaaaaggccacatttttttgaacaaagagattagaggcaattcaaacatttaaatttaaattgccacaagaagattagaaacagatggaacacacatgatacttactaaatttcataatttttctgccagaaaactgagatggatgaccctgaagtccagtttcttcataagtgtctttatccagtgacaaaattaatttccctataaatcaaataataactcccataagataccaaaactagaacttacgttgtctgactaaaagaaagcaaggcaaattgagcagttagatatcaatgtaacaaactgcatacaaggatcttatttatatcacaagaatattatttatgtgtatacatgtcttgtaacagatattatttatacattatacatccaaggatattatttataacagtgaaatttaaaataatctgaatttctactaaagatgaaataaataagtcatggtatactcattcttttgaatatcttctttttttttttcagacaatctcattctgtctcccaggctggagcgcagtggcgcaatcttggctcactgcaacctccgcctcccaggttcaaagcgattctcctgcctcagcctcccaaggagctgggactacaggcatgagccaccacgccggctaatttttgtatttttagtagaggcagggtttcaccatgttggccaggctggtctcgaactcctgacctcaggtgatacacctgctttggcctcccaaagtgcagggattacaggcgtgagccaccgtgcccagccgacttttttttttttttttttttacagtatgcatttttttttaacaattaaagaaagatgaaaaaataaagtgttaccatttggtagcagggcaacagtattatcttcatcaatatgtgtattgtatgttagtgcatagcaagaacctggaagagaaagtacagaggaaaaatttaaaacaagaaattacacctgcaagatgttagtggattatttttacaagataaccagtcttccgggtcattaaaggtcagtttctacccctgctccagctcactcaataaaccaaacatctgctaagggtaagctgcagcatgcagaagaccaagcatgcagaagaccaagcatgcagaagaccaagcatgcagaagaccaagcttgcagaagaccaagcatgcagaagaccaagcatgcagaagaccaagcatgcagaagaccaagcatgcagaagaacaagcatgcagaagaccaagcatgcagaagaccaagcatgcagaagaccaagcttgcagaagaccaagctccagctagttcactccctgaccaacagcctatttgtgcaagtttactatcatcaagcaaaaaactgactcagaacggaacgtgacctttggggatgcgcggagaggggtccaaagtagaattctagataaacatacacctctcagagacagagttccaggttaagattcaaaagctacccaacctctccaagcctcagtttcctcactgttaaatgaggatcataggcttgcttcataaagttgttgcaagggttaaatttggtaagacatttaacagtgcctgctacagccattgtccacgtaattcacagagtggtgtcaggccttgaaatacatgaaaggaataacggtgatgagaccggacaagatgcccagctcataagtcgccccagcagtgtcagaatgagaggagctactggtaactagagttcttcatatcttcactggagaggacacacatgggggctaccacaagataagcatgtggccactgtacaggtgacttatgtagtgtgggtggaatccctaaaggccctctgaaatagtttcaaacaaatggctcccaggaatcaactgaaacaaaccagtccaacccagcagatatgggtggaaatggggtgagtagaggaggggttatggctacaaaatctaagcagaagacactggaccccaacaagcactttgctctgtgaacagtagctgtggctgtatcgggagaccaaccctctgagacagctgctgtgggactgctgacagcatagtgtctttgcagccacatcttcaacagcagtgcatctgaacacagattgcaagtctctcctctccattaatcctcattttaaggggacggatactgtcatgttacaacatccccatccaacacttgtggccaattgcaatcggaaaccaccacctaaagagggtacaagaaagaacaggatgagaatgcgggggagaacgcgtgtgcacctgaccacacagactataccacaggccctgtttgaaacaaaacaacagccctagcatcgtgatgtggtctccctacccttcctcatccagccttgttcacagccatttcaggtttttcttacctttctttataaaggtactgatgaattcaggtgtaattaattcatgaagaggtaaattcttcacaaagtaatagggtccagtgttcatgaccaggtttttcagttcttccgatagtatcccacattcaggaatgagaaatgaaacctattggaatgtgtaatacaaacaaggtcttacttccatgaagatgaacacccaggtttttaggaatgaaacaaaatcatgaaagttgttatttctccacgagtttcactggaacataaaaacacgggcaacaaaacctcttatgttaacttacctatctcaggcaaagagaaatctgactacttaagtttttcatttctgcattcaaacgtacagtacaggaaggggattgaacagaatacttttaatggaaaactcgtgcttgcatttaatcttttgcaaattagcaatgctgtatattttatgtcctgttcctttcactattttattttcaaggaaatatagtataattgaatatcccttgatttgtttaccctggtgttatcctggaatgaaacaaactatctgtcggggcataaggaattaatttatggacatccaattactaagaatctatgtgcaagcaatggtgctcctgtatgttttcattttcgagacagaaaaatgcaacaggcgagttaaagtatacatccctgactgctgtgatgagcttgacatccaaaataggtgttaaaaacagggcaggcttcaaatgttgccacattgtaaaagtcatcactgtcccaaggctcaaacaccagcctgttctgactgatcaggtcaccacttaacatctctgaaacactgctcagtcaaacctgcgttattaagctgatccatttaaagtgtaaaatgtttaatcccccatgataaggttagtttcttgaagtctctcagatatcaaattagttccaacaaccaatttagaaaatcagtcgcttcggccgggcgcggtggctcacgcctgtaatcccagcactttgggaggccgagacgggcggatcacgaggtcaggagatcgagaccatcctggctaacacggtgaaacctcgtctctactaaaaatacaaaaattagccgggcgtggtggcgggcgcctgtagacccagctacacgggaggctgaggcaggagaatggcgtgaacccgggaggcggagcctgcagtgagccgagatcgcgccactgcactccagcctgggcgacagagcgaaactccgtctcaaaaaaaaaaaaaaaaaaaaaaaagaaaatcagtcgcttcctgggccgagcctaggcaggatgctctggtgagatccacaggtacgcaggtgggagagggattcaagctggggaggaggcagtggtggggaggaggcgcgagacccgccctgatttggggaaaaagcgaggtgcacgtggctgccccgcagcctaactccctggtcccggccctgaacctcgaatccctccctggactcactcccagttcggcgggttgacacgagtgagcagccagaacgcccctgacaacagctccctccagactgggtaccgcccccacgcccggcgcatcctgggagttgtagtcctgtagccctgcaagccactggctcagagcagttaagagactacaactcccagcaagccgggcgagggccccgcccctccgcgtaccgccggcggccccgccccgcgaagcctagcactctccccaaacctctctcgcacgcggggactgagcacggcccgaaaagccgaggacagccggactcaccctgtagttatagtagtgcgtctgcacaagatgccggtggcgcgacttgtggttgccgaagttggatttctcgcaaaccagtaagtgccgcggcgcctcccgaagccggcgcagcgtggccatgctctcctgggttcctggtcctcccggcctccgctggcggggcacgccccgccccttcctcccgccccgccccttccctccggccgcatacccgctgctgtgcgcccctggcggcggtggagtggggatggcggcgctggatttctgagcagttcttagacttcttaggagcccacgcagccgctctttggtggatgtctgaagctgtaaattcactgtcccagtggctgggaacctggctcttgccttttcaacgccacttttcctccgtccccgccatcccttggaattgccctaaaccctctctgtgggccccgcctcggagcgccccttggaccccagcctggcgccggcgcatacctcggtcaggcccctcagagggaccgcttcctgccaccgttataaaaggaaaacatcgcatggaaaggcccagttcctttagtatatggtcaagaaatgtagccgcacagttaagtaaccccctaagctgctttgggggccacacccagctgctttctgacttctcacactgtttggttcacaggactctgttacccattggggacctcttggccattattaacacaggccaacaggactaaaagtttgtatcagtccttcccaaaacattagggaaggttgtgcgggaaggtaaagcacaatttttgccttacaataggactcctttgaaactactattgagttcccttttaaatagcccttcagaaccgcttttaataatgtgttgtttctgggggttaatagtgataattctcctaagtcatttttccatttcgtttttctgtcacgggcttggagcggttaagagactgcggctcccagcatgcggtacgttactgatcagggcaaaatcaagtatgttactacatgcttctcaaactagagaggcacagccccaattctgcactggcaggatacaaaacagcagaatattggtgatacatcttcc

SEQ ID NO: 12427 - DNA, 137046 bp, Human
  misc_feature (1)...(137046): n = A,T,C or G
cactatttagccatgagctcaagctagaaagtggccgaaattcatgtctctgtagtgaatccctcattggttacgaatagcctcatagagtttgatggagttttgaactgttgcattagatcacacaatttgaccactcaactcagcaccaagcctgttcattttggataggtgaggccactttagccattttatttctacaaatagtcactatgttataattatttggtttcacatttctcccctgtataaagagttgggtagggttgtcttgactaatccatcttatgtggtcctggcccagcaccaaacttaataaatgtttgtattaggttgaactgtataaaaatgctgtgtttgtaagtcaaaaaatagtcaaatatcagcaatggtcaagtgaataataagaaaaattcaagcagtgaatgactggttggactagatgattttaaagatctcttccggttctgggatttcatgaccttataattcaaacataaataacatcatcagtcagtttcaatacttagctaccaacttatgaaaccatggtgctcatattgtacacaaacctggcaccctgttcttgtctttcttggaacttatcacagtgatttagctatttttatactagatgactatgtgctcctcattttaatgtgtataatacatatctaatgtgtaagatatataatacatatatacataaatataaatgggtagatagatgatagatacagtgtatgtgtttccatcagctgttaaaaggtagatgatagattaatactgtgtcattttcatgtctcttctgttctactgctttaatgtggcaggtggagtccactgtgattcaaactatgaattttttcattgatcaattctgacatgctaacctcagcaactgagcacctgcataatatgttaggtcatcatattaataatgaagattacatagttgacttgcctttttattgggggaatatagaaaaaaaccctagaaatatgactgattttaaaacaaactaaaatgatgattgagaacagtaatactatctataatttcattgcatctagtagaaaattagctttggaaagccactcagtttataaaattgttttgattattctttatttaaaaaatgaagttctcagttttaatctcaacaggaaatctcttgattacagcagagcagatttttatctgtcaataagttaaaaaaattttgaggaggaaatcaggcatcagcttccaggggtctaataacttcctaacttaatgggacttgcctaacagtagatgaacttttcattttaagactttgcctttagtagtcaacactgtcctcagcacagctacagactatataatacagagtccatacaatacagggcatttctgtatgaataaagtattaaatattttttaaaaataacttttaaaaaatgaagttctagcctaagacctgaattaagggctttagggaaataaaaactttgttccttttctaaattttagatatttccgttatggtaagttaaactgatcggtttaagaaggtagtttaagatagtaatgtatatgtgttaacaggcttctatctctgcgtcagctgtaagatttacctggtttttatactctgaagagtttatatttaaattcaacataataaaacattcaaaataagaatctctgaacttagttttattttagactgcttttgaaaaaatcacttcttaaagtgcacagattcacacatccaccctcccatcctttgtgatagaaaaaatgaaatacttagcttggtaaatcacattgcttctcctgaagtagactgccttcacccagtgctgtgaaagaaagcccagtgagtgagtaaggaagggtggctattgtttagtgctctctagcaaaagaatgggattgggggcggggttggggcgaggattgagtttaactggcattggctctggcttttctgcattccaaactgtctgaggcacgaaatgagagcaaaaagggagagagcaggaaagcgagcacaggcgagtacagtatacaaagtgttttgagtttctgactggcgtgccggaaagatcatgttagcacacccagaaacttcacacgatgcagaccccaggtaagagtttgtagagtctgagaccgaaatgaaaagtcacgtatttaaggggaatgtggctttttaaaaattacacaaatgcagtgactatttacctttatgattattggctttaaaaaaataggttggtttttattgctgtgagttcacagaaatactgtgtggaagctgtctgttagcattccagtacaaaatccagcacaagaatagccatctaagaaactcagataaattaaaagaataatgaccatagcaaaatattaacactgcagcatgtacttgttctgttaataatatgaaatgggtccttattctggatctttcttaaaattctttatgaaatataaagatacctgggaacaggtaaagctcatttctctctgagtgagacagaatatattgaccatcaacaagatattaacagccttgcttgaatctcagtaacacataatctgtgtcattcaaaagtttaacaggtttgatccatagacagcagtaagagcattcaaatgagaactttgcttgttatttttgcccaaggtaggcttttaatatcctctgccaagatgacaggtaagaaagtttattgacttattgaaagttaaatctgaaagagacttggagattatctatagtctattctctccattttcaatgaaaattttgtggtctaaggtacttgcccaaggtcagaattaggaacagaattgaaatgaaaacccagatctccttattgtcagtttaacgtgtttttcatagaaccaattatatataggcttatattttctctatactacatctgctagccccaattacaatgaattattgcctaaatagaccaagtacatcataaacctagattgaaatcttatggagaggaggtattgagaaatggatgtcatcaaatcactattgatacatgctcttgaccaaaaccaaaaacatgtaacaaaatatttatcaagaggaaaaaatggctttcagtgaaggaaaattagtttgtacgctgcttttaattttttaaaagactttaggacatcaattttctgtataaatatgttagtaaacttttttctgtatgcaaatatctatttttgtaatgtatctgttttactgaaagcaaatcgtattcactgcctttgttatgtttattcaaaaatataagataatattttaaattatccagctattttgaccagttgcttccttatccaaggtccatttctgtttctccctgcttataaggatcgtctgttacttcacctcatgaattatgtgttagcagataatttaagtgaaggatcttgagagccgcaacagacagtgaacatctgtcttcatacattttcatttagtgcctaaaaaaggttgctgccctttccatttttctggagaccattgtggggatgagaggccacactattctagtgagctaaatagtaaagatagccactgtcaacagaatctgtcatggctctttacaactcctgggaacaagttagcttgatttggctataagcacagtaaagggatgttgtccttttgtattaaagcctgacctgctctttccagtttttggctgggtctgtgtaagtgtagtactgacttacaagtctgtgtggaatgggcagcaagttataaggaatagtttcattactcctctcggctatatcggaaaccaaattaccaagtgaattctccacccagtaggaaagaagagactgtctgtcttactggagaatccattatttaagcactgtttttaagaggactgatggctgtgagaatgaggacattaatgctctatccaacttaacagtattcatgttgtattacacaaagcttagattcttctctgagcttttatcctgcttttaatatgtgaaaggactgccatgatatatctatgtatattatgttgtgtgtgtatattatatgatagaatagagagtaaaatgggcctttggcctgagtatattttctgatgccagaaatgatcagaagtcattaatctattgctggtattttactgacctaagttaaaagaaactattttattaaccaagctaatcatgataaaactcactaccatgcactacaaagagaaaaatactcaaaggaaacacacttcttttttaattctgaaaacaaatgtcagattatgcaggttcataccttccgtgttagaaaaaaaaaacaataaaaaggtgcccactttgtggctaaagataaattttatttttaaacaagtttttattggtgtataatacatgtagatagttgtgggattcatttgataatttaatatgtttacacaatttggaaagatcaaatcagtatacttgggatacccatcacctgaaaaggagacaaattttaaatgggaatagaatgggtatagtgaaatgagtggcataaaaaagaaactctcatatgtatgtgaaataattttcttttgaccagtgttttcttgaaggcagacctattttcactattcatgattttctccttgatactgttttaaaattttttcccatgaacaatctatatataaatattgtttatatattaaattttcaaagaaggtaaagagctctgctatgtaatgacaacattttctgaaaaagatttggctatagttgatcaaaacttttgactcattgaaaggaactgctttctttgctgttgcaatttctttctacctcttgggcataattctatgttatgtgtcccagttaaatccccaagaatgaaatatcttcaaagaaaaatgaaggcaaaagataggggccaggagcagggacttgaagctggacatataaattgttctgagatgtcaaattaattctttactcatgaaagttacccagttatccacccaagactccaagagtccttttatgtagacaacacgattgtgtttgcccttctgctccagtcttgaccttcagcagtctctaaagaggaaaagtgtttgttacagactctttttgttctcttctgttgtttcacgctccctagtggttgttcatggtcattcttgttttcagttccctgtatatcagttgtagtgagaaggagaaggaggtgactattgtattgtgaaataaggttcaccggattcttatatttgagttgcataaactttcttaaaataactgattcttatatgcagaatcagaagcaaaaatttttgtcctgttgttcctagtggacaatgattcaagaaaatgagtcatgactcagcgatatgaattctcttttagccggggttatttttaactgctgatgggaattccatctatcaaaattccacatttaattgtgggtatgatctcagcttgtgtttggaagccttaagcaatgccactcagaatactttctttgtacatacttgacaagtaagagagacttactgagtcagtgattaaaattcagatgaaggcctttgtcctctctggtaccctccttgcccctactcaaaccgtgtcattaagctgaattggaaatactgttaactcaagcacatgaagagggaaccattgaggagatcctgttaataatacgactctatagaactccacatttctgtcattctcaggtttgcaatattttttgagtaaatgagttgctgaaaaacaccttgaaaaagtagtttaggtttgtgcagccctattctttgaagaagaaaagatacctggttctgcttgctctttctaatgtcagatcttggaaaataagcaacttgagctgctggaataaagcaggtgtcgttcaggatcaagtgttgcctaggatagctagcctgttagacaagttgctaactgatgtcctgaatccaattccaaagattacggagtacctttgaaaaatgttgtaacagcactgttgtgtaactattcgtaaatactacctttagtttatatgaagattagtaaaatgggtattctttccatttttaagattctggtttgtaacttttttgctaaaatacttcaagtgggttgtgtgtgcctctcgagtcagatcagagaaggtaagatgtctgggtccctacttcaatcactcttctttccaggaatacctggaatatgaagtttcaggtaaataagtgaagtgaaataacaaagagaagtgatttgtcaaaatgagtgcaagaagagccaccaaaaatctagcttgtgtgagtacatagaattgagtttgttcagtcaaaggacaagggaagatgtgataagtctattaacagggaaggataatcatctcctgtgtaccaagagctcatttcgaagagtgtgtccagtatgattatagaatatttcttatcagtattttctcaaagtatgggaaactaatccctcaaacaaagggaaatagattatttcaatgctttcaacatgtggtagaggaattgcatcacacagtatttggcctgctttatttatgaatctctattgtacagctgaaatttaaggagtttttttattaattgaaatattttatctttcatatagtttgccacatcagccaggttcagtggctcatacttgtaatctcaacactttgggaggctgaatcaggaggattgcttgaggccaggcctggcaacatagtgagacctcccctctacagaaaatttaaaaatcagccaggcatcgtggcatgcacctctagtcccagctactcagaaggctgaggtaagaggattgcttgagcccaggaatcaagactgcagtgagctatggtcacatcactgtactcccgcctgggtgacagagcaaaaccttgtatctttaaaaaaaaaaaagaaagaaagaaagaaaagaaaagaaatcgctatatacatcctgatattttccttgaagcatttttcctccacctgaagtccagtgaaatgtcactgtagtttcctgaaacaataaatacgctattatatgagtagcatcatttacttgctggggtataattgctgaaattttgaaatatgcttttagtatgttaagttttatttatttccttcccctataaaaaacagcacttggaaaatgattggtgatcaacttttaaagataattttttaaagtagctttttaaaatcaattaaacaccttaccattctcttctcatctctgagaaatggtatagaccatttttattaaccaaaaatatagtataaagaagaaaccctaggagttaactgctatcattacaaggaatgaaaactagtctcccttgtaaacattttttagcttatgcaagatcaaaatgtactaggcagaggaaatttattgtaatataaaaggtagaagtctagtggaagtatagctgtttgtccccagtgcctcagtagaactgtttaggtcaacacttgatgacactgctttattttggttttgtttggtttttttaatggaagggtatttaaaaccagaagccaggctttcatctggtcttttttaaaaggaatatccaaacaatgatttacctgtttttctcagaagctatcttactgtgaacaaattgcaaaatgtatttgacggtgaaattttaattatcaagaaatagtgagcttgaagggtgtgactattgccataaagtgctgtgatttatgacagcttcccagtagaaattctcccagtgtcagaaattataaacccattttcattttactttgttcttgaattaaatatttaaaggtagaatttttgtttctctttccccctatcagacctgtgtgacgggagaatagaaactgttttaaggctcttcagatttagttcagatgttgcttatgttacattttctctgatagtctgaaaaaataaatttttaaattttaacgtttgatcataatatataacaggctcctacacatcagtgagaaaaaagcaagactggaatgctcattttacaaaagaggtaatccagatgaccatttagtatataacaaggtgtgcagctattgttagtcatcagggaaatgcaaatttaaaccaaaataggattacatacccatcaaaacgtctaaaatgagaaaaaagaaaataccaaatgttgataagtatctggaacaaaaatagttttcataccatattgacgagagtgtaaacttgtacagttactttgaacagctatttgacaatatctcctaaagctgaacaatgctcagtgacccagcaattacactcctatttatgtacccaatagcaatgtatacctaggttcatcagaagacctgtacaaaaatgcttttaacagcactatttataacagctaaaaatttgaaactacccaaatgctcatcagcagtagaatgaataaattgtggtttgcttataaaatggaattctatacagcaatgaaaaagaacaaaccactgcttcatgtgacagaatgcatgaacctcacaaatgtatgttgagcatgaaaagtctcaaaagaatactcactgagtgattccatttatatagagttcagactgatctagggtgatggaaatcaggatagtgattatccttatgggggtaataactgccaaggatacataagagaggcctctggctgctggtgatgttctgtggtggtgttgttttctgattcagatgctggttactagcatgaattacatttgtgaaaacttattgacctgtacatatgttatttgtacactgctcttttttctttttctttttttcttgagacaaggtctttctctgtcaaccagggtggagtgcaatggcccaactaatcatagctcattgtaacctcaaaccccttggctcaagtgattctcccacctctcagccttctgagtagctgggactataggtgcacacgactacacctggctaatttttaaaattatttttttgtaaagatggggtcttgctatcttgcccaaactggtcttaaactcctggcctcaagcagccctcccatcttggcctcccaaagggctgggattacaggcatgagctaccacgcccagcctgtacacttttctacatgtatgttatacttcagtaaaaagttcaaggaaaatattcctattataagcgctccagtttgcaaacaaacaaaacaaaaacaaaaaactctaggcaacttccaagttgatggaagtgatgttctgtaaaagtccttttttgtttatggagaatgtgagcaggacaccaggtttctttcttttctttttggttttttttttttttgagatggagtctcgctctcgcccaggctggagtgcagtggcgcgatctcggctcactgcaagctccgcctcctgggttcatgccattctcctgcctcagcctcccaagtagctgggactacaggtgcctgccaccatgcctggctaattttttgtatttttagtggagacgggctttcaacgtgttagccaggatgatcttgatctcctgacctcgtgatccacctgcctcggcctcccaaagtgctgggattacaggcctgagccaccgcgcccggcccgacaccaggtttattttcatgttgaaagttctccagtctggccggacgccgtggctcacgcctgtaattccagcattttgggaggctgaggcgggcagatcaccaggtcaggagatcgagaccgtcctggccaacatggtgaaaccctgtctctactttaaaaaaaaaaaaaaaaaaaagccaggcatggtggcgcgcgcctgtagtcccagctactcgggaggctgaggcaggggaatcacttgaacccggaggcagaggttgaagtgagctgagattgtgccactgcactccagcctggcgacagagtgagacttggtctccaaataaaataaagaaagttcaccagtctatgtgtgccatcaaggactttacatttggggtcattgaataggttagatgaggaaagcatttgggaaactaggcttgtggatgtatcctcaaaacaaaatttcatcatgtaaataatagaatttctaggctttctaaagctctgagcttactgtataaaaacactaatctagtcataccttaattgaaaatattttataatagtaatatatataaaaagatatatatgtactcgtacttaacacattaacttttacatatagttactaaagagttgatgatacaaatttaataagaattttccatactttggctttaatataattttgctttaaaaatatgtatttggacttttaaaggatgtgtaattccttgttatattggacgaaaaataacagctttttcatcattgtgaaatgtgaaaatatccaatacaacaaatggaagacgcctaataaatgttaatatccttctttgtctttacaaaactacaaacatgacatactcttgaacatgcccgtcttatcttctcagattaagctctgccacctgtgctgttcttcctgttctgaaccattaaaacacatgtgtttagttttatttctggattcttctagagcaatcttcttcactagttctttcatatcacttgttttactcaaacttgatgttttaatgttagcatattatttatttgttgctgtgtaaaaagttaccacaaacttggcaagtgaaaacagcattcatttaccctgtcccccagccttctctctctctttctctgttgagacagggtctcactttgtcacccaggctggagtgtgcagtggcatgatcatggctcactgcagcctcaacctcctgggttcaagcgatcctctcgcctcagccccccgagtagctggaactacaactgcgtgtcaccacacctggctaattttttgttttgttttgttttgtttttgtagagacagggtttcgccatgatgctcatcttggtctcaaactcctgagttcaggcagtccgcctgccttgacctcccaaagtgctgggattacaggtgtgagccaccactcccagcctatttcaatttctatacatcagaagtctagggagagtgcagctggttctctgctcagggccaaaacaaacatatcagccagaccacactcgtatctggagctcagagtcctctttcaaacttgttcaggttgtcagcaggattcagtttcttgcagtggtaggactgagatccctgttttttggcttgctgttggcaaggagtcactcctagcttctagaggccactgttatgtcccatttccatggcccccttactacttggcgcttactttttcaaagccagtgagagaatcttactctggttggatgtattagttcattcttgcattgctacaaagaaatacctgagactgggtaatttataaagaaaagaggtttaattggctcatagttctgcaggctgtacaggaagcatggcatcatctgcttctggggaagtctcagagagcttttattcatgacagaaggcaaaacgagatcaggcttcttacatgcaggcaggagcaggacttgggtgggggagatgctacacacttttaaacaaccagatctcatgagaactcactatcctgatgacaggaccaaggttgcatggtgttaaaccatgagaaactgcccccatgatccagtcacctcccaccaggctccatttcccgcattagggattataatttgacatgagatttgggcagggatacagatccaaaccatatcattccacccttggccccttccaaatctcatgttcttctcacatttcaaaatacagtcatgccttcccaacagtccttgaagtcttgactcattccagtattaactcaaaagtccaaaacccaaagtatcatcttagagaaggctagtcccttttgcctatgagcctgtaaagtcaaacacaagttagttacttccaagatacaatgaaagtataggcattgggctgtaatcccagcactttgggaggccaaggtgggcggatcacgaggtcaggagatcaagaccatcctggctaacacagtgaaaccccgtctctactaaaaatacaaaaaattagccaggtgtggtggcgcggctgtagtcccagctacttgggaggctgaggcagaagagtggcgtgaacccgtgaggcagagcttgcagtgagccaagattgtgccactgcactccagcctggatgacagagcgagactctatctcaaggaaaaaaaaaaaaaaaaagtgtaggcattgggtaaatactcccattccaaaagggagaaattggccaaaagaaagcggctacaggccccatacaagtctgaaacccagcagagcagccattagcccttttcccatttagaaaacaaaaagtgcagctcgctgccagtgctcatttaattttacataaacatactctttgaggctgaagcaaatctgactgattttcagtgtgaaaacaaaatataaaaactgttcttggagttatttctaaatagaactaacatcagaatcatctgaatcatcagaattgtctatttcagaaaaattgaattcatcaaaggaatctttggccaacaactgttccagaatgatgttaacatcacacataggaatgctatgttttctaggatttgacatttttagcaatcgagaattactatattttgtaagtggaaataccactactaaaaacagaatgctataaatagaatgatgtcttttgttttcaaagttgatatactagagcagtgtgaaaataataataaaaatgagatgttttgtggcaaagttatcttggggtaaatgctgaaactgcaagctttgccagcaagtattcttggggcaaacaggagaagaattaaatcttaaggctccaaaataatctcctttgactccatttcctacatccaggacacactgatgtgagaggtgggctcccaaggccttgggcaatccattcctgtgggcctttcagaggtcagcccatgtgctgttctcttgggctgttattgagtgctggcagtttttccaggtgcagggtgcaagctcttggtggctctaccattctagagtctgtaggatggtggccctcttcttacagctccactaggtagtgccccagtggggattatttgtggtggctccaaccccacatttgtcctctgcattgccctagtagaggttctccatgagggctctggccctgcattaggcttctgtctggacatccaggcttttccgtacattctctgaaatctaggcagaggctcccaagcctcagctcttgcactctgtgtacccacaggcttaacaccatgtatttaaggctttcagcttgtactgtctgaagcagcagcctaagctgtacctgggtccctttgagccatggctggagttagacagctgggacacagagagcagtgtcctgaggctgcatggggcagcagaccctgggcctggcccacagaaccattttgttttcttgggcttacaggcctgtgatgggaggggctgctgccaaggtctcagaaatgcctgcaaggccttttccctagtgtcttggctatcagtacttggcacctttttacttatgcaaatttctgcaacctgcttgaattcctcccctgaaaatgggctcttctcttctaccacatggccaggctgcaaatttttcaagcttttactgtccatttcccctttaaatataagttccagttttacgtcatgtctttgctcatgcgtatgagcataggttgttagaagcagccaggctacatcttgattactttgatgcttagagatttcttctgccagatatactaaatcatcacgctcaagttcaaaattccgtagatccctaggacaggggcagaaggccaccaggttctttgctaatgcataacaaaagtgacctttgctccagtacccaataagttcctcatctccatctgagacctcttcagcctggacttcactgtttatatcactatcagtattttggtcacaaccatttaaccagtctctagggagttccaaattttccctcatcttcctgtcttcttctcaaccctccacactcttccagcttctaccagttaccaaattccaaagcttcttacatattttaaggtatctttatagcagtgcccaactcttcagtactaattttttggctatgatgtaatccagtataacacaactgtaatcatgatagtgactatacgtcaccttggccatgtaatgtaacctaatcagtggagtggctatcccatcatattacagattccaggcccctgagggtagagaattatacaagggtgtggtggctcatgcctgtagtcccagctgctcaggaggctgaggtgggtggatcactggagcccaggaggtcaaggctacagggtgagccaagattgtgccactgcactccagcttgggtgacaaaaatgaaaccctgtccaaaaaaaaaagaagaaggaagatacattttcaaattacaaatttttttcagtaaaagagactacacacatcagctacttttataccacctagcaatgacacatcatgaaaggacaattacagggagttttactcattattatagttccagaaatcctaaaaaaaatattagcaaatggaataatacattatgactaaagttgggtttataacacaaaatgcaaagtagatttaatattagaaagttagaatagtttaccattaatgaactaaaggagaaaaatcttaaaatcatctcgattgagcaaaaatgacatttaataaaatttaacaactattcataagaactcttagcaaaacaacaatagaaaagaatttctttactctgattagtgatatctacaaaaacccatcgacaaatatatgtaatggtgaaaagctttcccttttagatgaggaccaaggctgggatgtccattattatccttgctattccacattgtattggaggtctcaatcaatacagtaatcaatacagtaaggtctcaatcaatacaagaaaatatgtaaggattagaaaattaaaacttcacaagtgatgtgatcatttagaaaatccagtaaaaactttacaggcattgagtttagcaagttgctagataacaagatccataaacaaaacctaattgcatttccatagatcaacaataaactgaaagcaaattttttgagatactgtttacaataacaaaatgtaataacctaggagtaaatcttttaaaagatgtgtaaaacatctaaaaagtaaactataaagctttattaggagaaatttaagaataatctaaagtagatatatactacgtttctggagttggaaaactggtttgtatggtgttaacttttaccctaaattcctttatagattcaatgtaattccagttttaaaaatcttgtgaagcctgggcaacatgataagccccatctctacaaaaaatttgaaaattagctgggcgtggtggcacatgcctgtggtcccagctacttgggagactgaagcagggaggatcacttgagccaggaattctagattgcagcgagctgtgatcacacccctgcactccagcctgggtgacagagcaagaccctgtctgtctgtctttctctctttctttctaggtatctatatatttgtatatattaggatagccaaaaactcttttagaaacctaatttaggaggacttgctctgtcagctattaaggctctttataaaactatattaattgagacaaagtggtattagtgttagaaatagaccaatggaacagaataaagagtccaaaaacagacctgtgcatatatgtacattttacttatgataaaattgacactgcagagtggtggggaaattaagatcttttcaataaatgatcctggctcatctggagatccatatggaaaaataaagtggaagtggattatttcttaacaatttacataaaaatgaattccatctaaattgtagacctacgtgtaaaacaccaaatagtaataataccacttttagaatatattatagcatcttcatgacctgaggataaagaagtaattattaaatcaaatagaaaaagcaccaattataaagaagaaaaaggtgataatgtttattaatattaataacttctgtttgtcaaaagacactactgaaagtgcaaaaagtcaagctatataaaccaacaaagaaattataccagaatatttcaagcatcccgacaaattgagaaagacaaagcccaatagaaaaatgggcagagacttaataggcacttcacaaaagaatataaccaaatggctgtatacatttaaagaggtgctcagccttatcaaggaatcccaagttaaaaccacaacaatggggccaggcgcggtggctcacgcctgtaatcccagcactttgggaggccgaggcaggtggattacgaggtcaggagttcaagatcagcctggccaggatggcgaaaccccatctctactgaaaatacaaaaaattagccgggatggtggcgggcacctgtaatcccagctacctgggaggctgaggcagagaatcgcttgaacccgggaggcagaggctgcagtgagccgagattgtgccactgcactcctccagcctgggtaacagagcaagactctgtctcaaaaaaaaaaaaaaaaaaacccacaagatacccccacataatctccagattggctaagatttaaaatcagatgatactaaagttgtcaagcatatagagcaatgggaactcctacattgctagtgggagtaaaaacttgtacagtttcattggagaacactttagcattatctaataaaattgaaagtaatgctaacccaacataaatacatgcttatgtacatgaggatgcatgtacaagaataaacaagcatccataatggccccaaaatggatacaacctggaaaaaaatcagtaaaatgagttttaaaaaagtgacatcatcatgtagtaaaatgaacaaactacagtgacacacagcaacattaataaatctttaaaatataatatttagtaaatcaaactaaaaagtatatcttcttatactatttatataaaattcaagaaaaggaaaaagaaaacatgttgagatatgcacatttcagtgctaaaactaaataaaagcaaggaatgtttaccccggaaataggtatagtggttatctatagggtgaaaggaattgggatcaggatggagtatttggggaatcatttgttgcagacaatgttctaattcttgctatggcggtattataattcattaaactctacatttatgttttatgctattctctgtggggcatcatatttcacaataaaataaaggcatatattgaagacatttttatttcatcatatctatacttgttatccttaaaggctgcatcttattccattgtagatttatctgttcccctccttttgaatagttggagtgtttttgttttttgcagttgccaactttgagttaagcatctttgtacatatatctgtgttcatttgcttgtgctggtatttctgtaggattggtttccagaaatagaatcaaaagataatttgcatttcatattttgatagatgctgttaaatagccttgcaaatttgttcagcctgtcttttgctatttgaagcttttaattttttattgttcaatctgtctctcttttccattgtaatttctcgcttttgtgtcatgcttagaaagcctttttcaacttcagtttatgtctttatccggaatttatttttggttatgtgaaatgagattttttttcagccatatagctagttgtttcagtgcttttttttttttcgaatggtcagttctttgcacagtgatgtaaaagctaccctttatcatcagctaaatgtctatatgtctttttctactctactgatctatttctatatcaatgtcacagtattttaatgattatagattttaatgtttttctcttactgatatagggaattctaattagtttttcctttcaaaaggtatttggccttttattcatgtacttacttttccaaatgaatggtagtatcaagtccctctgtactctcagccaaaaacaaaaaacaaaaaacatgtgttgacatttcagttggaattacaatgaatgtatagattatttgggagataatttactttcatacacatttttaaattttagtcatttttaactttatataaagagcatgttttatatattcttttgaactttttccatgtaaatattatattactcatatctctccatatttttgctatagtttatttgactactgtataatttttacattgtttgaatataacaacaaatttagattaagagttgtggttggggttggtattcaagttcagtctcttattgaagtatattttttaaacaaaaaacaaggccaggtgtggtgcctcacacctgtaatcccagcactttgggaagctaaggaaggcggatcactggaggtcaggagttcaagaccagcctggccaatgtggcaaaacccagtctctactaaaaataagaaaattagccaggcgtggtggcatgtgcctgtaattccagctactcaggagaccaaggcacaagaattgcttgaacctgggaggcggaggttgcagtaagccgagaaggcgccactgttctccagcctccgtgacagagtgagactctgtctcctaaaaaaaaaaaaaaaaaaaaaaaaaaaaggaaaggaaacaaacaagaagtattgactataaaagactggtggggttggccattatattaaaattataaacttctgtccatctatagactttaagtaaagaaggtaaaaagaccagttagaaactgagaaatgatattcacaagacccacaatttttcacaggattactatcaaggacatacaaagaactgctatctattaataggctgagcatgaccaactcaatagaaaagtgggcaagagatataaagaagactttcacaaaagcataacatatatacccatagacttatgaaaaatgttcggtattactggtagtcaggatatgcaaaatcaaccatcttatcttcattccatgagaaacactaaaaattctgacaataccaagtattaatattgagcagaatgtagatgactcaggatttcatatatcctgctggtgggaaaaagtttggcattgctgaagttgaacatttatataccctaagcccagagattctattcctatgtatataccaaagaggaattcctacaaaggataaaagaagacatttgcaaggatgttcacagcagcactgacaccaatagcaaaactcttaacaaaggaaatacaatatacttcaataagagactgaacctgaataccaaccccaaccgcaactcttaatctaaatttgttgttatattcaaacaatgtaaaaattatacagtagtcaaataaactacagcaaaaatatggagagatatgagtaatataatatttaaatggaaaaagttcaaaagaatatataaaacatgctctttatgtaaagttaaaaatgactaaaatttaaaaatgtgtatgaaagtaaattgtctcccaaataatctatacattcgttgtaattccaactgaaatgtcaacacgttttttgttttttgtttttggctgggagtacagagggacttgatactaccattcatttggaaaagtaaatacattaataaaaggccaaatacaggattttgtcagttgccttttcagcatgtactgatataatcattttgtttttaccttttaatctcttaatacagtgtcataatgatgttgtattaaaatatttattcatttctcccaagtcacaaaagtaaagccaggaaacttaaatatagcaggtcattgaaaatacaaatttgttctttgcagtattcttaaagccttagaattttttgtgttttgtcatccagcataccgaccttgtgctcatctttttactctgcttatctactttcattttacaaaacatcattttggaatttcccaagatacttaaatttttattatttattaactatgtgcagaaaaacttggggtctctcttcatgccagctaattacactactgctgtaaaatgaagatgcaattagggaaagcaaggcagcaacttactaccatttattctatgctgtagtcagatgatgatggtgaactctgattttgttataaatgactgtagatctttgataaacctttgatgttactgttgttgaattaatttctcctgtcttacagcggcctctgttgaccccaaaccttaagatctttttagcgtatgagaccttaataaatgatagaagaagaaaaaaaattgtgtttgcaattttgtgatttttttaacatatggactcacagattatataagcttcaggtcccacaacacatgagtctgcctctgggtgtaaggggtgaagagtgggggttttatttaccccagttcttgcccacaattgtgctatcactgctagaaagctgatctctatgatggggagccaatcgttgtttactttactttcagtaattaaagttaatttaatctacttgattaaaattttatctcatatcctatttaactccacccccaaccccaccatggagtaggagatagccagccagttctttcactcctccacccctgctctaccctcttcaacttctaacccttctggcattggagtagggagacaggattggagaaaaggtgttctggtctgatgccacagtttttacttagccagacatgaaattacaagcccctgttggttattgttgcttctctagctaacattggccgtgaatttgaatgccttctgcgtgtgttccagtgctggttctgttacaggtagaagggtgcaaactcttcagaggggcccataggaagcttccctactgaatagttctttggtgttggagatccagcatccacgatatagacctggttctcttttttggtgtctacttagctcatagtaatcaactatatctttcctttgcattcttgttcttccagtcagcaaggttacaggctgctccactgcagcaccttgttcagggttttattttaccagggctgctataacaaagaaccactgactgggtggcttagacaacagaaatgtattgtttcacagttctggaagttagaaggtgtcaacggggttgtttccttctgagggctgtgagaacgaatctgttgcatgccttttcacctcgcttccagtgggttgctggcaatgtttggtgttccttggtttgtaggtatgggtgggaagaaaataatagagttttatccctttggtttttatctgaaataaggaaaagtgtacttcactaatatttgctttatagatttggagcccatgtatgtcatttatgaataaatatactagagatatgaagttaaattttctattgatataatatttaagaagtatagaccatgagcttcttgagaacaaatctttttctaatttgtctctatattccacaaatgtgatgtattttattgtaatgttaatgaatttctgaggtagataataatgtagttctgtaaaatagttctgccatttaaactcatttaagatcaaatagggcatgctttacatatctgttgatgcaactgttttgtccaactacagccgaatttacaacagattcaaatactaaccagaaggaaattaatgagttgattgtggtatttttttttcaatcagaagtgttttctggatacatctagatacagtgttgtaacaatccaggtgataaatgtattgaacattttttataattgtggtttttaatgtaaaaaaagaaaggtatgaaaacccttgacttttttttgagttgccaaaacatttctgtaataatgtatacattctccatagctattagtacccgttagctttttttaattgaacagttggcccttcatatctctgggttctgcatatgtgtggattcaaccaaccatggatcaaaaatattcttaaaaaaattgcatctgtactgaacatgtacagacttttgttctcatcactattccctaaactagtgctccccagcctttttggcaccagggtctggtttcatggaagatttttccatggacaggagggagtcgggggtgggggttggttttggcatgattcaagcacattacacttactgtgcattttatttctattattattacattgtaatatataatgaaataattatacaactcaccataatgtagaatcagtgggagcctgagctcgtttccctgcaactagatggtctcatctgggggtgatgggagacagtgacagatcatcaggcattagattctcataaggaacacgcaacctagatcccttgcatgtacggtttacaatagggtatgtgcttctgtgagaatctgatgccaccactgatctaacaggaggtggcgctctggcggtaatgcttgttcatctgccactcacctcctgctgtgcggcctacttcctaccaggccataaaccagtactgctccgtggcctgggggttggggacccctgccctaagtaatatagtgtaataactatttacataggatttacattgtattaggtattacaagtaatctagagatgatttaaagtacatggaaggttatgcataggttatatacaaatactgtgccctcttttatcagggatttaagcatccatggattttgatgtctgtaggaggtcctggaaccaatcccccatggataccgagagattactgtgtatgacttaaggtctataacatgatgttttgatatacatagtgaaatgattactacagtccagcaaattaacatatctgttatctcatatacttctctccctccctccttccttctctccctccctccctccctctcttcccttctcttttccttcatagtaagagtatctaaaatctactcccttggaaatttccagtataaaatattattaaccatagtcctcatgttgtacactagatctctagatttagcctacatagctgcaaactttataccctttgacctaattcttcccattttctctgccccaggtaaccagtattctgctctttgttgctatctgtgtatttgttgttgcattttttggtttttcattatgttttttttttaattccacatataagtgagatcatgcagtgtttttctctgtgtgtctggcgtatttcacttagcataatgtcctctaagttcattaatgttttgcaaatggcaggatctctctctttttcaaggatgaatatttcattacatacacacacacccacatcatagtttctttattcgtcaacaggcacttcagttgcttccataacttgtattgtgaataatgttgcaatgaatatgggaatgcagatttttttaataagattgtgatttcatttcctttgagtagatactcagaagaggcgggattgcagggtcatattactagttctatttttaattccttaagaaacctccatactgttttccacacgggctgcacaaatctgcatttccaccaacagtgtacaagggttcccttttcctcccactcttactaacacttgttatctcttgtttttttgataatagccatcctaaaaggggtgaggtgatatcttattgtggttttgattttcattttcctgatgattagtgatgttgagcatcttttcatatacctgttggccatttttatgtcttttgagaaatgtttattcaggttctttgcccattttttaattaggttattcaattttttggcattgcatcgttatatatttttgatattaaccccttatcagatacatggtttgcagatattttctcctaatgcgtaggcctccttttcattttgttgattgtttcctttgctgtgcaaaaaaaggctattaacttttatccggtaccacacgtccaaagttagatttaaattaacatagttttcattgtaaaattagcaatggtaaatttgtcgaagcattaaacagcctcattaaatgttcataggagcaaataaccatgtcaaataccctgttcagatatggaaaaattttgctcatttaacaaatattaagcacttactatgtgcccagcattgactaatgttcagtgaaatccttttgttaagagattcttttgaaaaacaatcagactataaatattatttattggtggaaaagagtaaaacatctatatgctataaaaaggccgggtgcggtggctcacgcctgtaatcccagcactttgggaggctgaggcgggcggatcacgaggtcaggagattgagaccatcctggctaacacggtgaaaccccatctctactaaaaatacaaaaaattagcggggccaggtggcaggcacctgtagtcccagctactcgggaggctgaggcaggagaatggtgtgaacctgggaggtggagcttgcagtgagccgagatcgcgccactgcactccagcctgggtgacagagcgagactccatctcaaaaaaaaaaaaaaagaagaaactatggggtctggcctttttatttggccactaactctctggattcctacacaatttacttaactctgttgtagtgtctcagatcactgatcaaggaaaagagttttacttctcattaaataactgttcaccttcacccttcatacctcacccaaaatatctaaaaatgttatggaagaaattccaatatggaatgtagttctgagtgtcggctctggaataagaatatctaagtcttcacccaacctccaatactggctatatgacttcatcacttctctaaacctttgttttctctgaaccttagtttacttaactataaaatgggaaaaatgttactacaaccttgtagggttgatatgaggagaaaatgagaggttaatagcacctcacgtactacctagtacattgtaaatgcagaatacatttgatctattattattgttgctacaagtattcaaattattgctaggcctagtgacaaattgcaggagatgttaccctaatgattttcagtttacttacagagcagtgctaatcataggtatattgggtttatatatccatctatgcatctactcaataaatattaggtagctactatttgcttgatattttgttaggtgctaaaagtgataggctccaagaattgtatatactatgagtaaaatgtaaaatataactttatattaaagaaaaaatatttcaagaatagttatgcattagctactttctgggtctttttgagaaggagttatctgttcattaacaacagctgtcactgtatttactttttttttcttagaagaatagctttagtatttaaagaatctgattatctttaattctagataatcattaacgtctttaaacagaacctgcctttagctttgaatggaatatttctgttgagcacatgttttataatactgttgactaccttgcttttttttttattactttacatcttgatagcctttttcactgaaatcaaagcaacttctatgtatatattaaatattcatatgatgggaatacttctgatgctaacatccttgttacattgtggctttgcatgtctaagtattgcttcctaaatctagataaatgaaaattcatcttagtttcattagtttcatcagctctaatcttataataccttatatgatcatataatactatatctcctcactaaaatacaaggaaagttatagtttgatatttactttaagcttctttgaggaaaagtattgtacatgtacaaaggagtatcaagatagagatgcaatcatggtatctatcctctagttgcctgttatgttatgttatgttatgttatgttatgttatgttatgttatgttatgttattttgatggagtctcactgtcgctcaggctggagtgcagtgacatgatctaggctcactgcaacctctgcctcccggcatcaagtgattctcctgcctcagcctcccaagtagctgggattacaggcacgcaccactatgcccaggtaattttttgtgtttttagcagagatgggttttcaccatgttggccaggctggtctcgatctcctgacctcaggtgatccacccacctcagcctcccacagtgctgggattataggcatgagccaccatgccaacctagttgccttttagaaaactagttattcttgctttcagtcctttatcacaatagtgtattgaatgtccgtaagttcaatagtaatcctccaaatatttgagacatattttaatattatatagattattactttgaattatacttgcaatcagtacccatgatttctcagtcaccattgcttgaagacactttgtttttcaaataaatgcctttttatgatattgaaatataatttgtatagtagattattcatggagtagcatgcctaattttatccttaaaatgtcaaccaacatcaatgttaaatttcctgattttaatttttgttcttggtttagtaagagaatgtcctttgttttagaaaatgcacactgaaacagttgctggtaaagggcataatgtctccagcttcctcaaatgagtcaggaaaaatgcatatatataataaaaatatacatagagtgattcagcaaagttggcaaaatgtaaactgttgataaatctggaaaaaagatattcaggagttgcttatactatttatataaagttactaaaaaatctacaccaactttagttatcagtttaggaaaagatcatgtattacttgcctttgttcattcttgagtatctagcattaatcttttcctatgtgcaagaatactaaagcaggaggaaagagactgagttagtggttttggtttcttcaagaaggatggaaatcccagaggaattagggagaaaatgtggtgattgtaaaattagaagataacgctcatccgctgtcacattttaaaattacttggtacctcccacccccccccccaaaaaaaaacacagattatagaaaacatcttatttggacatccttttgaagtataaggcttccacacaaaaacttgtacacaaattgttcatggcagcattcttcataatattaaaaagtagaaacaacccaaatgtccattagtggaatattttcggccataaaaaggaatgaagtactcgctaaaacatggatgaacctaagtaaaagaaaccaggcataaaagaccacatattatatgatttcagttgtataaaatgtccagaataggcaaatgcatagagtcaaaacttagatgagtatttgttaggggattaggggctggggagtatacagagtgactgctaatggacacagagtttcttttacaggccatgaaaatgttctgtaattaaatagtagtaatggctacaaaaatgtgaatgtattaaaaatcactttaaaaggatgaattttatagtatgtgaattatatttcaataaagctcttattttaaaaaagtaaaaccttgcccatcactcttgcctcggagtcttcctgtctaattaaaggtaagtcaaagacccctaacattacatgatctggcttcctattactccacagtctgatctccttttactttttccctctcattccagtctagctgcagtgcctcctggctgttcttgcctctagtctttttattggtagttccttcttcctaaaacttaccacctttaacagtttagtcaaatgtcaacctctcagcaaggctttccctggctaccctctctgaaattgtaaacctcccccagattacctatttcccctttttgctttactcttctccttggtattatttaccatctaacacaatatatattttacttttttatcttactatttctcttccccataaaatataagctccctgaggacagagattttgttgcttttgttcacaactgtatgtgggggtctaaaatatgcttggcacatattagcactgatattgttgaatgaatgaatctgaaagtatgagtacaagcagctataatgaaaatcaggaatactaagtaattgaagaaagggctacatattttatgccctttattaaaataaaaattaagtatctcatgggaccatgaaactaaaggagtagaaggaaagcagtaatttctgtcttgaaagcaaaataataagacaattattcagttattaaaatggaaataaaacgttatttgacccaggcagataatagttactttacttttcaatgataaggacttggtagatatccggacatacattaagtactgaaaatatgttgcctgaatggacagtgttgacataaatcagggatcatttaagtatggcccatgcctttttttgtaaaaaaatttgtattggaacacagccatgcccattagtctacgtattttctatggttgtttttgtgctataacagtggagttaaagtagttgcagcagattatatgacccacaaaacttaaaatatttactatctggccctccacagaaaaagtgcatttgctgacccctgcctaaattggtctctgtggaatatggattagtataatagagaatcatgaccaagccttcagaagtttacgtttcatttcctggactggctgtgttgatttggaaaagttaagttctatgattttcggtttctcatctgaaaatgaatagaatacttatctcacgtggttgttgtttaagaattttaactgagctaatgtgtataaagcacttagtgaagtgcctagtaaacagtaaatgtcagcccagtaagtagcacatgcatatgtgtatatgcatatatacagacatgcacatacacacaggaaatgcatatgccctcaaataggaactctgtaagtcaccaagcattctccagacactttctatatttttaagtaaataatgaataaagttaattagtaagtacttactacacataagacgacatggtaaactgccaaaatgtatgggattttgttttttatgtagaaaattatagtcaaacattctttctttcttttttttttttctccttagaaacagggtctcactccgtcacctagactgcagcacagtggcacagtcatagctcactgcagcctcaaactcctgggctcaagcgatccccctgcctcagcctcccaagtagctgagactacaggcacatgtcaccacatccggctaatttttgcatttttcgtagaagtggggtctcactatgttgcccatggtgttatcaaactcctgggttcctcagcctcccaaaatggtgggattataggcatgaaccaccatgcctaaccttcaagcattatttctgacagccctatttacagtattttgatgctcttgactcacattttagcaaaatgtacagcccactatagagttttacattttcaggtaagtttcaatgttttatttttaaggaaggactagttcatgctttgttcggattataaaaagaggaaaacagtgtaatgccttatacatcatattatgacaaaatttcaatctagaactttttcttgggtgcctcattttcttttttctttttttgatatggggtctcgcttgtaccccatacaaagagtgcagtggggtctgcactcttactagggtgcagatatggggtctctgcacccaggctggagtgcagtggcgcgatctcggcttactgcaacctctgcctcccgggttcaagcaattctcctgcctcagtctcccgagtagctgggattacaggcgtgcaccaccacgcctggctagtttttttgtatttttattagaaacagggtttcaccatgttggccaggctcgtcttgaactcctgacctcaagtgatctgcctgcctcagcctccgaaatgctgggattacaggcatgagccacagcacctggtctgggtgcctcattttctaactgtcagtatacagaaggcaaattcatagggctggattattttgatgacctttctaactatacagtgttttctttgttaaaataaataagagatttaatttttccttaaccaagttattttggttgttaaataagaagaccaatggtatgaatccttaaatcaggatatctttagtattaagatatctgcaatacatgaaattataatctcactttcaataataatctagtaaacagttataaatctactatatgctaggcattaaaattttttaaaaacttagtagaacagaaattttgttttctaaaggtatgagatattgttgagaaaaacattatgtaaacaagtaattttaataacataatagtaataacaatgaaagtacggacgtgagagccattagttctactttaagatgtcagggaagacctggagaggtgacatttgagctgagtctcaagggaacagttcaatattgtcagatgtatatggtagagtgataccacacaagaggtaccaaagtcattcggcaaaaatctttgagcttctactgtgtgtcagataatgttttaggcagttgaacaaaacaaaacagttgtctagttgttctatacaaatgaacaaaacaaatgacttttttctgccactttcagtggaacatgtaaaggcgtggaagtgaggtaaataatacagaatggctgagtcgagaggagtctgggggtccctgacaagaaaaaagcagaagccgtgtcacaccaggaagtttgagtgtaatcctgtaggctactgatgtccaatcccagagctccagggatactggtgtgtcatgaagttattacaaaggaattagcaatccatgcttagatattaagcatgcatagcctgtggattttaataaaatgtcttttacacctatttttgtactacttctcaattttttgtagttattttgagtaatagaaactcatttaaacatatgaattcataatacctttttcgacaatttttattttctcaatcgtgtggtactgtcactttaactacttttaagtaatcgtcaaaatggttaatttttaaatgaggtcctaaaatattcagcctggcatctcctgccagtgttgaacctgttaaaacttctagagctaccatctaaaacttcagttaatatttgatgagctccatctaagtgccaagcactgctctagccactaggattacaaagattaatataaaacaaggtccatgtcctcagggaacttacagtcataatgaaatagagtctagattaaaaataaataagactgaagtaagcatggagaaaagggtatagattcaggatatgttaaggaggtagtaactcttaatcaatgagaatctctcactgaaagcagactactagaatagaagcaaagaccagattcttaggaaaagagctagtgttttgctaatacaggggaaaaaaagctctatcttttattaagaatattgttttatcctagtaacaagcctaatcaatctccagagaacaaggatattaataatttatggttctgtgaacatacctcttctgcttgatttttctctgcctggtaataaggtataaacctgtgaaataatcttaagtcaaaccatgaaaatatgtaatgtaaacgatgtaaaaaattcatctggatctgacaccttcatgatgatgttgcagaacagtcattctctatgttgatctctgtaccttcagcccaacaagcttacttctcttctttcagatttcagccttctttcccacacacacacacacacacacacacacacaaatacacacacacacacacacacacttcctttctttcctcgcaaagaaagacagctattgactagaagcccagaattgcccccaagttccgaccaccagctcgaattcttatgaagtggacttgtaatatccttaatgttgctgttggcagtcagttacagattccattattgtcgatcagtgcagtcgccatgcgaggtggggggaggaatggaggaggaggagaagaaaggagggatgagagcttcctattcacagatttatcaacctgccttttcttgcaggaaatcttcgtaaagggggctgttgaaatagctaaagcaggaaggggaagggggctgcagttcttgcggaggactgaaaggaaatttgaaaacctttctcctcaaaacaaaacaaaatgctgaatttgttcttttgtctttgtttttgtttgatattttttacttaactgattagctattgtgctgtctggttatctaagctgcttccagtgtaggaacctgtttctttttctttgagtgtctttattctttattttcgtatgatttttcctgtcattaaacacacttcattattcagtgttatcctggctttttctttcagactaaagcataacaccaagagacagaaggacaaatctcccttctcttctcttataccaccctcttttaaccctatttctttccccctccccctggttgtattagattgatgtcacagagacagaattcagagtggagggaggatcacattttctctttcatcattactgcctagccagcaatttaagtgttggacccccaagaatttagtctctgtatcctttttttctcacttcatcattcagtaattgtgctctgtatggaaaagttttctggctggagaatgagtctcctttcccccggtgatgtggcggagtggttggatagtagcaccgaagaagagaagagccttctgtcatttctgggtacggtagggcttgcttgttcttttaaccctttattgtctgaacttttcttacttttgggaataggaccccaaattctctaaatccacttttgtatttttaaaaggagaagaggaattaagggaatatgtttaagtcgtttgcttttcaaattttgtttgtctgtagaaataatgccaccaacactagctatgagaaataagagagagattgctttgccttaacaaagagtgctagctccattcaaggcttaccatgtcatctggccagctgttcatggtatttagacaacttctgccaaccaaaataatattattgttttactttactctcaatacagtgatggtgaggtgtgctgtgtgagagtgggagtaggctttgtgtgcatgaaaagccaatgtacaaatcgagaagtagcttttatgcaaggtgtgaaatatttgtaatgcttatatatgatttctactgactacataaaataggacacatggacctcccattgctttaattttgcatttttgaatgctttctaataaatttctaagtaaagcaattgtttatcttgtggttattgatataataaacaaattattaggaaagttaggttgtaaatccagtcatatcttaaatgtgatagaagagcttgatactcatttaaaaacctatttgtgaatactttccctagattaattatagccttcaaatttatctttcttataaatttgatttatcttctattttcctagatataagtatgcctttattataaatggacaaaattcagttgatcttctaattttctaatttattcctcatgaatattatgtatgacctatggatagtcttctgccagtccaaaagttatctctactattatttgaaaatctttcttatagttagcataagtttatctttcaattctgttgtcaatcttagcattctgtttctttcctttttttttttttttttttttttttttgcagtttagatgtaaagggtcatcctaatcaggtcttcctaggtacatatatttagatactaacccgactcttaatttaccatggccttatttatcttcggcatttggatgactttaagaaatatgtatacctcttaagccttcgtttctctgaagcctatctcattctacttgcttcccattcccctcccctgacacatgcatacatacacatagagaaacatcagtgaagaaacaaatacagatatccctaagtaaaaccaatcacttagactctactacatcatgggaaaggaaggcagagttatcattaaacatattttctgtgctctggcatacctttatgaattctaattatctagcctaaagataaatttatttatctcctgtttttgtggggaaggcattatcctactatacctgaaatgaatttggttaacaaagatgagtaaataaaaagtgctatagtagtgcccccacccatccctgctcctgtcctctgattaagggagttagtaaattcctatttatccacagatggataaatggaggtaataaagacaaagaatgttagaacttgcttagaagaaaaaaacgcaaatttccataaattatgatgttgacttctgggtagtcaattcccgattatccacccaatggaagcttcagattatagataaaaacaggtaagttagagtcctgattctgctcaagggctacaataagtttagttgctgagtgaatagacagcaatgtatcccatgctctgctgtggcagtgctaagctgtgaaagtcagcaaatcttatttttaggattgaagctctctcctgaccataggcagcaaacacctccatctgtggataaacaggaattttactgagctcctccacaggaatgaggaacaaaactatctgagatgtagcttgtgatagttcgaggattaagtaaaacccttgtgttgagtcatttgctaatgtaattaccattagtgacaacatgcttttcccaatgaagatgccaagagaaaaacaagaaaactaaatctactttatggtgaatctaggatgagtagaaccaagaaacactgtgtcttttggtagctatcaaattatgctttctttgcctaaggaattttaaggcagatttccctccagaaggggggatgcaagaaaagtactttgtgctggttaggatctactacttacttctgtacagtaaccacctaactgatgttcaggccttcccaataacgtagctcactgctagtttgatgaaacttcatacaactgtgcactgttattaatctgttaaaaaaccttccatggtttcttcatcacctaccagataaatttaaaacaccttactgtgaaacttaatttggcctttcacacctgacattctattattcattttagaggagaaaatccccaagcctcccttccaaccaaattgatttacttcctgtcttggaacaaatattgccctttcctaccttgtttcttctgtcagcagtgttcaaactcagctttctaaattcagctttttaaaactctgcccttgtttcaaaactttcttataaataaatgcaatgttctagacactgctagatgctgtggctggatacagagaagtataagaaaaagctgcttgtgagaggcatagtgtttggctagggagaaaacatgaactacgcacaagttaaatgagaaaaattaaatggtaattcagacgacagtggagaaaatgaaaataaggcagttcctaattgtaaaattatccaggtaaaaattgctttgggagtttgaagaagagacatttaaaaacattgaaaattatcttacagagatagggtttaatctgaatcctaaaagattttttatggaaatggtagggttttctgtatgaaagcagtgtcctgaggaacattaaataatttcacatccggtgagcaaactgtcttgaaaagaacgcagaattcatgtaaagaagtaatgagagataacatttgaagggtatttggaagctcactatgtaggactagtgacaattttatcctgaaagccatagagaagaatgaaagacccttgagcaagaagaagatatgatcaaaatagttttttagaaagacatctgaaagtgatactaaaggggaagaggctagaagcagttaaatcagtttgaaagctattgcagtagtacaggtatgcaataagtgcctctactttttttatccctgtgtattataattgttggtttgtgtattaaaaccagactgtgaatgcctccacaaggagggcttaatcctctgtcttttcagcacgtggaatactccttgtgcagatgaatgtttgtgtagctcaggtgaataacagattaaaatagatggagagattacaaagaatgtatcagcagaattggtgacatattagaggaatggggaacaaaatgaatcaaagataatttttgaacttggaagaatggtggtactattaacagaaataaattgagaaagggagccaattttttaggaagatgggagttctgtttaggtattttcacttttagaagactaatccacatccagacagaaaaaacagttttggtaattggaaatgaagtcacaggtgggagctgttcatctagagaagaaagattgttgatattctaagcatctgtaggtcatctgctatcaagagcttgtcaagaaaaaagagagggcagcagctgaaacttgaagaatatcaacatttgggggtgggtggagacaaagaggagacacagagcgaatgaccgtaaatgtgggaggaaagccaggatggtgtggtattacaggtgctaaggtagaaaaggttaacaatgtggtcagtagtgtcagtggctacaaaagccaaagagaagtcagaaaaaaaccactaggcttgacaatgtaagagactgttgataacctgtgaaagtgttaatgctatttgagtaaagttgaagagggagaagtcagattttataatactgagaatgacagtaggaggtgagatagtggaaaccacaggttaagccttttgcctgaagaaatctgtgactgacagaaacatgtaccctgttaaaaactagattgagaagacttgtacatatttttaagtggaggagagagcaagatcttgaacctacaagaataaagactaagaaaacaaaacattttatgggtttggaggtgagagtagaattaaaagcataggattaaccttttgaagggagaaagaaaaaactcatacaggaaccaaatatacatgccgagatttagcaatggaatgtagggaagatggggagataacagctactgtattaatcttatgccatttatcacacccagtcttgcagagttagctatttgtgtacccatttatgttgttatttgtgtgcccatcaaatacttccctgctactgccagataaggatcttctcttaatattttggcatcttccagaatagcaccgaataggtacttagtagatactttttgaatgaatgaatgatatccagatacccaaaaatttgagactcgggacttttcaaaattattgaaattattctgtcagatccagctttttttccctcttattctactactattctgtagtcccataaccttttcaggtactttgatagcatttgaaattattattcagtagataatgattgcgttttccaaattctagaataagaaggaaaatactcagcgtatacttttttccactttgccttttctaaatggaatttaaatgatttcattttacttcatagagtgaagtaatttatgtgatggaatagttctatgaaagaataatgtaattttgacaaatcctaaacattttaagtttctaaatgactctgttgactatagttaattatttggcattggcaactattatctgattcccaaaatttacaccaaacatcaagggagaaacatattcaaaaattgaaactctaatttctggtaatatgccagactagataacctcaaaaataatatagagacaattagaaatttcacattagtgtaacaaacacttttaactaaatggctgaactctcaggaaggaaaggaagtccccaggaagaggaaaaagaaaacaaaacaaaactcgaaatctagacagtaaactctcctgggggcatttaccaattttagaatattagagttaagttttaatggctataatataggagatgggccaagggtctaacaaagtaaagaattagaactgaaaggcctatgtcattcttccccataggactgggcctctgaatgagttacaccttcagtgagagttgaagttagaaaaatctctcattgacaaatatagacaaatcttaattatcttaacctggactggtaggtgaggtgggagggggaaaaacatcctgagaattcataatcacagtcgtgataaggtaaaactgaaatagtggacaacattaatatgtcagagataggaagtgggtaattggaattgaagtattttaagattgttgaattattcgagaaaaggatagaaatcgtgattaactttaggctttaagtatacgtgttaaaatgttaaggacaactactagaagagtaaaaatagagtatttttattgaaatatttgaaaatattaaaaaatattttcaaaagcaatacagaagaaaatggaattttttaaacctgattaacctgattttaaaaaaaagaaaatcagaaaaaaatggggaaaaaaatagaaaatacagtaagatggtaaaaataaaatccaattatatcataaattatatatgaaaatgttaaaagataaatattgtcagactggattttttttaatgctatgaatgagagatctaaaacacagggacctaggaaagttaaaagtaaaggcttggaaaaagaaagctggtgtagccagtgaaatagaataagactatcaaaaaagttactggaataaaggaggtccctaaataatgataaaatataaaaatcactaggaagacataacaatcttacatgtacccaataacaaaacctcaaattttatttggcaaaaatggacagaaatggataattctacagtcctatctataaaaattagtaaggatatagagaatattcaaaaatgcagtaagcttgatttaatggacatatatagaatcctgactccaacaattagtcttctcaagcacatacagaatctttataaaaactggcaatagaccaggtcataaaacaaatctcaacaaatttcaaagttatacggattgcattctctaataacagttgaactaagttagaaattagtaacaaaaatttactgtaaaaacctttatttttgcagtcttttaaagttacttgcaaataacttgttagtcaaaaaggaaaacataatggaaattataaaatactaagcaatactgaaaatagtgtatatcaaaacttgtggaatatcactaaaatagttcttaaatgaaatgtgtagtcttttacattgaaaagggcaaaagctacaaatcaatgagctaagcatttaactcaacaagttagataataacaaacccaaagaaagtttagggaaagaaagaatgaaaataagagtagataatgatgaaatggaaaatagaaataaacagaatcaataaagccaagagttgttcctttaaaaagcctaatgaaaatagatgaaaccgacaagatttgctaaaaagagaaaatataaacaatgttgacatgaaaaaagggtataattatagaaaattagagaattgaaaaatagactattataaaaaagacctttttgataatatatttggaaatttagacaagtggacattttaagaaaaatgtaacttaaaattgtagaagcaataaaaaactgtaattaggcctgtgacctgtaaccattaaagaaacagaggctagacacagtggagcacacctgtagtctcagctactggggaggctgagttgggaggatcacttgagaccagaagtttgaggcagtgagctgtgattctgccactttactgggagtgacagagcaagaccctgtcttgaaagagagagagagacagagagaaaggaaggggaggggaggggagggaaggaagggaagaaaggaagagagaagagagagagaaatggaatcagtagtttaaaatctaccactgattatggtttaatttctcatacagcttgacttcagaaaaataattaatgtcaaagcacacttgcgttaatatttccaatcagtgataattcagtttttcatagcaagtgaataaattagcattctggcatctaaatttaaaagcaaaaagtacctcagtatggctattgaatccatattgagtctcacaggtggacatggttcccttagagtttttaagtcttacatcctttgtttagggatttccttagaacagaaaaagtgtagaacagaagatgttcttgcaaaaattttccttttggggatgtataatttaaaaactaaaggaaattaagctgaacagatatctaaagaaaatgaataagatatcaagacttaaatgtaattatgtttaagtgtgcttctcaataaaatttggaaatttgtgacttaatttgagacagggtctcactcttgtcagtcaagccctgcctcttccacctcagcgccttgcctcccagcctcagcgccccctacccgtagtagctgggacgacaggtgcagtcgcacgccgccacgcccagctaatttttgtattttttgtagagatggggtttctcaccaggttgcccaggctggtctcgaactcctgaactcaagtgatacacccgcctcgggcccccaaagtgctgggattacaggcgtgagtcaccgtgccccgccaatttgtgacctttttaaatagaatgatgcatagaaggaaaatcctcaaaacttttaaacctaatttcccatgaggcttatttatcataatctcaatttttctgtgatagccatgtcactaatagagagatcaaaagaaaaagaaaaaaattagaagaaaaaataacaatttaatatacataaaggagagtggtcctaaactcaaccagttggttgaatttaattccatgtgtgagttagaggtaactagaaaatttattaatttattttgtattaaattgaactatatgaaattgctggtattttaccattttaatctaccaaaaaaaggcagttctatagggctgtacctaatagagtcatgattataagcacatgtgtctattgagtgggggtaggggcaggtgtccagacaaagtatgcttaactattttttagttgttaaaatatatttgccattatttattatcttttattctatcttaataatccctgcagacaagcaagaatgggtgcaaatggtttataaaaacattgtgagagaaatacttaaaacagagagaattctaccggttaaaatttgtttaaaaatttagacacaatcacaagatgattccaatcttgcagtgacttaagacctccattatggaacactagtatcagtattagtcaggaatatagtttagtttggtacccaaaactaaaacgcatataatcaaagaatatgaacttatataaatgtattaattggaaatcaaagaaatgtgagtaattaggcctggttttatggaagtagatgaattgaagttgatattgaaggtcatctaagagttggcagatatgtaggtgaaaaaagcaggcatgtgagaatgaatgtggccagtttgagattagagatcatctgactgaggcaaattgtagaaaactgttggcagaaaggactaaatatgcaaagtagggccaggtgatttttttcctaatgtctgactatctaaagatctctaggaaggaaatttcatccagaaagtaatgttttagggagattaatctggtaatgatgagtaggatagctttaagcagggagagactggagtcagtaagagcagttaggtgcttcctgccataatctgcatgagaagataaaaagccctagattaggatggtggatggtagtggaaataagacaaaatgaagccaacagccatttcgaagagatacttagcagtgtgtgttggctaaaggggggcaaatcaacatcataggctcctttcttttttattaccttcactaatgggtgatgttgagtgtaaatgattttgtttttgtacagtgtcatgtgcatatttagttcttggtaaatgattaaattttcatctttatattacaggtttacatatttgtatgttttctttttttaatgtcctctattaatatttgtttgggaaataaaacccaaacagaggctctggcataatcaagactaaatcttttttttaatgttcactgactaccaaaatgatggtatgaataaatctaccattatacccccaattgtacatgaagcatattaacaatgagaatatattactaaatcagttacagaaaaagttatatatgaagcatattaataatgagtatatattattaaatcagttacagaaaaggtttaaataaaggtgttaggccctatctgtagattagaagagatagttgatgacaaaataaaactcaccaaactgaagttgataccttataaataccaaactgaagttaatacattataaataattggactgacatgttcaaaatagtcattttatgctgaacaatgctttgttgtttagtaattgttctttgcaaaacctaaaatattaatgctttttatctctgttcatctcatacaacttatctaagtacttatctccccacataggtatactgaagattagtggcattgaaagacatggtttattttggagggctcttgtcacttttttgttcaagggatcagtattagatattctttataagttgtttcctgttttgttcacattttttcaccattaacttttgtcattaagttagtaaacttttgtcccttgttattgttttgcctcacctctctgtgtttcttgactagaatgtttttatcagcatcagcattcaaggattgagttgttctttacaggttttgtgtgcagaaaacacctcaagagtatgacttaattctctttaaaatatgaagaaaactagagtctctgtgatcattcatcttattttttttctccattgcagcccattatacaaaacacatggagaacaggatagaatgcatggcaattaaagctgtctctaaagccaaactgcatggattctaatcctgcccccaccctttttaccagctgtgcaaacatgggcagagtaatacatgggtgatagttccacctccaaagagttgttttgaggattaaagatgtaacttatgtaaaacatgtagcaaataataaggcataatacaaggttggcgcaaaagtaattgtggtttcacattttttaagttgcaaaagccacaattacttttgcaccaaacatgacagtttgatgtttgtacttgtcgttgttatgttttcatcatcatcattaagatacccacttgtcatcactaagaactagatacgtgttttctatctgaaacttaagataacacataaatatccctgagctattttcttggccttttcagttgagagtgttgtttgcactaaaagtattctctaccatctcatccaacattgtcatgtgaagccctaagttgaagaaatggaatacttgtgggtggtattcagattccttggctggggaaaaaaattgtttttctattatgttaacaagaagaaatattaaatattaaaaataataataaatttactgaagcaaggaagtggtggggagactggatggctttactttatgagaatttaccacatttatgtacttagcaccaatttgtacatattggagtgtgtggggcatgcaaacttgaaaggactacttgtttgagtgaagtactgcagtctgagtgatacaaattgggtgaattaaagtggctctggggatttgtatttcagagcagctggatgcttgtggctgacagtgcataggctttaaggcagtaaaagtgggatacagcagaaagtatcctactgaaaatggtggatgaagtttataaaaacacccaggtgctatagtgttagcagccgtataaatgcagtatgtgatttttcttctctttgctcttgtcactttttctttataatatttttctaactctgtcttttaagttcctattacctttaggagtcctccagcaaaaaaatatgaaaccttattttcatgaaagccttttttgtttcacaatttgccatttgttattaaagcccctctactgaagagctacaaacccatttcctcctactatttcatccttcctattctgtttcttaaatgtcttctgtgccttaaatgtcttctgtgcatcctatggaagaagaaccctcctaattcagaattcacagcatggagagagaagttatttgcttatttcattcattaataactagagccaccaacataccacatcctatttaatgttgtcattatttacaaaatgcaagggaaaatagattatagtgaagtggactcattcatagcaacactatatatgccaaaatttcagtgacttgaatgggtacacaaacagtttggtttgtattcaatgttttatcatgttttgttgaaatgttgatttttaaaaaggcttttgaagtaaactgaagaattcactttatgagaaaaacattagaaacttgtttcctacctacaaatatcaaaattattaaagaggcatgtgaataattataattgaaagagtatttacatttattcatgttttataattctgtgcaaaaaattactaagaattggttcaggttgccattaatatgaagtgcttagaatcctgtatatgccaaagaaactgcatctgtgacatgtaatatttttctgttctattgtaacttgagaattttactatgatattttagtttcttatataattgttcaccaaattaaagctataaatatctttctacattttatttacctttcctgctgaatttcctcctctgaacttactttattcccttttaaattttgccaccatcctcagagagagtaataattgttactatctcaggggctacagcaaagattaagtaagttagatactaggcccagtacttagcacataaattctcaacatgagctaaaattcgctgggtgtggtggcacgcacctgtggtcccagctaatcaggaggctgaggtgggaggatcgtttgaacatgggaggtataggctgcaaggagctgagattgtgccactgcactccagcttgggagactgagtccatgtctcaaaaaaaaaaaaacacacacacacacacaaaaaaaaaactcaatatgagctaaaattataataaaactattttccctagacaaattattcacaaagaggtgcttaaatagcttttataatgtaactcttttaaaagaaaaaaaatttaaattattatctttacttgttttttacgctatggtaactaattctaaaaatgatagacattataagaaatttatgttatttataatagttaagtatatgcaaatattatatggcatatgaccttcggttaaacgagattgaacaaaaagtaaatgtaattgatgcctatagatatttgaccgtatagtaatgacattgtgtagcagatacctttctcatttaagatattttcggagtcttttggaacctaaccctcagttaatatgatagacatttcactttactctctttccaaacataataacattccagatttattctgtatcacattcattattcaaaatcctgaaaagaaaattgacctggtggagttggctcaagcctgtaaccctagcactttgggaggccaaggcgagtggatcatttgagcccaggagttagagactagcctgggtaagatggtgaaataccctttctagaaacaggcatggtggcacacacttatagtcccagctactcaggaggctgaggtgggaggatcacttgaaccccggaggtggagtttgtagtgagcccagatcataccactgcactccagcctgggcgactgtcttaaaaaaaagaaagaaaaagaaaagcattaagaaataccagtaagtgtatatctatggactttcaatacgatttgtaccttttggtgacgcatgtctgaccaggtggtttttcattttagagttaaaaaaaaaaagtccttacaagagaagattaatgagtttatatgttttggtgcaaaattagctttttggaagaaaggggttctttaaaatatagtagtattgtagtgtcatttccttagcatatacattttcttctgtcactgtccttatattggccagtattatctgaacatgtctgccccagttcctctcagactttacctcctactatttgttcccactcactggcaccaatcccactggcctctttgttgcggtttaccttagaagctttgtactagcttccctctacctgtagtcttcttccctgttaaacctgcaaggctgacttccttacctcctaaagtattgactcacacctcacctttgcagtgcaactacctattgaaaattactgtacctattcatctccctgactactttttatttcccctaaaacacttgtcaccttctaacttactccttagggtcctctcaaatacatgataggaatttttggcatttactccctggtaagtgaaccaaaggcagtgtatacactattaggttctaaggcagaaattgacttctgtttgttgaacaggaacatcctccaccaaaagtatatttgcccctataattatccaattttcaatttctttgccacactttccaaagaaagtgcgttgacatagaggaatatgtgtatgttgaggaaatgatagtactctattttggattttaaaagattcttccttccagaaagctaattttgcctcaaagcatataaactcattaatcttgtctttatctctgtttggtctggataacccagtttattaaatggcgaagaccaggacagaaaaggtgaaatggcttacacagaatcgtacatatcattggtagagctgctaagaaaaacatccagatgttctctttgttcaatacatcattctatatggagctgtattggaggttatctctcatcattttaagtcatcacatcatctgaggtcatatccaatggcaaaggaaatgaagagatacatttaaaacttaaccaggctttttataactctttttgcctttcaatctgaagatgaaaaatattatgtttagagatgagaaagtgaggcagtttcaggcctttatctgaaacaatactgtatctctcttgtctcatcagtctcagagaatgagcatattttaaaatgactgtaattaaatattgtaactatgaaaagaacattaattttacagcaggtgaaaataatgcaatagtatgtagcatgagtgggggtagaggatacagctgtctaattttggtctactggaactagtgtagattttccttcaaactgagcagaaatgtagctcttagagcatagtagcagctttcctttctgcttacagatttaaagttaaaggcacaagtttaatatgctgttcgttctgtgactaatccagcaggttgctcattccgctcttgctaatgctgctaccttgcttctaagtggacattggtacttggggtatttatttttctgtatgctttgaagtagttatgaatcttctgagaactaaagaactgggattctccaaaggcctattctacactagcaggtgagtggtattattgtgggggttgagaaagcaacaaagtgtaaacttcttttcattaggtgatttagctttaccttatttcttccccttctttcccctttttagtggaaattgttcaaacttcaggaatgatttaatatcttctttctggacccgataatacatcatataagctacatcagcattgtattttttcccataatacagaaagagaattttttttttaattttattattattatactttaagttttagggtacatgtgcaccatgtgcaggtttgttacatatgtatacatgtgccatgttggtgtgctgcacccattaattcatcatttagcattaggtatatctcctaatgttatccttcccccctccccctaccccacaacagtccccggagtgtgatgttccccttcctgtgtccatgtgttctcattgttcagttcccacctatgagtgagaacatgcagtgtttggttttttgtccttgcgatagtttgctgagaatgatggtttccagtttcatccgtgtccctacaaaggacatgaactcatcattttttatggctgcatagtatcccatggtgtatatgtgccacattttcttaatccagtctatcattgttggaaaaaagagaaaagaaaacagaagtataacaataccatatttattggagtttgaaatgtggccactaattttagtcaatatagtttcaaatagttaaaagcattgaaacatattcatttaatgagtttgtatgcctgaaaactaaaattggatgtatggaagaaagtgaggaaattaatttcagttttttttccttagccagaacattgcaaattaaggaaatggtttactagatcattttatcccagctaatgaaatttatttttcccccaatttagtttctctgtcaattattcagaaattaaaacatactatattgtaatattaaatctccagtgtcttctaatttgatatgaggttacctttataggtaattattagaggaaaggtgagattttttttctaccttcaccagccccattccctgcctgccttgcccctagccacatagagtcatctaacttggataattactctgtaaagtcatattcctgaagtctggaagtctttctgttcaatgtgctccaacaagctgatttacttaaattcagtgctttgtgccattcccatgaatctgagctaattatgctgccatttttcagcgatgtgcattagaagtcatgtgtgcctaattctgagaacagctttgcacattaaggctcatttgactagtgatggttagagagaagttaagggacttacagttactggtcataattttaaaatacagtagtagtatggaactctcttgtactgcaagcatacaagatgctatgttgtcagcctctcagtctttaggaatgttccaatttggcttgtgccttaccagtcaagatgtcacagagaagatatgtttagtcatggaaaagaaaatcagtgtccagcatgcaaagatagtaaaagggtaagcacttccagttggattttcataggaggaattgatttgtgtgcattactggatctgtgtaaaatggtgtccttttggcactaggtggatatacatttcagtaaatgttttttcttgctgcagattagtgtaagacagtgaaattttcagtaactgagggaaggcagtggttgggcatctgttaatagcctgaaagtaactaatgaggatgtgcagtcagaacgattgattgaatagctgcagtcctgtgtatttctttcttgcttgctctctgcaagctgtggagagggagggggaagagcaagacacagagagggagcgagagaaaaaacgctctctcttaagtggaagtagcacggatcccaggggccaggaggccagaaatggaagtttaaactgcatctgtcttttaaagggagaacagcaggaatcaaaatgtcagtctccggagttacgatttactccttgttttctaagatctggaagataacacagaatactttttttaggatgtggcttttttttccttgtccatgttgagattatctaatgttatctgagaagctggattcctttatgtctgtcagttgaagtggcgatgggaagcagttgtgataaaggtataatacgtatatatctatcatctgtgtgtgcgtgtgtatgcatatatatatacacatgtatatatatatcactctatgaaaaaatcttaaaaatgtagccttaatacagtatatagtaattaaatgggagaagatcacattatctgcaaaatcctaagcttgttaggttagtttgaacagatttaggattccagagtaagatcttagtaaggtcatattgccagaacaaggagaagctgatctatttttatatctgcataggcatatatgttattttatcttggcagcagctttcagtcttctcatggcccttttgttgcagtctggtgaatcatcttatctgcacagaactaactttgacctttgtgcaaacaccatcaaatcatatgcaacattagactatattttgttcagaagaatattagaaattccattttattctattaactcctacattgctgacatgtagagaagtagatttatatactgtgagatgcaactattaagtgaacttaaagatattaaacatagctcagaggaaattatttttatatgtgcacagatgaaaatataaactgtcacactaaagcagattcttaactgtgaccaagtctctctagtgtcttgatagtttaagcacctcaaagatagataaattatgtgagatagaatgtaatatacctttaaagcatgctggtttattgtgaaaaaccagtaactttacagttcagtggaagatcctaaatttggggttcttaatgatgtttcaactttcctccttttttccagaggtaccagcagaaaggtcccctcgtagacggagtatctcagggaccagtacatcagagaaacccaactccatggacactgcaaatacctcacccttcaaagtaccagtaagtgtttatcttctttataagaatattttacttttccttttctcctttcttcttagagttaggggcagctactaaggaatccaaacattcttctcttcaagaatttctttataattctgtgattaaaggatagactcatcaacttgtgtaaattaactgtggttaattgtcaactactttctttttttgagactgagtctcactctgtcatccaggctggagtgcagtggcgcgataacactcactgcaacctccccctcccgagtttaggcgattctcctgcctcagcctccggagtagctggaattacaggcgcataccatcatgcctggctaatttttgtatttttagtagaggcggggttttaccacattggccaggctggtctcaaactcctaacctcaagtgatccccctgcctcagcctcccaaagtgttgggattacaggcttaagccaccatgcccagccgtccactactttcagtataatatttattaggttttagggaatattatttttactcacagggtacttaacaaaatatgtaactacattaagttcaaattcctctcaactgtagagttcaaatccttgcagacatctttttatcaagttgctagcaaaaacctatcacaattctgtaaagaatctggtggcaggttttttttttaggaacgggatgtggttttttttatttttcagagctggaacataagcagagagtgacgagactcagaaagttgcagactaaattcacagagaattagacaattgtgaattctaatcctaagacttggtctgcactttgcttaagctatcttttggatgaccatggaagtgcttaagaaaaaccttgaaagaaactaactccttaaattgaccaggcagtattgagaatcagcattaaatacaaaagaggctgggcctagtggttcacacctgtaatcctagcatttttgggaggctgaggtgggaggattaattagaccttaaggatattattgtgttccaggatggtctatagtgcagaaattgacattgataataatgatcctgaatcatcaagaaaaagtgagattatatttatttcactatttttttaaaaagtggaactatgtttgtgacatgcatccattgagaacatttaaaatgttgaagatatgtgatgtttataaaacttgttatccagaaaagtggtttgtgaagtacctcattccttggtcatgctagataaataatttattttttcaagagaaatcaaaatatgctggctaaatgagtacttggatatctgtagaaattcattgtattttcttaaattttcatgtaataccaatagtagtgtgatttacatcacttaaatatattgctgattagaagaatgtctaattttcaggtcaacacacaatacatttataattaatatcacagtggactctttgaatttgggaaagcagtacaaaaaggagtcagactttgagatatttaacttagagttgtttatgcaatatctgaatttaggatagcagtacaaaaaggagtcagactttgagatatttaacttagagttgtttatacaatatctcagatcgtttctatgttaactttgtggagagacagaaccaatattttaccacaagtaccagtggttccaggattcagatgtcattgctatggtgagcagtaggtttaccactcatcaattggaccccaaaattatagtagtggactctcacaaaggaccttattcttccgagctccattttcagactaactgagagcagataaaatagattttaacaagtcctaaatgaaattatttacaatgacacacttattgaatgcttactttgggcaaagtattggtgattcatcaattgataccttcttggcatactgtgcgtggtataaaaaagttttccattctgagaccctatatatagcctagtagcaagagatagaaaaatgaccagattcataaagagataagtgagcatggtaacacaagttattaacaacacaatgtgtaagttaaggctttgacaaggagcagcatttgagcagagtttcaaagtctgaaagaaaataattgacaggggaagaaagtactccaggctgtgggaatggcattttggaaagacacacagtcatgggatgactgatgcttccagggattatagaaagaactgagtgagacaggaattgaaaagtatgtgggcaaaaatcgcaggtgagaaggccggaaaggtaggtgggggcaagactgtgattgagtttgttcatcaaacttaactaaattatacttgctgctgaagcattaaagatgtgtttattagaatatttgtctttgactctaaaactgaacaaagtggcatgaatactgtgaaatatgggtaaattacttgactcttctcctaagtgagtcttttttcctcttgctgtcactattccaactcagggtgataggtaaggggctatcattcaatagaaggccagcccagcactcacccctggcctttcagctgatactactgatttttctagaataatatttagccttaaggagatcaaggagaagccagtgggtaaggatcactcatatcctgctggttgatgccaagttaggcagaaagaagaataactgtaacagtgagctcaaagcagggaaccctaaaaaacctttgtatgccttcctcattcacaaaaatttatacttttaaaaacttaaaataggcaactggtacagcagggtattcatgtataataacattcaaaatgtgggaagaagaggaaatttatatggctactgaacctgtaggttaaggcaatgtcttggttttcagcaatatttaaatgtatttgtactcttatctaatcatagccataagaaaaagtagtggtccccaacctttctggcaccagggaccagttttgtggaagacaatttttccacggaccagggttgggttgtgggggatggtttggggatgattgaagtgcattacatttattgtgcactttatttctgttattattaggttgtaatatataatgaaataattatgcaactcaccataatgtagaatcactgggaaccctgagtttgtttttctgcaactagacggtcccatctgggggtgatggtagacagtgacagatcctcacgcagtagattctcatcaggaacacacaacctagatccctcgcatgcgcagttcacaatagggtatgtgctcctatgagaatctaatgccaccgctgatctgacaggaggcagagctcaggctgcaagtcgatggggagcagctgtaaacacagatgatgttttactcgctcacctgctgctcacctcctgctgtgccgcccagttcctaacaggccacagaccagtactggtccatggccctggggttgaggacccctgatctataggagagtttcttccttctttcgctctcattccatatttcttcacacataccgtaattccaattgcaattatttgtttgtaggttctgtccctcattagacaacagataatctgttccgatcatctttataacaaccccagtgcctaacacagtacctcccacagagcaaacattcaacaaataattgttgaatagataaaatatgcatgaattatcaaagaccagaatcgaacgagtttatctcacacatattctcttggtattactgataatgtccctagtcaaatggaatattaaatatgtaattacatttaataaacatttaataagagatcatgtgggataagagcagaatggatggatttttttccttaaagagagattttaattaatatttgaaattcagaactatggtgttttagttatatagtgtatactttgtctacttatgttggtaactgaaactagatagaattctttattatttaatgatttgtttctgtggctatttcttggaaccttttaggtgttatacatatgtataaattcacaatgtttttgcacatctgagttttgactgttcttcaaaaacaactttagtcatttgacattttctcctcttttaaagatcatttttcattttttctttaacatcgtgctagactttcatttaaatgaaattactgggatgatgaggaacaattgaataaataatgaaaagttatccaggtacatacttaagtttaattcagaaagagaaaatgattatgtcttgtaattgtgtatatttgtttcacagtgcctgatattttggaacaggcttttttctttatactctatttataaagtgactattgatatttatgatttgtttaatcacttctacttacatgataccatcaatttggcttcggtcaagagggaactgcttgtgttctgggccaggtgctaggcttagtgttctgattttcataacacaatggtctaacttggcctttcatgtaagtataacacaatacagttgcagctgcttcatttgtgtttgctttgagcttggctctgaaagaattcaggcaccaaaaattatgccaagacatccagaaagcataattgaactaaggcagtagctgaatattcctatgtaactctccctgtgctcttgtcactgtgacacctaagcattcccaatcaaataaatacactagaaagaaaacattgtcaaaaaaacaaatctttacatagtttttagaagaatctaaagccctgggaaataagatataggctaagttaaagtcctgtgtaaaaagaaatgtgtcttaagtatcgagattatcagactcagttgctattggtttctgttttgaatcctctataagatcctatgtaagtgtttttccaagttaaacaaagagatagaaagcttcacgtccactatttaataaagactagtaagtgtccattgtccaaactaggggttttcaactctggccatacatgaaaatcacctaaggaacttcaaaaaatatactgatgcttagactccacctcagaccagttaaatcaaaatctctagactagagcccagtcttctgtatttttttaaaggtcccagatgattctaatatgcagctagggttgtaagccatttgtctaaatgattgataaaatattaggaactcattttagtcagtgtgttacctgtgaatatgagtgctttctttcctaccttcaagtctgacataagaaactaagaagcagtattttctcagtggcctttgttactcacatactaattgctgagttgcctgttagttgcccttctgtgtttgccacaatcagttcagatgaccaatgtaaatttacaaaatacttgctttacctttgaccagcctaagaatctcagatttcagggtgaaatattgaaattcaattcatagcatccaagctacaatacagttccaactttcatattctcagcattactgtattccaagaggatacttaaaacttatttcccatgatgcttaaagactctctatccgtgtttcttccctcttttcactaaccatctgcatggagttaaaatccataataggatcgccctccagtgagacctcttttaatgaacagtatatatatatatatatatatatttatttattcatatgtgtatgaatgtatagatatgagtatattcatatgtctatgaaaatgttattaccaaaggtagaaatcatatagcaatcatgggtatgtcagaaaactatagcctgtagatattaactatatctttaagtcattttgtaatcagaaagggcataattttaaaatcttctaatgataaatatcttagaaaatatataatttagaaccaaaggtctcagagcagagaaaaaaaaagaataaggttagatacaactccttaagggaacagggtgagaactggcaaatacctggaggaaaagggagcaggcttggttaggaaatactaccaagactctaaacttgaaagaattaaagaatgagggaagccctcctcaatctgtggtaattcctagaaatgggcttgcagcagcactaactactggagattccaacttaccctaaccaggagaagagggctgtttgagagagaggatgagatacactcacagctcattcttatagatgatgtaccataaacccttttcctctcaaagcaaagatatttctcctcagttttaatgggcaaggggaaacacaagacctctcatttcacaatgagagataaacactttgaaggcctaatgcccacttaagggagcatgtaattagctactaagtataacctcttttacagaagttctgaagccagagatgtagaaaagaaaatttgccaccttcatgattaagctagagttagctatgcaaaaaaatatatatatatattttggtcttctcagctgtacttatactcagcaaggtatgagaattgctggtaaacaataatacccttggtgtgcctttctaccataaggccctttaatttcataaccaatgccagtagcattccactggatttttaaaatgctttgtttcttttatattaaacatctactaatttcaatttaaagaaacttcattccaacagtattatttgattataatatcaatacaaaattttttgtcagattgttgagtggctggtaaaaaaaaaaaaaaggctctagaagaatttgaatagatgtttctccaaagaaaatatacaaatggccaatacacacatgaaaagatgctcaatatcattattcattaagaaaaaaatcaaaaccacaatgaaataccacttgatgcccactaggatgaccacaatcaaaaagagagacaataataagtattggtgagaatgtggagaaattggaatgtaaaatggtgtggccacttttgacagctcctcaaaacattaaatgtagagtttctatatgacctagcaattctacttttaggaatatacacaagaaaattgaaaatatatgtccacataaaatgtacacagatgtttatagcagcattatttatgacagccacaaagtagtcataacccaaatgtctatcaactgaagaatagatatgcaaactatgatttatccatacaatggcttattatttagccatgaaaaaggaatgagatactgacacatgccacaacatgaatgaactttgaaaatattatgctaagtgaaagaagccgtaccaaaggccacatgttgtatgattccatttatatgagatgttcagaataggcaaatctatacagaccaaaaaagagattagtgtttctcatgagttgggtgagggagaaatgggaagtgactgctaatgggcatggggtttctttttacataatgaaaatgttcaggaattagactgtggtgatggttgcacagctttggggatatataaaaatcactgagttgcatcttttattttttacttacttttttttttttagatagggtctcgctgtgtcacccatgctggactgcaatggcacaatcgtggctcactgcagcctcaacaacccaggctcaaacgaacctcccacctcagctgtgaagctggaaccacaagcgcatggcactgtacctggctaattttttttttttttttaacttttggagagatgggatcttgcttatgttgcccaggcttgtctcaaactcctgggctcaagcagtcatcctgctttggtcttctaaagtgctgggattacaggcatgagtcaccatgcccagcagagttgcacactttaaaagggtgaatttatggtatatgaattgtatctcagtaaaactttttaaaaagtaaaacaccaggcttaggagacttaggataaaaaatttgaaaatattaatactttaatattgattataaattgaaataatgttttagatatattttagatatgtaatatattacatattggctgcttattttctacagttttttttagttaatcgtttctgatactttgcatatttgcatttttatacaaactaccataatttggcctactataagggagatagtactaactacttttactcaaggatgtagaaatagaagcataatatttagtttaaagagaaaaaagctaatttacagtagtgtcctatatgtggaatattttttaatttttgcaaattatcaacaaatttttatatcttgttcatgtttgcatagcatatgttatagtttcttctataaattcatacctgttaaattgtttgaccttttgtatttttaatacagtccacctctgcctctccattcttgtaagatgtcctatatgtgggtttgtttagtgggataatgctgagatttcatattagaggagtgtttttattatatttgtatatcaatgcaattaatatcaacaaatcaggaaatagaaaaggatgctgttttggcaaacattctttcattcagtcctctgtattgtactatggcttggttctgatgtctcatagtaatttaaactcagcttcccccaaactgtattcactttatgtttttcttaaaaaattttcccttgaatttctctttgtagtgctgcacatttcttcagttcccagggccaaaaccctaagagtcataatatactcttccccttctctcaaattctgtcaccagatcttgtctacctctcttcaaattcattcatccccttttccagccccactgccatttactgacttcgcttatcagtacttgtggttccttccctgaactagtaccagggtcagcttcatgagcatgagaccagtgcagtacacagggcctacacttacaaaggctcaatgcatgaagttcaatgctgtattgttgccatctcaaagttcttagtgattgatctttggatttgtattttctaagtgaagtttaatgggacaatggagaattcgtggggaccttgggcatggtaccacctcctgctgcctccctggaatgaattatctgttgcccacttccccactccctgatctcattcagcctccctctctcttcacccagccacagctgtcactctctgaccctggcaggggcctttgcacaagtgtgagaaagatagggattagacagcacaacccatggtgtcttggagcagggcttggtaagggtagtccttgcccctgcctgtcatctccagggatgtcttacaggtagatagaaaccacaactgtgtttgggtgggcgggggaggggcaggggagtgaagggacaagcctcttgcctatctccaagccaggtacctagtgagttgtaggggcagccacaggaagggaagaagcatcagcctcccagcatggcatgacacgcaggtttggtggctggcatggtggaacctggtagccagtggacgcccactgctgagtcatagtctggggcccctggcacctctgaaggtttatacttacctgtaatttttcctggtactggaggaagtgtgacattaaatagtaaataaaaggcagcatggcaagtggagacaaaaactactgaagaaagggaaaagtttcctaatttataatagtacgtttaatgacattgtcttcctgctttttgaacagtactactcccagcttttcattttgcactgagcccctctaattatgctgcaggtcctgtctagtgcagtagagattcttaactcactcccggcctccaattcctcctcatcaactttagccttcgctctgctgccagagtggtctctaaaatctaaactccatcattacttgggcctcccttgcttaatgtcttttagctctctacgattccatgcccatgaacaagactagtttcatacattttatttggcctgctcagtggtttcttcctcctctctcttcctttcccctcttctttcccttcatttgaatgtcttcagacagaactaccttttacttcaaaaactgtcagtcgcccgctgaaggcttttgagttgaacttgtgttacaggatgataaaaccaaagttaaattggcactgagagctttcattgtctaattttgtactgcctttccagactcatttcctaatgctcagtatcctcattttcacccccaactctcttcagtcctgagttccatctttaacaaatctgagagttccccaaacaagttttctcaggtctccttacacatttctgcccaggaagtctaccttccatccttgctaaaagtattctcatccattaagactcaattccagtgtttcgttacctcttctaggcagcattaaccttggccgtctctgtccttccacgggagtgtacattatccattatagcaccgacactattatattgtagggttgccttccctagtctgtgatattctagttggtgatctccagaataggttgtgtatacttcagaggatacacagacaattcatttggggtgcagaaagaaaatattaaatgtttgatattttaaaaaaatttttgctctttaaaagttttatgttattgaatattttacagtcatatatcagaaaatcatattttataagtatattttattaggaaggcacactcaacaatattttattcatttcatagtcaaaattaattaattaattaattattttgagacggtgtctcagtcactcaggttggaatgcagtggtgtaatctcagctcactgcaacctctgcctcccatgttcaagtgattctcctgcctcagcttcccgagtaggtgggattacaagcacatgccaccacgcctggctaatttttctatttttagtagagacggagttttgccatgttggccaggctggtcttgaactcctgccctcaggtgatccacctaccttggcctcccaaggtgctggaattacaggcgtgagccaccccacccagccaatagtcaaaataatttagaaaccactcttctagaagacaagaactatatcttattcatctcataacttcagcactgaccttttatttttcctaatctgtttatgaaaactgatttaatatatgggtgatattcttgattacccaaagtatgcacgttgcaaagacattgacctcttatgccatagtttcttcatcattagttggtagtttttaattaatcaacattgtgtactggtttttataaagggtctacaataaatctattaagtgaaatagaattaagaagggtggaatttagtgagtaggaagaatttctgtggaagtcctgtgagaataatgatagagaaactcatggggagtatcttagtttgcttctcatttaaggtataattgaatgtgtaagaatgtgttctgcctgtcaactctttaaaagttccatggggctgggcctggtggtacatgccagtagttccaagctatttgggagcctgaggcaagaggttcacttgagcccaggagtttcaggccgtagtgcggatgattgttctgtgaatagccactgaactccagcttgggcaacgtagtgagaccccatctctaaaaaatactaatactaataataaataaattaaaggtaaatggggagaaaagacaatacagtcaacagaagtgaaggtgaaaacctgatgatctgtcctagctacctgggcttatatgttatgcagtcagtgagactgttactcggaaactttttcattaaaataaggtggttacagtttaaaaaggccctgagcttttctgatcataagatttagggcccgcgtcaccctgtctttttaactctgtgagagtaccagaacaaagatttcatattattaactttgaaggatttgtacctagaataggcaaaggaatgataagagaactgtattttttaccgttcttcaactagcatctcacttgtatgatcaagagcaaattgtttgacttcctctaacacctatgatttcttttctgtagtaatgaaatattacacaaatattttaagatctttggaagtttgcagataaaaagatactataggctgggtgtgttggctcacgcctgtaatcccagcactttgggaggccaaggtgggcagatcacttgaggtcagaagttcgagaccagcctagccaacatgttgaaagcccgtctctactaaaaatacaaaaaattagccaggtgtggtggcaggcacctgtagtcccagctactcgggaggatcacttgaacctgggaggtggaggttgcagtgagctgagataacgccactgcactccagcctgggcgacagagcgagacttcatctaaaaaaaaaaaaggaccaacatatatattatatatagtaaggaccaatttgttaatattttggtgccaaatttacaatggaaaaactgtttgcagtattacaaacagtatagttaggaaatagcctctagaagtaataaaataagtctaatacaatcttttcagtaatgtatttccccacttctttcccccttcattttatccttaggaaaaaacaaatccatcctgatagacgttagtaaagagtaattacattgtttcacattataccttttgctcatgaccatccataatgtggatttttggtacattttgtttcaacagaggcagtaagaattttatctttttcaataactaataggctcaaaagcccccctccatctctgatgctgttattcttagagtcctagaaatgagagatggaaaacttcaattaaattcatctagtccgtctcccctgacaatgaaaaaaaatagtatttcacattatattatctaatgctttttcaggccttccatgataacctctgagagactgtccaataggctaatagacctcactttgaggtcttcattttgacccatcatttctcattattatattccttaaagccatcatcctcaatattcatactttgtgaacttgaatgagattagcacagtctctgttagtcataagaaaatcaacatactatatagagtatgtatgacattcaatttacaataaaatttaaaaaaaatcagtatacgcctcattaacaggaactgaagtgttctacagaagtgaattttccagatactaaacttttcttccttaaccaccagatttagtttggttttaataattttgagggggttttccctcctatgtgttatttccgtactttcttgagtgaattcaacttttcttaataattcacattaatcattatcagcattctgcaaatacgtattaagtagcccactgtatgctaagcattacagaaatatgaagatgagctcaatgtgtttgttttctgtttgccttcaggagttaagattcatagggaatataaaataggaacagaattaattataggtcaaggtaggggaaaacagtagtataaataaaaagtttagataatcagaagtgggagagactaagtcctattagagtaatcaggaatggtttcctcaagaattggtacttgaaataaatgatataaggacaactgagtaaccatgtggaaaaagataatattagatgtgtatctcataccttacacaagagtaaactccaaatggattagggatctaaaatgtgaaaaaaaagcatacctagtcggaaacatggatgaattctctaaccttaatgcagggaaaaactttctatgatggttactgaaaagccagaggcaattttttaaaaatagattgataaatttgattgtacaaaagaaagttttttaataattgcgtgacaaaaaaataaaaaaattaaagttaaaagacaaccaatgaatcaattgagagaaaatatttacaacatgtaggaaactattaaggtcgggcacggtggctcacgcctctaaccccatcattttgggaggctgaagcaggcagatcaccaggtcaggagttcgagaccagcctgtccaacatgccgaaaccccatctctactaaaaatacaaaaaattagccgggcatggtggtgggcgcctgtaatcccagctactcgggaggctgaggcaggagaattgcttgaacccgggaggcagaggttgcagtgagccgagatcacgccattgcactccagctgaggctacagtgcgagaccccgtctcaaaaaaaaaaaaaaaaaaattaagggacaagtgactaagacccaataggaaaactgaagaaaagaaagacgtgaagaggtaataggtaaaaatgtttctgaacatatgaaaacaatgttcaaattcacttataatcagagaaatgcaattttttgtttatgtgtttgttttttgagacagagtctcgctctgtcgccaggctagagcgtagtggtgccatctctgctcactgcaacttctgcctcctggattcaagccattctcctgcctcagcctctggagtagctgggactacaagcccgtaccaccacgcccagataatttttgtatttttagtagagacagggtttcaccatgttggccaggctggtctcaatctcttgacctcgtgatccgcccacctcggcctcccaaagtactgggattacaggcgtgagcaaccgcacctggccccccaattttttttttttttttttgagtctcgctctgtcgcccaggctggagtacagtggcgcaacctcagctcactgtaacctccacctcccgggttcaaaggatcttcccacctcagcctcctgagtagccgggtctgcaggtacatgccaccacacccagctaatttctgtattgtttgtagagacgaggtctcaccatgttggccaggctggtttcatactcctaggatcaatcaatcctcctgcctcggcctctcgaagcgctgggattacagggatgagccacagcacctagccgagaaatgcacattttaaaacaacatagaaatattatttcacctttcagtctgacagactataaaggatgacaacgaattcagttggcaaggttgtgggaaacagacactctcatacattgttgaagggaaggcaaactggtacaacccttctacaggggatttggcaagattacatatacacttaccttttgacccagcatcccatttctaggaatccaacctgaagatacatttccaccattatgaaaacacatatgcacaaagttatttatgcagcattgttttttaattgcaaaatattgtaaacagcctatatgcacattcataagagggtgactaaactatatgtagagagtagaatagtggttcctcccccatctcccaagatgtccacatcctaatacatggaaattgtgaatatgctatcttatgtggcaaaagggacttttgtagataggattaaggctaaggaccttgagataggaagattatcctaaattatccagatggatccagtcagatcacgagactttaaaagctgaaaagctttcatagagatgcaacattgctggctttgaagatggaggaaaggccatgagccaaggaatgtgggtggcctttagaagcttgaaaaggcataagacagattctcccctagagccttcagaaaggaatgcagacctgctgacactttgattttagccagatgagacctgtgttggacttctgatcgatagaactgtaagataataaatttgtactgtttaaaccacatttgttttaatttgttataatggcagttgaaaactaatacagtggaaaactggtgaatttagaattagggctgtgtttaggtgagtatagtacctatgttaatttcttagttttcataatcatactatggttatataagataataacattaggggaagctgggcaaaggaaaactctgtactatttttccaaattttttgtacatctaaaattacttcatatctagaggaaaaataactaaggattccttccctcctcagtgtcctttccccactctacctcattaacatccccttaaaaagttgccatgtcgtcttgttatttgtgaatttccaaccaagcttttaactcagtggtttccaaaccatatgtccacataaagacttgttcataaatgtttatggcaactttattcttaatatcccaaaactggaaataactcgaacgtccatgagttgacaaatggttaaacaattgttggtgtacccatacagtggaataaaaaggagcaaactgtacatgcaacagcatgcataaatttcaaaaacattatgctaagtgaagaaagactacatactgcataaatccatttatgtgacattgtggaaaagataaaactataggaacaagtcatattagtggtttccaggggctgagggtgagaggaagggattgactgactacagaaaggcatgaagacatttttggggtgatagaaatgttccatatctcacttgtattggtacagcatacatttatcaaaacttgtcaagctgtacattgaaaaatattgacttgttttttgtaaattacacctcaaacctgttttaaaagaaatgttttaaaacaaaatacataaaaagttggacataaaaggtttgaaataatataacaagaaggtaataaaaatctgacatgacagattcatgaaaatgaatctctaagaatgtaattagttaataaagtatgctagatatcttccattggtccctctagcagatcttaacatgtcaatatgtgttttaacatgttataatgtaatacctgtaatataatatgtattttatattttaatataataattatacataatgtagcataatgacattaatgtgtcaacatcaattagatctgattaatggatatgtgtttattaatttctgtgctttgtatgtttaaaagtttcataatgaaagttttagtttgcttaataaaaaaatcacattgaattgaatgcttgttaaaaatgtagatcactgtgccccaatcccaaagattccgatatatcagatctgtgctagaagaacaattgtgatttatgacagaaccttttctctttccttttgatgcttaaatttgaaaaacaaaaacaaaaaacctactagaggataaactacccatactacaactaaactataatgcactttgcaactatttcttgttttgttattcttgtcatctacagtctcccttcctgtttggacttccaaataactggaagataaacttaagtaaaatataaagactagaaagtaaacttgaacgttttcagttagtcttctcctttttccttgttaattttttagaattacgttttagtcaacatttagtgaatatctacaagttcctaagttatattgagagcaaggaagggaattatttatagatgacacagctttttttctcaggtatttacaatccatgataaaacaaatatgtaaaatacatagagattttaatttactaataaactaaaacttgaaaagcaagaatgaaaacaattctcacctgggtcctttctagttgacagggtggcattttcttactgtgaatcaggtaacattttgagaaattgccatttaaaaatagttaatcacttagaattgctgtaacattgtccttaatcccttgtgtggtcactgatgtgaaaaagtctcaagcagaattaaagcagggttttgttgcacatccctacatttttcatgtgaaaggtgatgacatgtttccctgtctccgcttctccctgtcttaagggaacgcagcagtgctaggatgctggcaaggcattgtcccttattacccccacggaggcttctgagagcagttgcatagcagcagttttatttcagttaccactcattcacagctagccgagttcagtcttcagggaatactccaatttgcaggtggccaacaactttagttatcattgtcttaacatttaccaagctccagagaaaggcaatagttggctttttctttcattgactgttgctaattttaagccttattttgaaagaaaataatgaataccaactaattaaattattttagttgtatcaattgctatgacaatgtaccttttttaaaaaaataatgagctttttactatttttaagacttgtaaatggtagcaacagcatttgaaaaaattggatagagtaggatttgttttgagtgtttgattagtatgctttcagattaggttggtgtcagaaggatgaaatcagtttatttacattctttctttcctttgtttccatttagactggaacatcattcacactcttcacatttttataaggcatggatatcataactgtgaaagagaaaaaagcattttcctcttggtatccatctatttttaaattttatatttggatttttttattttatactcagtgaccacagaatcagttacatataaaagccatttcaataaggttttgattttactttagtttaattatatagctaggaatcctaggggcaaattcttgtaagtcaaatgccacaatagtagtttttttgttttttaggttttttgttgttgttgtttggttggtttttttttgttttttgttttttgttttgcttctcttttttttcctcatattttgaattgtcatattacatttctggctgtttatgatacataattctataataaggtatgtgtagaagttacatataatacatatggggaaaataagttatgttatagtacttaaagtatttgatgtggaattagaatgtcaagaattcatatagcacagtggttaaaaaggaagggttccggtgtgaggctacctaggctcaaagttctcctctgccatttagcatctatgtgaccttgggaaagtcatatatcttctgtattagtctgttttcacactactgtaaagaactacctgagactgggtaatttatgaagagagaggtttgactcacagttccacagccttaacaggaagcatgactaggaggcctcaggaaatttacagttatagcggaaggagaagaaggaccttcttcacatggaggcaagagagagcaagcggggaactgccatacttttaggccatgggaggtggttggagaagattgcatcatgggagaggatttcccctatgctgttctcatgatagtgagtgagtgagttctcagatgatctgaggacacactgcatatgatttttcagttctgaaagcaatttttgagcccctactaaataccagatatcagacctgccctgggaacacaaagcttgcagggtttagtgaggatgacacataagtgggcatacactgtgctagatgtaaggctagctctctataaagcacagtggaggggcacgtaatctagggcagggtcaggtcatgtcaaaaaagacaccctagaagagatcattcctaagcggtatcaaaaaggatgattcagccagggagaaggaagagaatatgagcagtggtaaacatgcatggtgaatatagagaattacaggtatttcaagttagtggaggataaagtatgaagtggaatgaccagggatcagctggaatggtaagtcgttaccagatgatactatatcttataggcagaactcttaccagggccatgcctagctgcttttaggtacctttgggttaattatccatcccttgaccagtcatatggatccagggcagaaagattgcatggcacaaagcatagtgacctgaatatgtaagcagttgctcagaagcaggcaatgggcaactgggcatgacatgtactttgttgtttctcagaagaggataatgtgggaagactcagtacatggttggtccaggatggagggatagtagaagccaagccaagcttgaaaacagtgaatttgttgtggtttcatccggtacagctatgtggtcttcctaaagagcttcgtcatggcaccaggaagattgacttaaatattgttttaattgttattttggatagctaatcattaagaaaatggagggtgttggtaattgaatagcatcagatgattagctgtggaatctagggagaaggaaaagagagcaggaaaaaacaagggacagggagaaaatgaggtggtccagaaagtgaaggtttctgttaggttgaagagtagattaatgtggagaaagagatatatgaaagacatgtgattagggaggaaatcagagaaaaaaatattactgtttaagatgtctgagatggaggatctctgaatgatgataagatctagtgtgtagatataagagtgggtggctgaaatgttgaagaatgaagctgggtcctcatctctcaccttatacaaaaatcaactcaagatggatcaaagacttacatctaagacctgaaaccataagaattctagaagataacatcggaaaaactcttctagacattgacttaggcaaagacttcgtgatcaagaacccaaaagcaaatgcaacaaaagtaaagataaatagatggaacctaataaaactaaaaagcttctgcacagcaaaagagatcagaatcaataaacagacaacccacagggtgggagaaaaatgttcacaaactgcatctgccaaaggactaatatccagaatctaccaggaactcaaacaaatcaagaaaaaaaaaacagataatcccgtcaaaaagtgagcaaaggaaatgaatacacagttctcaaaagaagatatacaaatggccaagaaacgtcaaaaaaatgctcagcatcactaattatcagggaaatgcaaatcaaaaccacaatgagataaccaccttactcctgcaagaatggccataattaaaaataaaaaaataacagatggtgacatggatgtggtgaaaagggaacacttttacactgctgatgagaatgtaaactagtacaaccactatggaaaacagtatagagattccttaaagaactaaaagtagaactgccatttgatccagcaatcccactactggatatctacccagaggaaaagaagtcatatgaaaaagacacttgcacacgtatatagtagcacaattcgcaattgcaaaagtgtggaaccagtctaaatgcctatcaactaatgagtgattgagagaaaatgtggtgnnnnnnnnnnnnnnnnnnnnacacaccccatggaatactactcagtcacaaacaaaaaggaacgaaataatggcattcgcagaaacctggatggagttggagaccattattcttagtaaaataactcaggaatggaaaaccaaatattgtatgttctcacttataagtgggagctaagctgtgaggacacaaaggcataagaatgatataatggactctggggacttgggaggaagggtgggagatgggtgagggataaaagactacacattgggtacagtctacactgctcaggtgatgggtgccccaaaatctcacaaatcaccactaaagaacttttccatgcaatcagacatgacctattcccctaaaactattgaataaaaataaaaatttgatttaaaaaaatgagtggatggagagacgacatgcagaaatggcacacttcaggtggctgaaggagagaaatgtatttggtgtctgccatatctttgcaaccttcagtgacacttttgtccatgtcactgatctttctggcaaagaaaccatctgccgtgtgactggtgggatgaaggtgaaggcagaccgagatgaatcctcgccatgtgctgcttttttggctgcccaggatgtggcccagaggtgcaaggagccaggtatcactgccctacacgtcaaactctgggccacaggaggaaataggaccaagacccctggacctggggccagtcggccttcagagcccttgcccgcttgagtatgaagatcaggcagattgaggacatcaccccccatcccctcttgacggcacccacaggaagtggggtcgctgtggtcaccgtctgtgaacaagactcctcaaaatactttctgaaaataaattgccatcatgtgaaaaaaaaaaaaagagtaggtggctgaaggggaggatactgagtaatggagtcaaggaattatgaagctagggtactagacatcactatttggttattttctagcatggtgttaagagtcagaaaaatattacaagctaggggctaaagttcttaatgaataaaggaaagtgaaagagagattgaaacatgagagcagcaaagagagatgaagaatgctaaatcaagatggtatgtaccttaaaaaatatgcatttactccaaaccatgattttatggactattgatttggaaacagtcatggtaagctaggtaaagtccagctacctcttcctgggtaccactgaatattgggtaatggagaatgaaaaaacttcaactaaatagagctgtgagagaaaccatttctcaggttaaaactatgcttcatttacatcaaggaggtgaccacaaaattttgaaaggtttcactacctccctgaagtattactgcccactctgtgcaatcttaaccttttccttatctgtgttcctaaatcagccatgatttcatgtatgtatttatcaaggacttactaaagtttaaacattgtggttgatgttaaggtaaatataacattatgccatcccctcgaaagtttaaatgcaagacttcttgttttcagataggaaaacctcaactgtaatttatgaaatgctggaggcttagtgtggccaagtttgagagataaaaactgtaggggtattcattaatggggaggccacaatttttaaaaattttacctcctagagtcctaccaggttctcacagtgaatatctgagaaaattcccctcatttttccagcagggagaagggaaaggaggcattttgaaatgcatcagagctttctttctctttctttttctttctttctttctttctttttctttctttctctttctttctttcttttctctttctttccttccttccttccttccgtctgtccatccgtctgtctgtcttttcttcagagtcttgctctgtctcccaggctggagggcagtggcacgatctccggctaatttttgtatgttttgtagagatggggttttgccatgttggccaggctggtctcaaactcctgacctcaggtgatccgcctgcctcagcctcccaaagtgctgggattacaggcatgagccaccacacctggcccgttctgtttttcttaacaaggtctgctctcagaagaaactaatcagagcctaactgatcagaaggaagggaaatacccaattccagcactctctagccatccccttccacctaagtggggtgggtggggtgaggggcactgagcagcacttatgaagttcacagtccagaaacacagactcattaaaagactgagatctaataggacttcagaatgttttcccccaccttactactacatgactaaaggctggtttactgcagttcctctcacctggtacctagttttagcatatcctctcacctagtatttagcatatccagctagcaagaaaataattacagaacatactaaaaggcagaaaacacagtttaaagagacagggcaagcatcagaaccatcctcagagcaagcatcagaaccagcctcagaaaatattgaaattatcagatcggaaacttaaaacaattatgataaatgtactaagggctctaatggataaagcagatagcatgcaagaacagatggacaatgtaagaagagagatagaaattataaaaaagaaccaaaagggaatgctggaaatcaaaaacactgtagcagaaatgaagaatgccttttatgggcatattagtagacaggacacaattgaggaaagaatttctgagcttgaggacacctcagtagaaagtggcaagactgaaaagcaaagaaaaaaaagactgcagaaaaaacaaaaacagaacagacccagaggaaccttaggtacatattactaagtgaaacaagccagtctaaaaaggctgcagtatgattccaaccacagatgctccttgacttacaatagggttatgtccaaataaacccatcataagtcaaaaatatcctaaattgaaaagtatttaacgtcctgataaacctatcataaatcaaaaaattgttcaaaccatcttaaatgggggactatcaatgtatgacattctagaaaaggtaaaactatggaatcagtgaaaagatcactgtttgccaggggttggagtgtgggaggtactgagggatgaataggcagagcacagaggattttgagtagtaaatatactctgcataatactataattgtggatacatatcaccatgcatttgtccaaacccatagaatgcacaacaccaataacaaaccctaaagtaaactatggaatatgggtgatgatgatgtcaatgtagattcgtcagttgtgacaaatattccagtttggtagggcatgttggtgggagtggctatgcatgtgtagagggaaggggaggaacattggaaatctttatatcttctactcagttttgctgtgaatctagaactaagttaagaagtattgtctctgcttctatcttctatcttctgaaagacattgtagagaattggtatcatttcttcctttaatgtttcatggaattcaccagaggaacccatctgggcctggtgcttctgttttgtaaggttattaattattgactcaatttctttaatagatatagccctattcatattgtctatttcttcctgtataagtttggcagatcgtgtctttcaaggaattgatctgtttcacctagattatcaaatccctttttaccattttaaggtccatagaacctgttgtgatgacccctcttttatttctaatataagtcatttgggtcatctctatttttttcttagtctggctacagacttacaaattttattgatcttcataaggaaccagcttttgattttattgcttttatctattgatttattgttttcaatttaatcgattctgcactaatttttatttcttgtgtttgctttggatttaatttgctcttttttttctagttttctaagatagacacttagtattgggtttagatctttcttcttttctagtatatgcattcaatgctataaattttcctctaagcactgtttttactgcataccacaaaatttagatgctatgttttcatttttatttcattcagttcaaagtgttttttaatttctcttgagatttcttctttgatccatgtgttgttcagaagtatgttgtttaatccccacatattttgggattttctagtcatctttctattactgatttctagtttaattccattatgatctaaaagaagacattgtatgatctctattcttttaaatttattaatatgtgttttatgcccagaatttgatctgtcttggtgaatgttccatatgagcttgaggaatctctattctgctgttgttggataaagtagtctatagatgtcaattatatccagttgattaaatggtgttttggagttcaactatgtcctcactgattttctgcctgctagatctgtccatttctgatagataggtgtgtagtcttcaactatatagatttatctgtttctcctagcaactcttaccagttttgcctcatgtctcttgacactctgttattaagcacatacacattaaggctgtattcttggaaaattgacccatttatcattatataatgccattctttatccttgttaagttttcttgctgtaatatctgctctgtctgaaattaatatagctatgcctgctttcttttgattagtgttggcatagtatattgtttccatccatttactattaatctttatgtgcctttatatttaaagtgagtttctggtagatgatatatagttgggttttgttttctgatctacactgacaatctcttttaattggggtatttagactattgacgttcgaagtgattattgacatagttgggtttctaaccatatttgttaactgttttctatttgttgcctttgttctgtgtccttatttttgtcttccactgtttataacctttcgtgattgtaattgaatgacttatatgattccattttctctcctttcttagcatatcagttatacttattttttaaaaaatttagtggtttccctagaatttgcagttttttaaatgtataactaatgtaagtccactttcacataacactatacaacttcgtagatagtatgagtaccttataataaaataatcttaattcttccaccttgtcatttgtatcattattattcatttcccttatatataagtatacataagcatatatatcatatagacataagcatatatacataagcatacataattaaatacattgttgttattacttcaatattaaatcaattaagaagaaaaataaaaggtggttttattttcacttattccttttatactctttgttttcttaagaaggtccaatttgtgacctatattgttttcttttctctctaaggaacttctttaaacattttttgcaatgctggtctactggcaacatttttcctcaattttttcatgtatgtgagaaagctttatttcaccttcacttttgaatgatagttttgcaggttatagaattctaggttggtagtttgggttctttttttttcctctcaacactttaatatttcactccattctcttgcttgtatggtttctgaggagaagccagatgtaatgcttatttttgttcctctgtacataaggtgttttttccttctggcttctttaggattttttctttttctttgtttttctgcagtttgaaaattatatgcctcagtgtagttttgggggttgggattttttttcttttagggtttttttttttggcatttatgctgcttggtattctcagtattctctgagcttcctggatctttggtttggtatattaatttggggaaattctcagtcattattgtttctgattttctatttctttctcttttctccttttggtattcccattacacgttacgcctttcgtagttgtcctgtagtctttggatattcttttctgggttatttttgtttgttctgcttgcttttcagttttggatgtttctattgatatatcctcatgcttagagattctttcctcagccatgtccagtctactaataagcctgtgcataaatttatatttagtatctaaagtctgtattaaatggcaagttccttgagggcagagtttgtgtttatctttgatttccttacaactcctagtagagttctctacaacaaataagcataagttttattaaatacaatgtatcatattatgtcatatgaggtatgatatgatatgtgccacaaggctggacgcagtggctcatgcctgtaatcccagcactttgggaggccgaggtgggcggatcacctgaggtcggaagttcaagaccagcctgaccaacatggaaaaacaccatctctaccaaaaatacaaaattagccaggtgtgtaattccaactgtaatcccagctactcgggaggttgaggcaggagaagagcttgaacctgggaggcggaggttgcggtgagccgagattgcaccattgcactccagcctgggcaacaagagtgaaactccgtctaaaaaaaaaaaaaaaaaaaaaagtgccacaaaaaggtagaattaaattactagatttaattagtagacagtctactaatactgtctcagtcaaatgcttaactgtattttcattagaaatatatgtatgatttttggtcgactcctcggcctggatctcaacctaggcctagcaatcctattacaattctataaacttaagcctggtttgctagctacatttattagcaaatgtggtgactcattctgattgagtcatagaaaatagtacataaagcctttgcctttatgtactaatgactgtgactaatgacagtgactctccctaatgacaccaaaattgtacagttgacccttgaacaacatgggggttagagacaccaccctgctatgcagttgaaaaatttcatataacttttgactcacccaaaacttaactactattagcctactgttgactggaagccttgccaataacatatacagtcaattaacacatcttttgtgtgatatatgtattatatgttgcattcttaaaattgtaaactagagaaaagaaagtgttattgagaaaatcataaggaaaagaaaatatactatttactattcattaggtggaagtgaatcataaagaccttcatcctcatcatcttcacattgagcctttttcccttgcctttagtcaatctctacatacctataataagctggagtgaaaaacagcctagggtattatgtctatgtgatatatactaggagtttttacacttaactccttggatggccaaaacaataagatatagcattataagtattttctttcagtaatctaaatagttccactttgatttgagtaagtttgttttcatttttctctaataaaaggagcaatgcctgcatgtttaaaaatcacttggcttggtaaaacactgtggcagtctatactgttgttcaccaaatattttcagttccctttctgagtacctggtagtactatatatcccttcctccattgaagttagatatggtcacgtgattgttttgtcagtgaaatgagaccagaagtgatatgaagctttaagagctagtacatgtacataatttgctattttacctttatcctgctgcaaaaactgtagaagcccagatagcctcccttagcctaagttcctgagtaaggacagcatagacaggatcccaccccctcagttgacctgcttatggacatgtaacatattttatgccacgaagattaggggggtgattagataatcataacctagcttatcctgataaatatagccttcaccccaaaacagtgggctttggtagttactaaaggaatataaaagatttgatgtgctaatattggcctagtatttctttttcttcattatagaaatgtttattgtacacagcttatataaaatgatattcatctcaagaaagagtcattctccatgtgtcaaaatatttttctttgaattagaatctttgcttgaaaaattttgttttattttatttatttgtttttgggttagggtttcattctattgccccggctggagtgctgtggtacagtcatcacttactgcagcctcgaactcctgagttcaagcaatcctcccacatcatcctcctgagtagctgggactacaggcatgtgctaccatggctggctaaattttttattttattttattttatttttgtagagatggggtctcgccattttgcccaggctggtcttaaattcctggcctcaagctatcctgtcacctcagccttttcaaaatgctgggactacaggcatgagctaccgtgtctgactgagaaattttaatatgcttctataagattcctttcacctgccaatgacagaattgtaaatttcttgaaagtagtgaccgtcattcatttttgcatttattcttttattcaacaaacttttgttaagtgctcactatttgccaggtgcagagtcgaggaggatgttcagggaactctagatagtttggtaaaactggcaggaggcaggcaggggccatagactgtaaagcactttgttccagtctggaagctttaatgatttcataaatgatctatacttcattttaaaatagtttatccacattcaatacttaattttacaatgccatatccaaggtgacatagactgagttttaacacttctgagaccaccaatacattatattttacaacttagttaactcctttttacatatcttagaacaaagctttttctcttctgtcagttatcttttaattcctccaatgcgccaagtaccttctcacctgggggcctttgcacatgccattttctttgcctgttttcccttagtttgggaaatcagtagatgtcatttgtattgaaattgctggtaccatcttcatagaaaggaatatatttgtgtatgttatattgttgtgctttttagaaatctaccagtaaaattagaagtttttcttccataactaatataaacattaataaataataaattaggtgctactagaaagtttagttatcccaattctcacagaagaaaattttctcatcacattgccaggtggtttcaagtgactattatttacaaaattaaaaagcttaaaagctagtttctatttctggtctttattgtaaaagtctaaataccttttgcagagatagtgtggacgagtaacattcccttttggttctctctcccatcaccttctgcctttccttctagggattcttcagcaagcgcctgaaaggctccatcaagaggaccaaaagccagtcaaagcttgacagaaacacgagctttcggcttccatcccttcgcagtacagatgacaggtaggaagttaactttcttaaaacaaaaaaagcagtttgagagtgaattttgttaaggcattttggtctattctgaatttgaatcaatgacaaatagaaaaatacaataaaaaattgacttttatgtcgtgttcatattaaggcaagatacaaaatattgactcaaatacccaaccagtttaagaatgttataatattggagagtttgtggatacataaaaactaatttcagagtcagttaagctatttctgtagaatcaagttacagtggtcagaggtgtatcttttgtttggtttttggtagaatgactataaagaataatgattatgatagctaaacaattttagcactgtcgcaggatgcttcatacatgttatcttgtttcatctttataataaccgtatatgataaatactattattatcaccattttatagatgaggaatctgaagtacagagaggttaaataatcttgcccagggtcatacagctagtaaatagcaaaaatggtatttgaacttgggcagtttggctccagagtccatgctttttactgctatgttctgtatgtatagcatatgaaattggccttgttggtttgcaattacatctagaagacgtgctgaaaaggaagcctgggtggatttccataattaggactactagcttgagtacagctccctaaggataatatgcttcaaaaatcattgaatgtgtgctaacacatttttgacacatcatgtctcgataatgttcaaaattttggaaacagtgcttgtggtatcagcatcagcacatcatcaccaccacctatatttattaagtacctactgtgtgccatacgtgttaaatgtagtctctcatgtaatacaacaaccctagatactattattatcctcattttatagatgaggaactgaggcataaaaagtttgagaaacttgcccagggtcacacagctaataagtagtagagctaagatttgaactcaggtctgcctctcatatttgatactcttatttatgttttactttttttttccagtaagtgactttttttcacttatctacctagaaaacagaaataaaattatagatttgccaagcagatgattactgtctttattttgtaaatgaagggacttgatgagggactactgctttattagcccttcttgaaccacattaaaggtgctctgtgaaatttgcaagtcagcccaatttgcattatatttatattattatctcttttatacctctttgttttaaggtaatcataaaaaaagatttttaaaatatttttcttagtttcctgttattctataattttcatcattccaggaattcaaagcattttattaatgtctcaaaaaatagaataacaattttttttcagattatcgattcttaagaacaaaaatgttgtgcagcaaataaaacactcccaattcaataggcaatttcttaaactctgcagcatcatatagaaacttgggagacaagattttttttttaaagtttacattattttttaaccttgcactaaatgttaccttctttatttcaaacaaagggctctctcctattccattttgttttaggttgcccatgggaattgtttgattgaattaccaagagattatattctcccagagtctcttgtatttctattatatagttactgtatttttagcctttccagtgattgaaatgtattatttgtgacttttataatgttaatgctttaatcaatagcaaagtctttctttcttaagtacagcacaataaaaaagtgctagtaaatctcaaatattaagtaacccttttaatttatcaactccatttgaattgtagagatttcctatacagaaatttttcaaaaaactttttcttgtatagaggtgtactcaatatagtttgaatgtgttaccatttttaaaaaagactctcttgccttcagatcatatgaacagtcagataaatagagctaaggtacaagatattgatcagctgagttctttgaattagtgcccttataggtgtgaccaagtattttctgaagacctgattttcttgggtcagatacatcaactgctgaagtcagccacttctttcaaaatgttatacagtgtctaaatctaagtagcaaaacatttctgttcttttatccaatctgtggaacttccagttaaatgtagtaagcagctccttttttttccatttttaaattataaagtaaaatactcatttgtctttgttttggagggggaaaagtttcagtatataagtaaagagaaaaagaactaaagaccctctttatctttcctatctccccacataaataaccttattaaccatttgtatattttcaaacctctttaaaactccatacataaagggaacccaagtatatgttttcatgttttcatataaatgggatcacatattactttgtgacttgctttttagtataaatattttgtactctccctgtgtcagtaaatgtcagtccacatcattctttttaacaactgaatctttgtatgctacagtgtttttataataatgtacctcacttctctattgatggatatttacattgtttcccttttttggtacaaaatagagatgtcatgaacatttttgaacatgtgcctttttgtactggtggctgggttggatttcagaagtagaactgcttggtatagagtatgtatgttatcaaattttccttcaaaaaaggacctttcccaccaacaaattgagattacttttatccttcagacaaccttttccattttatcaatatgttgaaagaatagaaatagtaaaatgtagtatttattatgtgacagatatatcctaggtactttatataaactaactcatttaatcattacaaccaccctaagagatagtcactgtcattactcctattttgaagatgagaaaactgagacgcagagaaattcgtaagttgcctgaggttatacagcttggaaaatgagagaactgaggttcaaacccaggaagattggctttagagtctgtatttgtaatctttactgtgtattgcctctctaaaagatgggatggggggggatttctttgttttaatttgtattttgctaatgcttagtatactgaatatcctgtcgtatgttttcttcttctgtgacttacctatttcctttgcccatttttctattgagttgtttgtcctatttcttatgatttggaatagcactttttattactacggatagtaagccactactatgcatgttaataaaatttttctcccaatctgtttcttgtgttttaaaatcatgtcttcaagttacatggaagttttcaattttcctttctctgatatgtcagtctttttgggtgggaaggggggcttatctgatcaaatttgatcagaacattgaactcaagaggtgagggacctgtttcttgttaaattcttctttatgatactctgcaaattactttatttttcccttcttcaaaagggagaaatattctatctggagcgatccagaggataatgaaatagtggacatgatattttgaaatcttcaaagtgttgtggttttttttttttggttttttttgtttgtttgtttgttttttggatacggagtctcactctgtcgcccaggctggagtgtagtggcacaatctcggctcattgcaacctccacctcctgggttcaagcaattctcctgcctcagcctcctgagtagcttggattgcagacataagccactgcctccagccagaaatcttcaaaatttttgagataaaccacaaaccttatcttcactcattacacttttatttttattttttgagacagtgtcttgttctgtcacccaggctggagtgcagtggcacgatcacggttcactgcagccttgacttctcaagcttacttaattctcctgcctcagcctcctgagtagctgggactacagccacacactaccatccctggcttatttttatactttttgtagagatgggattttgtcatgttccctaggctggtctcaaactcctgggctcaagtgatttgcccaccctggcctcccagagtctggaattacaagtgtgagccaccatgcacagccctcatatttttaaaagataaaattattctcaggaggtctgagttaccactttaagatagcagaaaaacatttttaaaatggttaattttatctaaagaaagcaagctgtgaaaaataccatagttttaccaaataatgtttctaaaatccaaatgtattgatatacagtaacacactcaatatgtgacagttatgtacaagctactatgctgtatgctacagagaatatagcatagagaaccaaagatacagccctcaacctcgaggagtccagtaaaagaggtaagtgtcaaggaggaaatggtatcggtgaagataaaattacttcttgttgagtggatcaggagagaccttagagggcaatggcctgtgagttggatcttacaggtgtaatttgaacatagaaatagacacgcacacagaactttccttggaatggaaataatgagcaaaagtagaaagtaggaaattatggagcttgaagagaattactgaatagttcatggtattaacatgaaaaggggcaaggtaggaaataagtttggaaaggtaaaattccagtttttaacttaatgggtgaaaacagttctgcttttttttgtcttaaaaattaatatgagaaacaaatatgaactccatctttaatgaaactaggaaaaatatgagagatagattacttaatctataattctcacttagatgacaaacagatgtagttacctacaaaaggaaattctaaaaagaagtctctacttaggattcagtttagttgccaattaacagatacccaaaatagaaatgactgaaacaaggtagaattattttttttttcacttctgtctgaaagtggacagtcctgttcaagtctgccattcttcaggatcttcaagaatctctttataggcataagatagctactagagctccaaccataacatatttgttttagataccagaaaagatgggcccataaaaagacacatgctttccagctgagttatctccctttaaagcaatctctctgaaaccatacctagttgactttgacttctgtctcattgccacctttttctaagggaacctgggaaactttatacctggatatattggtgggcccaataatataggactctgttcttaaggaaagagagagggatggacattggtaaaacagctagcagtctctgcataggaagttgatttacccacctactctggaaaggttcagcttccacccagctctagaaagtcagcagccagacttacccctgtcacatagcagtttgagaaattgaaccaccctggagaaacagacctacagatagctacatttatatctgtaggtttttttgcctattaaaatcccagctgataaattcattcctaggtagatccaagagaaataaaaatatatattcatataaaaacttgtatgtgaatgttcataacaacattattcataataggcaaaaagtgataacaacccaaatgcccatcagctgatcaatagatatacaaaaacatgatatacccgtacaatagaatattcatcagcaataaaaagagtactggtacatgttgcaatgtgtatgcatgttttcaaccttgaaaacactgaagtgggaggatcactttaggccaggacgtcaaggctgcagtcagccgtgatcgtgccactgcactccagcctgggaaacaggagagactctgtctcaataatagtaataataataagccagtcagtcacaaagtaccacatattggatgattccatgtataagaaatgaaaatgccaagaataggtaaatcaatttatatcatcgtgacatatctgaatgctaaggtttaaaaaaaaattaaaattttctagaaagaaaaaataggttgcatacaaaggaatgttgggggtggggggatgacattggaattctcagtagaaacaatgaaaaccagacgttagtggagcaatgtcttgaaaattctgagcggaaattattttcaacccaatattccatacccagagcagatctcgaatgtcaaactgaggagtttggattttagcctataagaaacaaggagcctttaaacatttttgatcaagaaaatgacctaatcagagttttgctatggatggattaatccagcagtggaatttcaggtaacttagtttgcagatactaagtctgagagaccagttaacaaaaagctgtaagaagatataatgagggctccaaggcggatagtagcagtggaaatggagaggcagagacaagataggaggaacgttttagaggcaaaatcaataggatgtcacaaagtcatcattgttccaaagccatctaatcagataaaagccagtaaagcgatttcctagaatcaatattggcagcattttcacattaaagccatgtcatataggagggtgttgggacacaaaaagactctgtgatgtttctgcctttcattcaaatgcacttaaaactaggaaatgactgaaaacagtggtactgtattgtcaggcattccaagattccaaatgcctgttgccagccttgctttggaagtgctacttaaatttaccaaagactaaaggtaaagatgagcatatggagtagaatattctcacccactccaaacttccctcaaataaaaaccttcacagtaatgttctcaattctaaggctcactaacaaagtatggttttaagtagtctactttttctttgtcaaaagatacctgaaagtaagtatggtgttcattggtaggtggaattatggaacaatattctcagcttcttgagtttctccttattaattagaattttttaactttttatcttgaaattatataaagaaagttgcaaaaatagtacatacagttctgtagactcttccccccagctttccccaatagtgaggtcttataactgtagtataatatcaaaaccaggtaatggacattggtatagtaatattaaataaactgcagactttattcagttttcgccaattttacatgcattcatttgtgcatgtgtgtgtgtgtagttctgtccaatttaatcatatgtatagattagtgtaactactaccatgatcaagataaagaactgtttcattaccaagaaagaactccctatgctacccctttatagtcatacccacctccccacacctatcacatcccttaaagaactactaatttgtttcctgtctctatcgctttattattttaagaatagtgtttcacagaatcatatagtatataattggttgagattggcttttttttttttttacactaaacatatgcccttgaggtccatccaaattgttacatgtatcagtagtttgtttcttcggttgctgagtagtatttcattgtatggatgtactacggtttgtttaaccattcagccattgaaagacgtttgggttgtttccagtttttgctatcattaatatgaataaagctgctgtgaacagttagatacaggtttttgtgaacgtgttttcccttctatggggtaaatgcccaagagtataattgctgggttctatggtatgtacatgtttaggtttgtaagaaactaccaaacttttccaaagaggctgtgccattttacatcctgataagcaatgtttgcagaggaattttttatgtcccaagagattttcacttatgttttcttttagaagttttatgattttagctttttttttttttttttttttgagacggagtctcgctctgtcgcccaggctggagtgcagtggcgcgatctcggctcactgcaagctccgcctcccgnnnnnnnnnnnnnnnnnnnngtttcttcggttgctgagtagtatttcattgtatggatgtactacggtttgtttaaccattcagccattgaaagacgtttgggttgtttccagtttttgctatcattaatatgaataaagctgctgtgaacagttagatacaggtttttgtgaacgtgttttcccttctatggggtaaatgcccaagagtataattgctgggttctatggtatgtacatgtttaggtttgtaagaaactaccaaacttttccaaagaggctgtgccattttacatcctgataagcaatgtttgcagaggaattttttatgtcccaagagattttcacttatgttttcttttagaagttttatgattttagcttttatatataagtctatgatccatttagagttcatctgtgatagctttaaataaaagatcttaattcagaacttattgatgttctctctatatatatattctacatatatattgaatatatatatatttttaagagacaaggtcttgctctgttgctcaggctagcgtgcagtggtgccatcatagctcactgtaaccttgaactcctgggctcaagtaatcctcctgccttagcctcctaaagtgctgggattataggcatgagctgtggcaccaggcccagtttaagatattacaaaattctaatcaaaactacacacttgccccagccaaaccagttacaggcagtctgcctgcctttggagaagaaagtatgatagactacttacttctctcctcatctgctcttcccctgtagcctactcaccatgtttttaggcaccctccaggttttggggaaggtgaagcaacaaaaagatgagaaagaggataacaaagtctatcttagccttccataatgctcactgagcctaacagaaatttgaagctgacttttctctcatggggtgatttggggactttttcagagatttatcatccctgaggagctctcacctatggtttcattgactctgacagatgcatttctcttccaagtgctcacttgcgaatcctttctagaaaggagttcttgatgctttggtttcttcatcatgcagtcttatggtccgcaggaaacctccacaaatcttttgccctaacaacctctaggactacaggcttatccaaaagcatcaatgctcttgctctgccaccaacagttagttggtcatttctcatcatctagatttcccagatggaatcaaaccctgccctctatgtatcttttacccttctcccttgtaggtagcaggaggatgagcctcacaacttctttcaaaaattgtttctcacaaaatctttcccattctccattctctgaccactttttatagtcttgacataactgagaggatcaaggtagtggaactggttctaacacatttcctttgtaaatgctgcagttgatctgatacatgactttggtatacagaatctgttttatctaggtgtctcaattgaaactgcaattttcatatctcattgcctatgtatgtaatacttctataaatctgtaatctttagctaccgcacaaaaggcaacatggcccagtctttccctctcaatattacctcctgtcactcctgccaaaagtcttctttatagtattatacttgtcatactgtttcatatttctctgcttttgatcttactgtctcctctaacccaaatgccatttccttttcctataccctgtcttttgtcaagctcacttctagttcatcctcatgcaacagtacccaagtcaggagttacatgctccctcccttctttttggtattcttcccacatatcatcctagactaagtgcctaccccaccccccaactacctgagtccaactctgcatactttattctaggactaacttttttattgaatttatcttttcatatgtctgcttactgcagcagattgaaagctcctccaggatacaatctttgtatcttcattccctagcacaatgactgtcctattgaggaactcaatacacatttgttggcctgaaacagaagaggagagtcaaaactgacttccagataataaagaattacaatcttttaaaatatggtctatgtggatatgacaacttctcagaaattactggactccaagccattaattaatcaatacagtctagctatcgattagagtttcctattccagatttacagccatgggccaattaaggatcccttagttttatgaactaaaacccaattgaagtatctaattgcatcatgataacattttaaattcattaaaatgctttatcttaatagaaaaaatatttctacacatttactccatctttgtattcttccagtgaagagtgtattcaagaatagctttcctgatctcaaccagatgaataatttacataaaatgaactaatgcatgtcatatcactgcaaaaaaagctgtgtgtctacaatcttactccttcacatttgtattgtactgcagtttatgaaatagatgtgaaattatagattactgcatttgattctcacaactgtgtgagatgtaggaagagaaatcattatccacattatctacacatatcttaaatgagataactgaggttcagaaagaataaattatttactgcatgtcacatggctaataagtggttctagctgatgtgaatatgtagggcttttggcttcagtttgagtgtttttttccattatactctttgttgtgtgtgttgatacgaatcctaacttgctgacaaaataagaaagaagggaaaaacaaaggcaaaaaagtacacacacacacacacacacacacacacacacacacacccctcttataccagcagaatactatacggtaataattgagtcaatttatgatcataatatttctgcaatttggaaaaatacaaagctgactccgtactgtactcttttcatctctcctcctctgccaaaaaatccaaatggattgaatgaaaacttaaaagcactaaaagaaaatgtagcttatttcttatgatcttggaatttaaaaaccctttgtaaacataaactggggggaaataattataaatatgacagaaaaagaactaatttacttaatatacaaagagtgtttacatatcagttaattttaacaattaggaaaatggtttaagaacatggaatagcagtttataattcacagaaaagggaactgagattgccaataaacatgtacaaatgtcctcaatctcataattaaagaaatgcacactaaagccataatgaaataccattttttaccaattaaacaggcaaaagattttgaagttcagccacatctcatgttgaagatagcaggtagaaacatgcactgctgatagacacttaaattgatgttgtctttatggagggtaattgagccatatcaaaaatttaaatgcatatgcccttggatctagcaatttcacatctgagaatttgaagtatgaatgtatgcacatgtgcatgaagatatatgtagtaagatattctgaattttgttgctaatcacaaaaaaaggaaacttagatggtcatcaaggactgtaaattattacaggctcatgtaaaggaatactatgtggtcattacaaagagacaaagtatatctgtaggttccaatatggatagaagtccaaaatattctcttaaaaacagtattgtaccatcccatttatgtaaatgaatatgtatatatagacatatatgtttgtatttaaataaattatgtatattatgttaaatacatgcaaatatattgttatataaatatatgtaatatgctatatattacatactttatataattatatacatatatgggtaccttcgtataaaatatttctgggttcacaaaaactgttaatggcctcctttctataggaggttgtgggaggtaccctttttttattctttaccttctatccttctgaactcctggaattttttaccaagagtatttatcacttactgtttcaggagaaaaattaaaagatgattaatttttttaaaaaacctgtttcaaacccatgtctccctctagctattttactgttgtcaccccttcacaatcagacttgtggaattaatcttcacttcctcatatttcattcattttctcaacccattgaaatcttatttttgtcctcttttctgaaactgctcttgccaaagtctccaattacctctaaattcaattcccaaattcagtggctactattaatccacctttcttgagatccctctttcctggccttctgtgatacttgactcacctggtttttcttctttctcaaattcttcagtgtcttttgtcagttttgtagctttaaatgttaacatgcctcaggttatgtttttaggttgtcttctcaatatgtatgttctgtttcactgttcacatctaccccgacaggaacctcaaactcaacttgtataaaacttgattttatttgtactctcacctcaaccagcattgcctcctctttcctatccctgtgaaggacatcaccatctttcacccagtgtttcaagccagaaatgagcagttgtcctggactctaccctctccccaattcctccagcattccagtcatcaaagcctatttacctcctaaatatctctcagtgccatctacttcttccccatatctgttagtctaattcattatctttactcagattactaccataatcaatgaactggtttctaggtctttcatttcttttctctccactctctgtgtactcctttctttctccactccttagccaaggtagttttactgagacacacatcttaccatgtaattccccttctaccacctaaagccttccgatgtacatctactggtattgtgatcaaattcaaatacccacacatgactacaagtctgtgatctctctcaaacgtcattattcaccaggcctcacccactccaacaccccagcctcttctccttctaacatccatactatagtagagccacactgctgaatttctttcactgtctgaacaccacagccttgcatactgtcatacaggccttttcacatgctatccattttctgtagatctccacacctgcatatagtgaaatccaccccatccccatgaagatggttacaactttgtgttactgttttctccaagaagtcttctctgaaccacccccaccttaaaatcctctacttagtgctcatagagccttttttggcatcctttttcgtaagtcttgtcacattgtattataatggattgttaactcactagattataaattgtgtgtgagtacacagaccgtgcttttcttcttcacctttgtattccttgcatctacctctagtatagtgcctgacccataatgcacaccaggtaattattggttagatagatggattcatacatatattcatttattcaaccaaacgagaaactaatgggaaagcaaatcagttatgagtttaggaattactaaaaagtcagtgttgccaagcatgttggctcacacctgtaatcctagcactttggaaggctgaggcgggcggatcacctgaggtcaggagttcaagaccagcctggccaacatggtaaaaccccgtctctactaaaaatacaaaaattaactgggagtggttggtggtacacatctgtaatcccaactacttgggaagttgaggcaccagaatcacttgaacccaggaggcggaagtttcagtgagctgagattgcaccactgcactccagcctgggcaacaagagagaaactatgtctcaaaaaaaaaaaagtcagtgttattgaacttcaccagtttttttcctctcttatccttctacccattacttttatggcaattatgagactaaaagtctagcaactgaaatcagaaataaggaaataaaagctgtagtctgtccactcttactggtatgttacttgagttggattacgagtttggtttggtttggtttagtttctgttttttaaaattcaatgtagttgtgtttatattgaatttgtttaataggtgctagtagattatattacctttgcaatttaaggacaaaaagatatgttataacatggtacagtttctgtaaaggaattgttccctagtgtctatcatattggaggcaagttggattttctactccctagaatatgtcttaatgtttataatctagtcttccttctgtatccaccttcactgtgtgtatacatgtatatgtaccaagtacaaagtaggtaaggatatttttgtctatgctgatacatttctttaccatgagtttctcattttgagtgacaactcaggctgacaaatatccttcttcatcattaccagctggtcccattagaccatcctgtcctagaggctgagagcagggagaagtaagacctatatgttatgtttccataaatagctttttaatgtgagtggtgtggtacatatttttaagctaacataaaaatcagtgagtaatataagcagtagagactactggctttaactacagcaggtaaaccagctcagctggtgctgtcaggatcctcaggctgaacaagtctttgcacataagtagagctctggcgaatgagctctaatttctttttttttttaatccagggaggaaaacctttaaaattataatacaagaaaggatgtgcactttcaaatggcaaacatcagttgaagattttcacaaaatacctaattggaaaataataaaatccagggagcaagtaaagctacatttttcccaaagtgaaagctcaaattcaatttttaaaaaactgattagacactatataaacttgctggtagagtattagggtacccaattttgttaattactacctaggacatttttaaacaaagtgagtgccttagaaatgcatactggtgaatacaacagtatgttgctgcacccagcttactggctgagctatctcatcaggaattcactgaagcagtctggaatcacaactgccaagccaagcagaaactcacctgcactggagtccaggattttatgtggcaataagcatttttaattaaaagtttcccaattcctaaatttggaacttaatctgtaaacatgtagcagattgagctagcaccaccaagcctcattggagctgtgggggaaatgtggcattctgaaaaattggccagttaagctgagaaaatccagctgtgttttacttaaaattgcactaatcagtgttattttattcctctttttcttcaccagtgtatctgctgttatgtgaatgttggctccccatctcccagcccttcacttttatcttttaagactgatttcatatagggatgaggattcaagcaatataatactcattcactttagtgagtaatagaaagcctcacctggctagtagtttatttcttaaataagtcagaagcagcaggtaattttcatcagcaaagcaattagattttaaccattacctatcacattgctagaggtcttgaagtttacacagaaatcaagattgtctgctgaccttaagataaaaatataaagaatatggtgtgccttaattagaagtaaaattgcctctgggaagcagttttttatttaaatcaatacatagtctgttggagccctgaattattcttacatggtgttcaggatgatggggcagtatgggaagtagtcagggagagaacctggccagtagtcaagggattcacaaagtccactttcaaggatgggttagattttttgatgaaggccattgtcagattggactgggaatcattattttaaactcattattctcccaataaatccacattctgctttctgttagaggagtaaactctggtgccaaacagggctactaaaactctgtagttagtagatctaagaaaaatcaattcagaaggaggtaaacatgaattagaggaaacttggggttactaatgctattacattgaaatatttgtacaaataatgcctcccctgtcccaagccagtcccaggctgtttgatcttcctgtttactataatcttgcttctctgggaattacttctgtcttcttagagatactttcttcccaatacagggagggcttgcttatttattcaataataatgttgaatatattcgtgactttggttttcaattcagtacacacacacataaaaatgccaaaagatatgacattctgaactatgtattaattaaaatttcggtaactaggaagagtttggagttataattctaagtggcttagttttaaattctcttatggctacatttgaagttagacctgagtatcaaaatgaaacttgttcagcactggaaatacagtgaaaaaatagttttcaccatctttctgtaaaagaagaaaatatatgtaagccaggtaagtttcagtaaaataatacctagaaacattaaaccacggtaggcactgtaaaggaaacagaatacatgtgagagaaagctttgtacttgcaaggtgagatataggaaatagcttctagtaggggcatgggaattgtatatgaagcaagctaaagtttctcaagttagtccctagtagaggttttactttttattttttatttattttgtatttttggtagagttggagttttaccatgttgcccagactggtctcaaattgctaaactcaagtggtttgcccacctcagcctcccgaagtgctgggattacaggtgtgagccacctagtagaggttttaataagagattatctcccactcccagagttggcctcgtctcttttctattgccttttactgagaacttgttcatagaaatggatagaagcctcaccattccttcctttctgtcttaaagtagtcaactttgccatgtttgcagagcatgccccttgcgttattcaagccatagcttcttgctgccttccagctctaatctccttataggtgtagcaccatggcaacagacccagcctagagcccaggtgccttgtttgttacctgaggggctgggtgcagcctgaaggaatagaataaggaatattacctatcctacaaattgtttggatagatgaagtcttgatctgttgtttgtgtttctgttctgcttctatggaagacttgaaataacacctggaaaacatttattcaaagattttatcagtaaccaaaggcaacaaagaagccatcttctatttgttctcgtcttctaaacagagagttgttttctgacatatagttcagaaagtgacttgctataccgggacatgtggcaccgctatgatttggggttgcactgccaggtggctctaccattgcttcatgtaggtagacgtttattttgtttgaaataaaattaatttatgctttagaaatttttcctagagaatttaaaaaataaaagttgcctttgtcatacctccttctgttttaaacatgccttaatctttcctgttgagaagctcaccccagagcatgagaggatttttcctcccagcaactcctcctgggaaaaatgagctagaattgttgttttgtttaagaaagattacagtgtccagtttccttaatcaggcttcccgtgtagcatattgggaaagattatatgataattaaagtacaatctttctaacatttaattatttatagttgatgtactatatttgcagtacataacatgtcattgtcttatacatagaacagaaggaaataaatatggagcttacattgttatatttttcttttttgtttttttaatttttaaatattttaattttttgttcttgcccaatatcagaaaaataaacattgtcattttaagatacaaaacattaggtagcatttgtcccttttgtgcatactttgtactgtcaacaagaaatataaatgttgacttttttactttaaaaattactaaatatcagaacacatgttttgcagcctaaactttaaatggtggcttgtgtgtgtgtgtgtgtgtgtgtgtgtgtgtgtgtgtgtgtggaaagaagaagaactaaaatccttataagcttaagatttttcttattttatgaaatttgattaaacagtgttagaataaaggtagaaaggagaaagcagccttagtgctagtttcttatatctttttactttataatttaaccaaaagctactctggcattaaatatttaagttccttttagtgttaatgtggttatttcaaggaattaaatgaagctacttatttaatgtgttttataaaaacaattgtctttacacaaggcatttctttttatccttattactaagtacttctgcttgaaatatatgtgtgtaactctgggtgtttacttcaatagatactataattattgagtcaaactgcatggccatccagtttgggattcaagaatattgtacttacgtttgactcctttaattctttcaagaggaaggcagtgaagtactggctcttgtagtgacaagtcatgattcctagcattcttcttataagcaactaggaaacaaaatcagccaggatgactgaacggtgttgacaaagatctctcttctagatgagagtttgggcttttttttccatgctgggaggtttcttcaaggcattttattctttattcatgcttatatagtaaagcatgtattgaaccaaaagcctgccagaaaagaattctatattgagatggaaatcaggacttttgaaagacaaggtcttgtgataaaaagttgagcttcgactctgtgtgtgtgtgtgtgtgtgtgtgtgtgtgtgtgtgtgtgtgtgtgtgtgtgttttgccaaagtagaaagaaacaaaatgaagattcagccactactattctgtcaatcatataagaggataaagctataacatgaaaaacaaaaagaaatcatttgtcttttggcaatacctttgcataagaaagaatatataagataaccttaaagagtatatatttctccgtcttccaaaataggaataagaataaaaaacaatttctgtaatgggatttgaaggtcactcaagactagtaaaattatagtatatttttatgccatattgaaaaaaagtgtgtgtgcactcacatagatatatagagagaatatatttgccacataaatatgattactattattgttactgtagattaactattaatttgttcctcatttatttcttcccttaggcatttgtacatttattgttatcctccattgcattagaccttcatttccttgctggccaagttacactaccttaaatatctttttctacttttaggtctcgtgggctgcctaaactaaaagagtcacgttcccatgaatccttgctgagcccatgcagcacagtggaatgtctggatcttggtagaggggaacctgtatcagtgaaaccacttcatagtagcatccttggacaagacttctgctttgaggtaaaaataaagtgtagaaaaaaggaagagtagttaaacaacaattggattttatgtccagtaattttgcgatttcattgctgtacagttgatgatttaattaactggttttcagttgctagaaattatctacttacagagaaaaagttagaaatcttttcatctaatcatatttgcagttaaagttattaaagatagctttgcattccttttggctttgcctcctttcagtaaaatttgattcttagtacattttcatcaggggacaagactaacaataacattacattactatgttaatttttagtattggtaaggatgtcactcatcatgttatttttctaaccacagcatcagtggttcaagatctgagaccatgtttttcttatttatccatccatccatccatccatccatccatccatccatccatcctaattccaggacattttgacctaaatgtcttatttatttttgaaatcccctgtaactaacccagaccccagcacattgcaggtgcctgatttttgaataaacaaaattgccaactatcataaggtaatttctcccttccaaatatgtactactagccagttacaagtaaaattcaaaaactatatatacatgtatttatacatacatagaattattagggctgagatttgattaattaacaagagcttactaagtgactacagatgagtcctatactagatgttgtagaagtcaaaagatgtttgtttggttcctcttcttatggaccagcactgtccaaaagaaatatagtacaatctgcatgcatatccaaaatattatcatttcaacatgttcactatcagagaaattgtttcctttttttttaaaactaagtcttcaaaatctgatgtgtgtttacacttgcagcacatctcaatctggaatagccatgtgaggctagtagctgctgtattggacagagcatataatctgatcggatttattaggttgtgaccagagattgagttaataagtgagcagacttcagcaatttgggcaagacatttattggtgttcttttttataaaaatcagttgaactttcttgtatttgcggaactcagttcattaggctgtatatcaagcccagagttaggtgctaagtatataacaacatatttcatttttaaaggactgtgttaatagtggtcaggctaacctaataaatgactagaaatcaacaggctggttgcgtagtggaggaaaaatgggttccaaagatagtaattcaatattagtaactcttcaatttcatttagcacccttctataatatagtgaggacagtctcaagaaatctgataagctgtttcagaaactctcatcctttattacctattttttactaactcaaagttgaacatatttatttgcaggtaatttaagttattgcctaaaaggcctttaattttgatttttctgaaccataggccagttttaatttccttggatgaatttaaaatggcctttgttctcatacctggaaatggatgtggatgctacctaagcaaaaagcagatgtagatgtagatataagtatcggaaaactagcaaagatcatcttagtttcttatggtatgatttaggttcatagcatatgtctaactcacagctttgcattccttttggccttgtctactttcaataaaattggactcttagtacattttcgtcagaggatgagactaacaataacactaaattagtatattaattttttagtattggtaaggatgtcgctcattaggttatttttgtaaccacagcatgagtagtttgggatctgagaccatgtttttcttatctatccatccatccatcctaattccaggacatttcgaccttatcatttaagagttagaggtatgctgtgaaccctaatgacagagccctgaaatccagtgttttctttttcttatgtctaatttttatgttgaaggttacctacttaagtggaagtaaatgcttcagctgtaattctgcttctgagagagacaagtggatggaaaaccttcgcaggacagttcaacctaataaggtaatagtagcttcaagtatctaaaaaatgtataactttgtaagcagttaattgatagaaggtaagtgtggtagtaataccttaatttgtctatagcttgagagttttaaagcacatttatatgttatgccatttgtagtaagcccttattatatcaccataaagaagtatctgagactgggtaatttatcaagaaaagcagtttaattggctcacggttctgcaggctttacaggaagcatggtgctgttatctgctcagcctctagtaaggcctcaggaaacttacagtcatggcagaaggcagaaggggagcaggcacatcacatggtgaaagcaggagcaagcgagagagagagtgtgtgtgtgagtgacttggggggaaggtgccacacacttttaaaccaccagatctcacaggaactcagtatcaggaagatggcaccaaggcatgaggaatctgcccccatgatccaaacacctcccaccaggccccacctctagcactggggattacaattcaacataaaatttgggcagggacaactatccaaactgtattatcattttaagctaaaagcagtcttactgcagatattattgccatggttctaccagcatggataaaaggactctgaaaagttaggtgaattggccatgtcagaagctagtacatgatagaagagggactagaatacgagcttcttaacagcttatctcttttatttgcagatattagactggttatatgaaaacttaccgttacaaaatgatattttcttaacccaagtaaataaaatagaatgaactatatataatatatataatgaactatatataattcttcaagattctaatgcatgcttgtttagagcttgctgttaacctaagcaatgagatagcaatccctttcattatttgttgactccccttaatagagtacctaatgaacattgccaacttaagaaaaaaatgtttttttttctgcaatgtcagctctgaaattcagctttgttgcctctttataggacaattgcaggcgagctgaaaatgttcttcgtttatggatcattgaagccaaggaccttgcccctaaaaagaaatatttctgcgaactgtgccttgatgataccctctttgctcgtacaaccagcaagaccaaagcagacaatattttctggggcgaacattttgaattcttcagccttccacctcttcatagtatcacagttcacatttacaaggatgtggaaaaaaagaaaaaaaaggacaagaataattatgtagggctagtcaacatccccactgccagtgtgactggtcgccaatttgtagaaaagtggtatccagtgagtacacctacacccaacaaaggaaagacaggaggaccttctattcggattaaatcacgtttccaaactatcaccattctgcctatggagcaatacaaagaatttgcagaatttgtcaccagcaactacaccatgctgtgttctgtccttgagccagtaattagtgtgagaaataaagaggagttggcttgtgccttagtgcacattcttcaaagtactggcagagccaaggtaagtggaaaagggggattgcagtacctgaagtctcttccctacctttcataaaccaagatatggatattgtagaaatccaaattagagaaatgtgctttactattggtcaaaacaagaagaattaagaagaaaacctattagatccagaaaagatgaagattataaaactaaacaagtaaaatggagagaccagcaaatatttaaagccaatttgcatgaaacatagataacacagccagctctttcttgtctgacaaaataaatggtaggattggcacgataaccctacagcatgttcaaggttccttatctttaatttagttctagagtgttgtatggtggttttcttcctcactgtattttatttaagtttaactgatgactgtatcctctaggcacagaaggaagtattccagaagcatattgagtattagcaagagtctttgtgggattaaaatctatatttagaataaaaatccaagggatatgatacaattggtagctgtttcatgatacacttatttcaccttggatagaagtaaaaactcaggaatattttttatttaaaggagaaatatgctggttgtgggaagaacaaaaactagttgagagagtctttgacctatgaaggatattaactaggaagagttaccgttatactgtatgcaaactggtcatgataaaattacatctcagatccaaagaaactcacagctagaataatgtatttagaaccaaacaaagtactattactatttcttgatatgtcggaatatatcaatatattcaatatttagtctcttatctggcttctatggattataacttttgtgtttaaatttacttatgataatcttgggcattctgtcattaaaaagcttatgagtttggagcgaggtgtcactgaaattttgaattgtatggatatatttctacttttcagttgctcaaggttcagaatatacattaagacttttttaaatgacttaatactgatttacgtacattttaggtagaataaacacccatttaaagtggaaaagttcagtaagctttgaccgattttgcacccatcgaaaccaccactatgatcaagatacagaatgttaccgttacccccaagagtttcctcctgtctcttagcattaagtttaatagtgattcctaagtctacaactctgttatactgttaagctgccccagagtaagtcccattgatgtttaaaatgcttaattttaaagtaaaagtaaatcagcatattcctcctattttggcatttgcagcccttgaaatatccaataattatatagcattcaaaatatatgatgttatcacattcaaactgaacaaccaacattgagctttactagaagttctttaagactgttgaggaatgaagcagctgtttctttgcacctttatttccccttatgctatccttctggattgatggatggatggacggatggatgggtgggcgggcagacagaaagatagcctagacaatgacttcaagtgatgagttcagtagattctacattgacactgtggaccgatttgtaagtattatatattgaacacctaatatatgccagaaactgttaggtgctggagatatggtggtaaacaaaaacagaaactggttttctggggaaaataaatattaatcaagtaattacagaaataaatatgattacagtgagaactacagaggataaaaagagagatgatactatgaaatggagcaaggggagctgactaatggagttcaggggcaatgttggtcagggacaccttcactgaggaaatgatgtgtgaactaaaatccaaaggatcccaggaatgagctacctgacagtgggagtggaagcaagggtgggagcagagcagaactgagaacagtatttggaaaaaaaaaaaaaaaggctttgtggtgaatagagaacattgtgtgtgttagaaagggcttggtgtattaaaggacctaaaaagaaaaggtacaaggcttgaaaggtagacagaaaccagaaaatatagggacttgtagactgcattcagaattatggcctttatcaaaagtgcaatggaaaatctttgagggaattttaaatgtaggggtaggaacacctaacattttatcctgattgctttttttcctttcagatgaatctgatagctttagttttaaagcagcatttccaggatgtctgatatttcaaaagtctcttctaatgtgtattatttattcagttgctttctgcctgattgaacattattctaccaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggtatgaaagagaaaaacatctattttcttttatttacttttcagttttaagctatttcacccccatgagacgaattgagctcaaattctgcatgttatttagttctagctgactcaggtgttaaggtttgaatcatggctgtaagaagtctgcagtactcaccagtagagaaataataataaatgtagaaacagaaaccttgtcagcatacactgctaccccaggtccccagcttcatgattccaggatgcacagtaatatcagcagtgtccactgatagatctgaggtggtctgttttgcccaaagttttgggtgtttatatgatgatattattacctagtcttgagagtgttaccctgacatttgttatcatgcatgcaaaactctaatcaaaagtgaagaaactcttgccacttcccacaactcccccacaaatttctgcctttctctagaatttttaacataactaatttttgtccaatcagtagttcttgctgactaggctacgcacttgcagttccagatttggtcatgaaattgaggcattaaccgctagagtaaggtactgtgctggtcactttaatatacatcatgatagagcagatgtgagttccttgaaggaaatagccctttgttttacctccatatccccactacctgcacacactgttgagcagcactgtccgatagaaatatgacccatgtgtgaatacttttatttatttttattttttgagtaattgtaaattttctagtagtcacagtattaaaaaggatgaagagaaacaggtgaaattgataacatatttcatttgacccagtatatccaaatactatttaatggtttagaagaataaaagttattaattaggtgttttacttttttattctttttgaaaatcagtgtgtatttcacatgtatcacacattttaatttgcacaagccatttctaatgctcaacagccacgtgtgactatcaagaatagaaagtaaaaacatgttgaatgattggagagatttttaccctcgagaagtttgcaatgtaaggatataacattagggatatctctataccaaaaagagacattctgtgttctttcaaataattttaaaaaaattgaatccagctgatagaattgtcaaactttctgtgtgaaatacatttatgttttgtatgtagtttgatgaatagaaaggttaaaaacagacattgagcaagagcagataagataagaagtagcatgggggaaaggacccataaacaaaaagacatagaggtgggacagaaccaggaatgtgtggaataaaactatttagctggaaaaagacatgaaagaaacatgtgaacaacaacaacaaaaagattaaacaataattagaactaatttgtgaaaacctcaaatgcctgggtgaagatttaaagtttacagtaataactggagagccactgaaagttttgagcaggtgttttcagtggaattaacttagcagactgattaagacgagttgtatccaggcatggtggctcacatctatagttccagctactcaggaggccaaggtaagagaactgcttgagcccaggagttcgaggcagcagtgagctatggtcacatcactgcactccagcctgggtgacagagaaagaccttgtcttaaaaaaaataaataaataaataaaggtgaagaaagcctactgaaagccaatcaattaagaagccattgtaggctgggcgcggtggctcacacttgtaatcccaacactttaggaggccgaggcaggcccaccacccaaggtcaggagttcgagaccagcctggccaacatgctgaaaccccatctctactaaaaatacaaaaattagccaggcatggtggcgggcacctgtaatcccagctaaggaggctgaggcaggagaattgcttgaaccagagaggtggaagttgcggtaagccaagattataccattgcactccagcctgggagacaagagcaaaactccttctcttaaaaaaaaaaaaaaaaaaaaaaaaaaaagccattgtaataagaaagaatgagactctgaatgactgtaatcatgcaagtaagaatagagaggaagacggatatgagaaatattaaggttgaactgatagaacttggcaaatttttcagtttgtgggaagcaaggagggaacgaatattacagagaattgtggggtgttgtgagtgactagggggatgatgagattcttaacaggaatagaaaccacagaagtagtaggtgtgaaacagtggaaattacatatatattcaatttgaagttctagtaggaaatctcaggggttttagataggcaatctaagatacctgtctagctggctgttggaaatttgagactaatttatgcttgtggagaggttaaatgaagctgtaagattaccagagcaggaagagaacagggccaaggatagatcttagagtgcacctgggtttatggtatagaatgaagaagaggaatcagagaagtgatcagagaaagagagagcatccaaaaaagaaagaaaaccaggaaaatactgagtcctagataccaatagagaagagagcatcagtagagtcagaaattatggaaggtaaagaaaaagaatggatattgcatttggcaccttaaatatcactagtgatggctcacactggtttcaggaggaaaggaggcaggctgtaaggaatagagtgagtcgccattcaagaaacaggatcactgtgtttacatgaagcagacacattatagtagctactacaattagtttctgctctgaagcagattttttgtcttcctgcttatcttcatatttttttctctaatcatatagacattaagaatggtacaaagagcttaagaaaagtacaaagaggtttatagtgtcatttacataaagagcttattacagccataaattatatctcatgatttgctttaatgatttgtgttttgttaaaaaagtccaccaaaaaaaaaaagcatctcaaaccgtattctccattctatggagataggagtgagtatttattgactatctgcttctttgaaatcaattattcatatttgaaattcagtgtgctaaacaggatttctgaatgaaataatttccaaaatgaaaagtggatactagtctttttataacagtgaatgattaaatggccgatgggctcaatgaggcatgaaaattaattcagtggacatggaaagaaattcaattaacccctcagaaatctctgtaataatatttataatccaagagcaagggccagagtagtaaaaatggctgctgcttctaagagcataagcagaattaattggtaagcttcttcaggacaggggctgtattgtcttcttctcgttaaagttttgctatatttcatatactttgggcaggaaatagatgctgtttccagactgcttgaagaattttcagagagaattgattttaaaagttgccagtaatagtgtacgatatctgtctgcttcttagccagtccttatcttaattaaagcgtcactctttctgcacagactctgcattgtttagacttgaatcttccatctattatcccattttacctttccaattgaaatcagattgcaccttggtatcctgtgacacacaggaaatactatctgtgagatacactaaagaaagccctgatgaaaagacctgatttccacttgtagcagtggaggcaggtttctttcggcagtaatatgtccatccttgttgacttattcctacatgtgaaatttttatgccagatagtaatgagttaatgatttacatagaaaatacatcatagaacattctgggcacaaacttaacatgtaaacaacataacaagcaccccctttggctctggtttttttttcaaatgcaagaaggcaaacttaagtgggttttttaatctgtgttggtaattaagcaccttctagttacaaatcaataaaagcctctcctttcaatatggtacattctgcatgctcaaacattggttattgtttcaacagttaaagtattatttttctattttggagcattttaaatatgtgataatcagggacaaaaactttttaagctggtactatagacaattaatttacttctgggccctggagttatttatctggcacttttcttgaagaattaaagaaaaatatggttaatattcatgttttttattaatattagtattttttcccttgaatacatataacctaaaagaagtcactaaacagaatatttaggatacaggtgtagagtttggccagtttttacatgggatatttgacattgatttcttagttttaaatttaggtactctttaaatgaagtttaattgtggaaacacatagcacaggagacatagagaacatattgactacatatcttgggagaattgataacattttaaaacagtcttttactagttttggccatttcacctgacaaaaaattattcaaaagttgcatgatttttaaattaaaatactttttgtatggtgcacctactaagagccaggtaccatattagatgcttttcatgcattatgtctgttcctcaccacaactctacaggatgattgctattaacactgttttacaaacaagacagctgaaactcagacgaattaagtgacttttccaggccccacagtcagttaaatgatggatccggatttgagcctagatctctgacctcaatgcctttaatttttctgtgcaccactttcctttctgtataccacattgtttcctgttctctaagcatttttcctcaaaattatcgcttctcatctcctgtcacgggtatttttaaaagctttcatttatccaaatactaaccactttgatagaaatgctctttctgctgctgatgctgctacttagttttgcaggcattattgttcactttcatgaagtctgttataactagcctgaacctcaagtaataaacacatatttaggaggatctttgaaagatccactcctctttcataaagacctataaaaaaccaagaatacatactgccatctctgataaatatttattgagcacctgtaacattttgggagctattcagaagagtcaagatttgaacatgaataaaacctagtacctaacctctgaaggtattcatcctaggaatgaaacaaacacaaataatgagaaatatgaagtagtcgaagatatacaaggtatggtgtatactagaggataaacaggtaaggtaggaatttgttctttcagggaatagtgggtgtatcttcatagagcataggccgtatgaacacggcttctaaactaaatttatatggaaaagcatatacagattatgtaaggagatctgctatattattgtgcaatgttgaatgactgtctccgttacaagaggtaaacatagaagatagatccttacttgcatccgtgtttggcaccaacattagcacttaaaaccttcactggactattcaatcaagcttgggtcatttgttcttctagaataacaataatagtcacctaagtagagcgagccttaaaacataacaagtttgtactaattaaacatatatttagtttaatacattttttgagtagtatcattaccacttttataaatactgtgatgatgatgttagtgattgctgttattccacttccaggataagaaaaataaacatgatatgtaggatgtggcaactcttgggttccaaagcaatgaggcttcatgggccatcttttgtgccctccctgtcagatctagaaaagaattccccattatacgttttaggacagaaatcataagtccttttattctattcaggaagacactgtttatagctataccgttatcttctctcttcaaataggggagtttatcaaagctttgtatgagtccgatgagaactgtgaagtggatcccagcaaatgttcatctagtgaactgatagaccatcagagcaacctgaaaatgtgctgtgagctggctttctgcaagatcatcaactcttactggtgagcttatcttatcctctgccttacattttttcatgtaaaggtcatcacagtggaacttacattttttcatgtaaaagtcatcacaatgttaacaattattttacaaccaaaggggagggtcttggagaaaaattgaaagtttccctaatacagtcccgtctaaaattgaaatctctattgtaagcagaagtacttttgaactggctatctacataaatataatctctctaatagaatattagtactatagcctctaatatcaaaagtatttcttttgctttctaaaatatttactagtgttgaacagatgtgttcatgaattttgatcattgctctaactccagcaattggcgaaattttggaagatttttgataaacagtctttagagagattatggtgagttatactaaaccagatggtttagtcaggagcctcatgccattttcccactttgcaaaactaaatttaaactaatccagagttctgtagccttgggtttccagtctccatctggcctctgtgaattttccaccgcctctcagccatgaatcaggtaaaacctcatcccggaatttctactaggtcctcctcacagcctgactcttaagcaaaagtatattgggtcagggtggaatcacttgtgcttgtactggtacttctgtgtttagaggttttggtacttctttccttccctagtgttttccctcgtgagttgaaagaagtgtttgcatcatggaagcagcagtgcctgaaccgtggcaagcaagacatcagcgagaggctcatcagtgcctcattatttctccgttttctgtgtccagccattatgtctcccagtcttttcaaccttatgcaggagtatcctgatgaccgcacatctcggactctaactcttattgccaaggtcattcagaacctggccaactttgccaagtaggtgatactgttgtaaccactttaaaaacacagtttaaaaaatacttgaggcctaaaatttggatgagggttgggagcctcatcactcatgttaccagattttcactgtgttattaataaatatagcaaaaaaatggaaacaacttaatcacttcatagaggaatggttaagtaacctatgatacatgcattcaatggaatatttgcaggcactacaaactgtttacaaaaactatctaataatatagagcatgaagataaaattatattaaaagtgctgataaaaatactttagtgggaaaaaaagggcagaataaaaagtggtatgtatactgttatcccagcaatatgaaaacacaaaaatctaagtataaaaaaagttgggaagaaaagacaaattctgcggttacaatgtctaagacaattatcctggccacttcaaaaaagacaattttatgaaaaatgcaaaagatggaggggggctgttctagattaaaagagattaaatgcaatacttgaaacttatttggatcttaagttggaaaaatatatatatatgtccttttgggggcaatgggtggaatttaaatatatagataagataattcgtgaataatgtttttaaaagttttagtgtgataatagcattggtttatgtaagagatattccttattctgaagaaatggacgctaaactatttagaggtgatgtctgcaacttagtttaaaatggttccagaaagaaaaaaaaaaaaatctgtctagaaagagagggtgtgaaagcaaacttggcaaatataacagttggttattgtagatgaaaggcatatgggtattcattgtatattctttcaacttttctgtaggtttaaaatttttcaaaagaaaattaggagaaaacagttgggaaggaaatgtactaaaatataaacagcagatatatttgggtagcttgaatgatacatccacacttttttctttctacttttcattgtttcaaacttttttcagtaagtttatgatatttttataatttatagaaaataaatttaagaaatggctgggaaggaattcacatttacagaactgaccacagatttactcagtattgatgcttaaagacaagtttctgttagcaatgtattgaagaaaaaaattggaacttcagtgaacagattgttttctagtataagtggtggctttttagaggtgtactattttaattttgtataatttatatataagccaatgcagaaatatacatatttatcgatatttgagctaaaaatatttatattttattttggaacaggttttatggacttaaactaggccctgcagatagctagaatctagataggcaaaggagagaagtttttctctagtgcaagtaaatagcatgggcaaaagcttggagaagaaaaaaatgtgtaatatatttgggagactttgtagaagctagcagtattgaaggtttgtactggtgagcttttggtaggtaagtgagggctatattgcagagaaatttaaatcccagaactaaaaaaaaaaaaaaaaaaaggagttttggctttaccctttagagagaatagaaagctattctcaaagcattagaatattaaagtgatattaagaaagtatgttataacatttatcacttatagataataaacaaaattagtcattccctccacaaaataaaaaaaagtaatagttctgtgtaatgtcaaatcaaaatgatcatatctctcttgaatatgttctttctcattttctcatcctctacttcaggtttggtaacaaagaggaatacatggcattcatgaatgattttttagaacatgaatggggtggaatgaagcgctttcttttggagatctctaatccagacaccatctcaaacaccccaggctttgatggttacattgatctgggccgagagctttcagttttgcattccttactgtgggaagtagtttcccaacttgataaggtaaagtaggttggtggaagatagagaactttaatgtacctgaattctggaaagtaactatagagtgatagcactcactctttctgctaattgaaagcaactgtttaccctagaaatctgagagtaaatggtcatcatttctgagtaaaatatgagatcgacaaccatgaaactctagaaaaccatgacattattaatatatgtttttaataattatctgaattaatggagtatatttctctaaatttatatatacagagtgcatatctgaaaacttgactagaaactaatatattggtatatacagccttatgcatgtctaataggataagatgaaacctcatatagtaatttctaataaaagtatagatttagctaagaaaatactaggtttatcatgttttaagtaactacccatgaaacaaatttttttactatacaagtcatagagtttcatataattattagtgctaacagtcattgttttctttctttacagatgtgaattaagaatacagaaagcaattatttttaatcgtttgctaagaattttattatataccgtattaataagtaaatatacaccatgccaatcattttcttccttctggaatttaacaaaaaggaatagatttggtagtaaaaaatagtctaaaagacgttggctaggcttattacaataattatttattgatgtttttgtttgctacaggcactttataaatatgtgtggtggtatgttagaataacttcaaaagacagtcatttttctatgataatgatctacttattttcctctattttcctatcaataaaaatgctatatcagtaaaatttgaaggggaataaaacctattaacaaagaccactttgctgaggaaacatatgtggtaatgtgtcctccagtgcttaaaatatttgtaaaacaataaactgttccttattctcgaggaccttttcttcacttttagaaatgctagctagatttttaagttgcagctatgccaaagataaacccttttcatgtgaatcgtagcccaacattattgagcaagtaaaggccttggtggcatctatccctgtttgagtagggtagaagagtctgttgattgttgagaaggcaaagacccaaaggcagctatgccaaactgactgacagttgaaggggacccctaagaccccatgagaataagaattccctaaataaaaaaatgattgaaatggataaagcaagtattaaagagttcgtctttgttgaataactgcatctcagtggaatgcagattcagttttcctgtgaaatgggcctggtttattcaggatcaaagtctttttaacgggctttgctgtgtaaacacactttctcctttttaatctgtgtttggtcctgggaaccaggaatacatctagacatatctcatagaggaagtttacctgattttgctgttaaattaacaataaaaattgtcttactgatggaaactcagttggcagtgggtcagggttcccaagattgactgggatagtggatggcagtatcatctgtgtgccctgcagtactctggattcctgaatgagcaccttcttatatgttggcatgcatttcttttctcacatgatcccttttctttgaaagtttatcatactagttgatcctctgatcttgaagttcttttggttagaaggaatttggttctgcctccaccctcccccaccttgatctactagcctcccaaagatttagtttgcttcgcatgcctattttagttggaatggcattagtttggtagttttgagcatgtcttttaatttttacttgcataatcctgatttcgatttcctttctttcctcgatgtctgccgcaccttgtttcgcctcctccattcatctcgacgccatggttctgctgctccataacaatgcattatgaacctgccactcccatatgcaaacacttacccttccctccaacctacacccctccatcaatggccatcgttgtgccaaaaacaatctgtggtggatgtcgcaatgcttattatccaattagggtgaaaattccttcctacaggcgaccgtggcaaaattggggcctctccctcgtgttcttgctgatattaccaagtcattgactaatcctacgccaatacaacagcaactgagacgcttcactgaacataactccagtccaaatgtcagtggaagcctctcctctgggctgcagaaaatatttgaagaccccactgacaggtatgaaagagagaatttgaccactatctcggagaaacataatgtttagatttagcagaagtatattcaacctatttgttgaatttacaagtttaaaatcatgagcaactgaagactcatctgacctgagagcagtccaattatttgtcataataatgcacaagatctgggatgacttattttctagaatggtagtatagagagttacaatatattccacaagcatatttttaaaatttctgtcttgcttagtggaagactaaaggctttatgaaattcatgtttctgtacgttatagcattcaaaatcttggagaacctcggttaaaaccattttatagctggctatgtcaactggacaggtagatacaatgtcgatgcttagactgttttagggattggcaagacttgtgccttttgcagggacctttcagttgtgtgcttagaacttcttctcttgaaggtttagacaagtaagtatgaattggaatatttggggaaggtttaaaacctaactaggaaattattggaatcctggttaaaactgaagacagtgatgggttggtatctacagtgttattctgtacctttggggaaaaagtaaaaatgctggattttattctaagcattgtaataattccctaattagataaaatctgagtttccaaagaaatgtacgtatccacataagaaccttcggaggagttcatatgcctgaattgaggcatcttagccatgttgaagttgtctcaagagaaattaagtgtcctttccttttccacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggtaggtgtgagtgctgaaggggcctggcttctacttggtccatctgtttccttggttctttatacataaatcattgggaaatcctattgttaacaagatttcctcttaaaagcaacctttaaatggaaagaggaaaggaaaaatttgggaggcttctgcccaggtgtgactacagaatgtagtttgactcattacccttaagagtctaacaaacacgcagaggcccccttccttctcttcaagcagcagagctgctacctcagtttgcacttagagcaaatctatgatgttgaatgaataattagatacttaaaatctgtaggcaaaaccagctattattttggaaatctgaaaattaatccttcttaattttttttcttaagcttccagaataaaggtttgcattccgagccaagagtttaatatgactgctctccattccatccctcaactccttctggaaatacaaagtcccatgtggcttttcctggaaatagctagaaaaataaacacttgaacacctgtagagtcaaggtaaaggagagagtaaaaagatagaagcacaggtggaaaaggaagtattctaaacatctgcaaatcccttacatttctatttacatggacaagcccagctaacatcacatccaatcttaatataagtttttctaatttttttattgacaaataaaaagctttgccaagaaactaatcatttcttccttaaatattacattttgaagcatcaatacatatttttccctttgaaacaaactactgttaaatatataatatacacattcatataatttttcatgtatataatatatatctttatatatctttcatctaaaaagatttttctcctaaaaaagcattgtattagttgaattttttttgaaacctaatgatagtactaaaaaacttgagattaaaagagttctatgacaaatccttttatgcagcaaaataactgggcagggagactgcaataaaatcctagtttgtatctgttatatatttgcatttttacagtttaggcacttacctatatggctgcctctgcctccagtctgctatgatcagagccccttgcacctactttgattttttaattggattatttatagaatccttggatacagaaatagaagaagggatgaaaagcatgactaacttaagctgtttctggaagcagacttcctgggctaaacctcctagttggtcattttttactgagtaataaagtttttctacagtcttaaatttttcatttttattttgttatatttcccaaaattttaccaaatcatttgatttagtaagcatttttatttgaagaaaaggaaaaatagatatcttttatatgtatcatatgtattttttatatataaatgtgtatgtgtatataagcataaaatgtatgtgttagaaggctatcagtcattcctaccttattgtgaagtagtttcctcacatcacttttgtgctagattctagttgcgatcaactactttcagagaattaagatgtttattgggaggagaaaggaaaaaatacataattttagaaatcagaatactgtgtagaagcaaatatctactcagggacttagggcagcacaagggcactgaagataaaataggattagcgaagagcatgagatctggcagagagggacaggacagggaaagtgtcctccacctgcttttcaaaagtgtacttaggcccagccctgtacagaaaaggaaaataaagattcttttttttttcttttgcttaccctttccttctgtatcatggagggcctatgactcaggctggttgtttattaatattataaattaaatagccttttttgtgctcatctggaaccagttgtcatttataacattttttctttaggaaaatacaatacctatcgcataagcacataatacatgtttctgtgggttatgattagagggctgcctggatggatgggaggtaggaaatgcatacagtctccaaacaaccaatataaaaattagtttttgtgtcacagccattaatgagtcaccaaatatattttttggcatgaagtggggtacaggcacagtgagatgtccaggtacagctttgaatattaatctttgtttatacttttgctggtactgccactgtcctatcagttgaagcataaatcaccgtattttgattgctcaagtttcttttttttttcctacactggcttttggttcattgttttgaacttacattgttagttttttatttttatttttatttttttgaaacagagtcttgctctgtcgcctaggctggagtgcagtggcacgatctcggctcactgtaacttccgcctcccaggttcaagcagttctcctgtctcagcctcctgagtagctgggattacagatgcccaccaccacgcctggctaatttttgtatttttagtagaggtggggtttcatcatgttggccaggttggtcttgaactcctgacctcaagtgatccacctgcctcggcctcccaaagtgctttgattacaggagtgagccaccgtgcctggcctagttttttatttcttatctgtttcttgcttgctttgttcatctcactcccatgaagcctctgaagttctatataatcagcacatttttaaggcaaattcctttacatattttaattgcaaattgtgttggggaattctctcccagaaactagaggatttctttgtggggattgttctgtaggcggctgtaattatcagtagctttgtcccatgcaaattccatttatatcttagcacaaagtagtggccattgtctgcagagtaactggcttcagtcttctacgtctaatgagtaggaaggaaataaaatcctggtgaaaaaattcacagataaattttttttcaagaaactctcttaattttttaacccatttcagcctctgtttgtattgcttttttcttattttcctctctattttgtttttcatgtatcatctacttcgtacaaacagtagactttatatatatgagttgttcagatttatcatgtactctaatcttagaaatttgaatttgaagagaccttttaaaatagataattgacaagcctgttaatatgatgctgcagttttcacatttagatttgttgaactgtctcttaaccaacctcttcaagaactcccaaagtttgtggattaatttattcggccctttctttggtgttgatagcagaagggttattcatttatgggaatccgactatttcacactatgaagctgaaaccaattggtcttgtttatgtctagtaaatactagcaaggaacgaggaactggcctcagcatagccaggctatgattaattgtagtatcagtgaaactgctgcatcaggctcttttgccctaaagcgttactgtttttccagggaaaccctatacagctttatctcaaagggaagatattcctaatgggaattcctgctcctttttctttttgtctttttcattatctttgatgatcatgttgaaagtcagtggatataaattctctttctaaggccattcctaagcaagatggaatctgaaccacttactaacctcctccctcaattttttggactataaactagagatattttttgctatttatccagcttataaggagatggaacaatcattgaaaagaagcctttggtgcccttccaaaggattaggggaaaaacatagaatattctctaagtaataaattatattttagtaatgaattctaaagataatccagaataataaatgaataatattttattgagcatctgttgtgtatttaactagtcagtatcatttaaaagaactgtatgatatgatgcccattagattgactaattggaaaataagagcaacgcttataagaccaagaatatataaaagatagtatatagttttttcatttgaagaacatactacaacaaaaaaattcatgaaacaaaaatcacctctgtttcctttcaatctagcacaataactattttttatttattctatatttctagcctttttacaattttgtgaaggctttatcattaatagaaggaatagttaggattgatctattttgtcacttttatttttattattttgaccacctactgtatgccaagcaaagtgctaggatatattaggaagtggctgaaaataagatttgaccaacaaaatagtagaaatttctagaagttcattcacaattgcttagtgtgtacgggtctatttatataaactatgcacatccatcctcaggcatgaagctatttttattgatatataactataatctgtaaatcgactaaaccagatctttcttcacacctttaagaaatgtccctatgttacttttgcatgtgtaagttttaaagtctctcccaacccatctctgatagccttttagtctctgcaatcagttttttaatctggtcttcctcactctccagttcatcaaaataccccttcttttaaaatatttatttagagtttaactgagttctatttcagaatggtataaagatccttaagatgtaatggctgtgataggggagaaaatgcccttcaattatgaaattatggaattctggtccttaaaatacaaatccctctatttaattataaaaggctaactcacatgccaagttttgtactctctctttagcttactctctctctctgaggcaggacagaggggaaaaaaattgtgtgtttccatcattgtttgtggagaaagcactaatgttcaatagcctaatataaattgtaatatctaatgctagtttttgaaacataaatattgtaatgactgacacctaacctctctgtagcactctgaagtttccaaagaattttcaaatatattgtcttatcctcacagctccctatgagatgatcaagataggtggtggtgacagtgttggtatgtctattcagtagattaggaaaatagactacccagtatccatcattttgatcctgtattcaagaaattttccagtataaggacccttgagtgatcttaatccatcatgaagtcagtgttctgtaaagataaccagcatcacttgtccttctttttctctaaatcaataatatgaaaactaaatagactggtgcaaaagtaattgcaggttttgccatttaacccacaattacttttgcaccaacctagtatttgccattctgatatataaatgggcactttgtgagtttgtttagcactaatcagttttttggtttctgattgtgtctgggctaaacagatattttgaccatcaggttatgctttctttctcttatttaatcatcaaatagacttttatggcataaaagacttttatggcagaggtcatttattaatttcagcaggcaatttgttacctaccagtatttggaccactgggcaaattaacaattttaaggctttgactttctttagagggagaataaggatgcctcttggatatgatatatgcaactttctattcagaatagtttgcacttatacaaatgtatattctctttccccacccctagccttggcattagtaaaataatacttaaagctaagagcatttattagaaaactgagagatcacagttaatgtcttccaagaatagctgtttgtgaaacatagcacacgggtgagctgttaggggaaatgctaataactgtttctgatgcaggttcagtcacctgtggactctgccacaatgtccccagtagagaggacagcagcctgggttctgaacaatgggcagtatgaagaggatgtggaagaaactgagcaaaatctagatgaagccaagcatgctgagaaggtagaacctagtctgcttcatcaactttctgatcccaaaatgacaggccactaaaaaggttatctagctaagaacataaactcatcccacccccatcttcacctctaccccttatgttaatcatcctatacatatctatgtaaaataggtcagtggtgtgtgtgtgtgtgtgtgtgtgtgtgtgtgtgaatatacatggaaaatgttcatcttgctagggggtggcagttagctactattttttttaatgtagatgccttaatctagaggacactctactattcatttctagtcattttaggtaaatatttcatgtttctgtgtttccataaacttgttggtcttcacccaaggacaaaattaccctagggcaagactttttgtttatcttggtaacaattaggttttggttttagttgttttttttttttttttttttttttgccttttctggataaagaatgtatagctctataaatgactgttaaaaggatattatctattgtttagattttgtttttttgttttttaaggaaaagttgacaaggggtaaaagggttatcaaacaagaaccttgtcatcatatatagcattatattatttaattgacaaccagacaattagcttctttttatcagcatgatattccagtgtactcaaaccccagccacagcaactacagtacaggaaagggccatgtaactaattgagtcactgaatttatgtaaagctccttagaacacaaacatgtatgttccagcaagcagtacaaaattgggcaggtgagtcatattacaaaaatgggcaaagaagcaatattaattggccctagagaacatgtaggcctttgtttagtgcttgtgactggaatactttacacttttatagttggggaaaaagcagcaataacctctgccatgaaagtcttattgattcatgggcttaacattatagaaatgttgcttgttctctgtagggctgattctagtagaacaaaggaatggcagtctgatgagctaagacacatcagagatcctacagtgcagatgatgacacagaatctttttctcttatagacaactgacttttggcttattttaagtgatttgtcagacttttaagtacttcatctggtttttttttccccctttcatttgataccatcacagattggatgtggcttatagcaatggtagcctagtgtagagagagatacatatatatgtagaatttggaatgccaagttaagatttaaaatgtaattttagtaaggaaggcaatgctccattaacatttatgccagttgataattataaagaatattaagaacagtatagggaatgacagcacagccagcatctagctacactgcttagggtttcttttgttaaaaaaaagaaaaaagaaaaagaaaaaaagaaagaaagagaaagaaagaaaagtaaatcactgatttctaaaagcaatgtgactctagtttttgtctccttgcctcctctgccctagtatgaacaagaaattactaaactgaaggagcgcctgagagtttccagccggcgactggaggaatatgaacgccgcttgctggtgcaggagcagcagatgcagaagctgctgctggaatacaaggcccgactggaggacagcgaggagcggctccgaagacagcaggaagaaaaagatagccagatgaaaagcatcatcagcaggttagacatcacctggcagcagatgtgggctagttagcaagacaaagaattgagatgatccacagaaccctgaaggaatggcagcaaaagccatttttatccttgtggtactgagtacaaatgtgataattgactgtatctcttaaaatatcctaaatatgagaccttgggcacttcctatgaagataatctgtttttctttaaccataacaattagaaaaaattaaaacttggtggtttacttgagaaatcttagaggagaactcggttttaaaaatgtaaatatccaatgcccaagactaaattaatctttcaaaataagtccagaaacatggaaaggaattttatggaatatctttagggccagaggacctcttttgagagtgctgcagatgccaagggagaaaaagggagggtcagttttaccaaacacttgtatagcactcgacatgggacacacacctttctaagcactttacacataatagtttgtttaatctttatcacagcctccacctacgcattattattctcattttacaaataaacaggcaacaaattcattaagtcacttgcccaaggtcacatagtgatgcaccaggatttgaatcccggactccagattccatgctcataacctctatgcctcaatatttgtaaaatgctatggacaggtcaagtaaacagaactgtttgttgttttaatagtgtggaggtaattgacagtcttactgagaggtgtttgggtagactggcagaattaaacatcaatgagttaagatgtgaatggcggacagaaaacaagctaaacatactaggtatagagtactcattgaggaaacttagctgtgcaagggaagagaaagtgggccaggtttagggtaacttgagattaagagagggttgtttgttttttgttggttgatttgatattttaagatgaaataagttgtgctcaggaaggaatctgagagagaagagggaggaaatgattatggggttactattccaagggagatgaaaatgtgtgggatccaggcacaaggagaaaaatcaaccttagatgtcttattccaaggtagtagagaagaaagaaaagatggttgcaggtgtcttattaaaaagggcagaggatattgagttttcctgttctctacactagctagccctttctttgaagatgttgatatttccttcctgccacattctaggctaatggctgtggaagaggaactgaagaaggatcatgctgagatgcaagcagttattgatgcaaagcagaaaataattgatgcacaggtaagcaggctttgaatctaatagaaggcacttgtttatagtaacgattatttcctgacttcacacccttgcaaatgccaaggcaggtacccaaaaatgtgtcattgaaaagttctagacgctacattttgaagattaaatgagtgtctgtgtgacctccattattttcctttctttcactggtgagaagtctgtttactcagcaaagtattagcgtgtttagtgcagttgcttgacaaatctcaacctagtgcatgatggggtttgcttctttccctatggaaaggagggcattttctaagggcgtaattgtgaaaagtgcactgcatgtgcctggcttgtgacctccactgaccattgcttggctgtgctgttcatggtcttgtcagtcacgtccactgccatcaaccttttgccccagacagtaatggaattgccagggaaagacaaggttgtaaaaaggtacctttccttgttgttcttttggtttagggtttggcattgctgcttggaatgtgcttggctgctcttctttgttggtgctgtgcttagagagcatcttttgataaaactttaaaaaaagaaaaggttgttgaaatcagaacctaggcttctgctcactgtagctcacacctgtgacaccaatgacataaaggctgccaagagcacctcatagggacatgtcaatgattagagcaaaatccaggaggcaagaagtgtttctaactcctttttattttatcattgcaaaatatggttgtatttcttagggtgaaacaaataacaaaaagcagttacagtttttatagttttgatagtggctgatctagccactgaatgtgttgcttccctgaagatagccgatccaggtttgcatttttcaaccttaaatgacatatcatatccctaagctgtgaaataaaaaatgagagcaaggattttatgcatagatagcctcctcccttctctaggtatcagctagtaatcaacatattttagagcccccagtattcttaaacatgtacttaacagtctagtttccttacagagtccatgtggaatgggtttatttttcaacaaaattgagagtgaggctgaaagcacggtcgtggaaagaatgcttcatgggcctcacactcctttaaacacactagacttggaagtcaggtgagagttgtgaggatgcaatcagcactgctccttaaaatattttggattcttgaactctatagtttctggatacttagacatgcggagaatcagaagaaaggtctgtagtaattatcttacttggtcctttgaaagaaatctttctagatgcccccagggtaggtgaggtaagggtagtggagactaggccatctcactattcacactataaaaaatcatcccagagacttaagaaaaacagcctggataaataaggcaattgagtcaggaaaactaatgttagtaggttttcactttggaaatttcaatataacaatataaagcaagaagagttctattaataaccacacaaggagagatgttagtactaagagataaaacagactttttaaataatttcagctggtttaaaagtatcagtcttggccaggcaaggtggctgatgcctgtaatcccagcactttgggaggctgaggcaggcggattgcttgagctcaggatttcaagaccagcctgggtaacatggtgagacccacctctacaaaaaatgcaaaaattagtcagacatggtggctcatgcctgtagtcccagctgcttggggggctgaggtgggaggatagcttgagcccaggaggtcaaggctgtggtgagccatatttgcgccagtgcactatagcctgagcgacaaagtgagaccctgtcttgaaaaaaaatgtaatagtcttaagcagagggagcttgggtgtgccacagttgtggttctgtacacaggctgacaggacagcctcatgattagctcctgaagatttctaccccaccccctaattttatattagggctaggtgactgggtataaagcagaagtcacctgctaggcataggaggtaaaagccagggagggaatctgatttattaggactcaaatgctctggaaagtaaggactttctctcagttaaccaggagggtgtcatgtgtaggaatgggagaaatgctatcctcaaaccgtaagtcactgtcagactggtggtctgctaagctagttaatgttttcagtccatacttcaagacagtggttttgaaatggtttggttctctggactattttggtagaatccaggcacctttcataaatgaatatccagctccttccactgaccactcaacagcaaggaccacactctcaactaatgaatcaaatcatactgggattggttaaatataataaattacctacccaaacacaaatattactatataataaattattctaccagagacccactgtggatccctaaagaatagttgggagaatccactaaactatatttggaaaacctctgcaccatgcatagcacaaatcctaaacactatagttaaattttaaaaaattatagtgtccttaaaaggaaggtttcttaattccagctgttggcttactgatacattaaaatcttattatagcaaatgactttaaacatcctttggcattctttgtaatgaatgacttttgtatcagatcctttcttttgtaaggataaatcttctctcttaagtgaatgatggagcagagcagcccttctggcatcatttaatagaatgaagacgtgtttggggtgaaagcttcccagagaagtgactcttatgtcaacacttcccaaaacactaccagccaggtgcccagtaaactggttttcatgtctctcagcagccctgtgctcccaggaaaatcttgtccctgaattcagcctctgcctctttttgagtcatttcatgctacaaggcacaggcctgcatcagccactttctaacaggaactgcaaaaggatgagcactcctttggtgagtggcagaagcacctatcctggaccttgtagcttaggggccatagggatcctagtggtgatcataaggatccatttcttaaatatcagaccagagaatgtgccacctttcacccctgagcatgaggagacactgtggctcccaggatctctctatgtgactcaggtggagaacagagaagggcttcctcctatgagaagcaaaagcagctgcctagttactgttgcaagtgatatctccgctgtgttaaattacaggtcataaatggagatgagattattcaaacaggcaagtaaaccccgcgtccgttctctagctgagcagttcccagccctggcccagtgcactggcctcctacacattccagctcctgccactccccacatgggaatccttcctgtcaggtgtggactagattgctttcccttacaatccaggcagaattgaaatgtccgagcatcttttgtcaactgaacttgactttcataagtctctatttgattttttttaacttttttgttttattttgagaggttggcaatagggggaaatacaaagggagtttctttatgtggaaactttcagctgtttagtaggggggctgtttgtcttcagttgttacctttttaggcagtaagtaattacagtcattcttaggctttttgaccctttaaaaatcaaattttttatgaattatttatttttggatgaaccctggagaatcctaatttccttatgaggccttataatttatcccagttctgaaatatcttttctttaatcgttcaagaaattatcagttactcagtttagagatcattcctaataatgcgagtagggaggggggaatatcatacttagctcttacctcttgttttctagtattcactggccagttcttacctattggcttttcaaagatctatatttgttatcccagtaaacttcattggttaaaatttttttaataataattattttttaaaagccttgcagctctttcctttagttttgtctatccttaaaatgaattactttcctaaaataaaaagcattttataccagatgcatgggtcattaatagtgctgattttgtatatcttaccacatgagttctccatcagggaaagaaggatttttttttaaatgataatgacaagcaagagctagtttgttgttgtttctttttttttaatatacttttgaaactgtgaccaccagcactgctgccttacggatcctaccctcctgcccccagaaagcaggagagtaaagggaagtattacttgatgccatggtggtatgtgattttacctagatttttcccccagggccgtggtcttcactctgcatgctcccagtagcatgtgtcccaaagtgtagcactacatgacagccctgggtagctgctgttttaatagcaaggagcagcaccagccctgagccctgctacttcctctctgaactttaccatgactaaactttaccatgcttttctcagggtcaattttaaaaacccctaaggtagtaaaactccttttggctttggaggtattccctatgtgttattttctttttaattttacaggcataggtaaagactgtttcctgcgttgttttctgaaaactatagacttcatgttagaaaggttctagaatgatttactgagctgctgaagctaagattagggtatctcttctaacctaatccttaggagactgataatgttttgataaaatgattttattaaaaaaattttagatagtcctactttcctttagttagactgcctattttttttcctcttttcttcccccttggtttttgtgtgtgtgtattcaccaatgcttggtttccaaatattgtttctaaagcattttttttcagagactcaaaagtaaaatgaaagcaatctccgtattgggcagccctcctggagtaactttgagctggaatgggtctaggagcctgtgttctctgtttgttctcatgtgttatgttgatggcattcccttttcggcacatctccctccccatattcaagtaactccttggtctgagctttttggctgcttttttcccctcttgctgttgcaacctcaccttgttggtgactctacactgccaccatgtattgttttaattttgagcacaatgtgaattccttccaaatgtgactgatatgccctcttttggggctaagaacccatagatcacatgctcttctcctctgtgaaatgaaacctctggtgcttctttctttgccacctaatttccatgtttcaattttgacctaaagcacttagtataataaggcagcttgatacctgtgttgcatagtctgaggtaacacatggtatcacttttacatgacagtctaatgtcccaagagattgttaataaaaagtcctgctatgctgaaagaaaaagagagagagaaaaaaataaacacagatccactgggctcaggggaagctgaacctgaccagtgtgcagaaagaggcagagacgttccatttgtctgggaagcaccatgcatacaactgtttgagagaaagcactggactagtcattcagtaaagaaagcgtgttacctcctgcctgtagcctgaataaagccatgattggtgtgttgtaggaaaaacggatcgtgtccctggattcagccaacaccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaagaaaaagaaaataatggaaagtgtcaggatggcacattccagttattattccaatgctcgtagatctgacaataatgacccaatttcaacacttgtcatccatagccttattattatagaacagaaaaagtcatggaaacgaattcatttccttttttccagaggtgtgcaatgtcatcttgaatgcaaccttgattaccagaagtatggaaggttacatgttaaacagacattatatatacaaatatatatataatatatattcacacatatgtacatataactgcacaaataggaaaagttcatgccttctatgctgttcagatataatgttaaaagggtctcaaacctctttaagcaagatctaagtagttgttttatattgagaaagcaacaatgtttctcgaataagttgatgttgattttaaattataagctttaaagaattttttttctagaaaaaggggatggaaaaaaaaggacctgagggagccatatgcatcaagtgagtgtttctccataacagaatatttataagagaacatgtatagtgccctcttttgagtgatgccgacagacaccaagccctccttttcaccaagtcccaggcttgcattccagcctcttgagctctgccctctctcaggtggatctttgtgttggaccttacgtttcagcaacctcaccatggccacataacccacaaccttttaaaacagtttctttcatagcaatccctgtttctgccagacagatctaaaatgggagtttctcactgtgtttatctgatctgcacactttatatccagctgttttggcacttttacgttttcttcacctttggttttggtttgcaaattcttacaccttctctccaagcggagggcacactgtggtcaaaatcacttattttattaggaaaaagaggtaactgttccaaagtgtagtgtcctttgttgaaggaggagggatgtaagcatagatttgttcttgtttctggctattctcagctcaagccatgtttaattcattctttgtaaaagccttcaattgtgccacagaaaacctggtaagagaattgtcagtttcattggccataagtatgtaatgtgggtgatgtcttgccattgaggtttggaagctcttaagtgccgattatggattacagagggctgataaaattacttatattgggaattgagagaagccccaaaaaatcaaatgtgcttttgatggatagagtgtatcttattagcattatgggagctccttagagggctgtcttcactgaaagatttaatgcccaaaacatttggacagattatgcagccttctactaccaggttatcttgaatgaagaagaaatagtaaaaaataataataatagagcattaccaataagctaaaagttcagagttgctgatagatgttaaatgttaagttatcctgtgagcctactcctgtccaaccttttttctcagtatttctttagagaatgctgcaatctgtataagttactctgaaggattttttaagaagagaagccaccaacaggtgataatttttatggagatgtttcttaattggctttccctcagtt

SEQ ID NO: 12428 - DNA, 45225 bp, Human
ggtgggggtgggggtgttgctctgaagcaagaagagagaggagggcggcagaaaaggtcactgagactaagaactgttttccaaatgaatcaaacctttctctggcaccaagaagggacatacagtattccgagctctgcccttgttttcttatcaagttttctctaacagctggaagtggttgaagggggctgtcttaaggagaccccctgctcttcttttgacagctgatcaaaagaaaataggtcacgcttctcaaacttatgtccaccctgtccttaattactgtctctttaaacaaaggcaacatctgcgcaacctcagctagcttgaatcttcggaggcaaacagagcgcaacctgctttggaagaatcttgttacgtttaaggctttatgccgggtgttggcctctctgtcttcaactacccctccaccccgactcggactgcagaaatctccaactctctgtcccccagttccactcccacctccagacctggggttgccaaacaacggaaattctaggaagacgtaggtgcggtttttaaagccttggcttgtgagcgttctcaggctggccggggcgctggtcttttcagaaacaaggtttgaatatgcaggtgtcagccaggattccttgtcgtctgcccaccgccgtttctctcccgggatttgagagaagcgggagtgtgtgtgtgtgtgtgtgtgtgtgtgtgtgtgtgcgcgtgtgtgtgtctcgtgttaggagaaaggtccgtggttgccgtctcagctggtttgcttactctctgcccccaggagaagtttgctcacttgggacaccagcgaccctcctcacctccacctcaccggttctacactctccccacttctttccaagtcgctgatgcagaaagcacttggtcaccttgaaacggcagctcccggaattctagttttgttttgcaatctagcagggctcttcggaagcctcataactgagatttatgggctcaccgggtaattaaatgatgttattgtgttaactttgcatgcattactgctgcccgcgccgcccgtgggccgccggccggccgcagctcgctggcgacgagggcactacagttgctctgaccgcgtagattatgcatgtcccggcctcgggaatttaccatgcattagaatacattagcgcctgcattttaaaaggctaaactattggctcccagctagggactctcggtaagtggcttgttagtgacgagtgtttgtctatactggcacatagcggagtcttttgctcccggcttactcgcctccaggaaagctttggggtgaggcgaaggcgattgaagcaatgccccttcccccagatcgcagctgctcaggggggacacagcacggcatctttcaccgaatctctctcgctcgctcgcactccagcctccctctccccagcgacccccccaccttctcctccctccctctccttgacgtttgattccagtagcaaaggaggtaaaaaaggcaccgagccgtcagccaaacctgaaaagtgcggccccgccccctccacagccactggtagcttcccgtggaaggcccgcctcccggggcagctgcggcctcggagtggttgcgcttggcgcccgtcgggcgtggccccgccccaggtccgggagggtaggttggctgccccggcgagcggcagagcccttctggacagctcccgctcacccaaacagaagacgtcggcgccggagcgggctcggacatggcgaggctgcgagccggcccgagcggcggggcccggtgatccctccctccctccccgtcccctcccctctcccgcacgcacgccccgtccgcccccaccccgcccccaccccgggcgagcccgcccgcagcccggggcgcacacccgcacgcgcactcctctccactcactcccgcgcccgcccccactcccgcagccgagccccgccacgcgcgccttgcccgcccgccggccgcccccgccgcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctgggcggctgggtccgcgaagccaatgcgctgaacggtgcccgagtcttcctaactatcctgtgcttggccgttgccactgggccctggtgactaagcccaagtttgaaaatgacgtggctaaagctgcctgctaacggcagagcttaatcagccgcagatcccctcctatcctcatcggttctcgtactaaaaaggctcacgcgcagactttttacgcaggtgcattcgttggacaattaaacgtggccctagtaacaaaagcctgagcttcatccctccgagtagcaggctctgcgctggactggtcgggtctaacagggagaatcttgtgtcctaccttggctgggacaggaagtaagagaagcaaactggggaacccctgccccaccccttcccaccccctggacgtcctgggccgaggcccgggtcactggcccatcgcgggtaaggaggtgtcctgtggaacacctgcattgactggaaaagaaagaactttaaagctcttccttcccgcttgtgggggacaccaccacaccctgccaaccactcccctggccaaatggtggcttgtttttccagaaggagcactaaggtgaattttatggaaaaaaaataaaagatcagggacctaagtgggagtaggatgagaactaattcttctgggttttttttttttttttttgaaattatgaatcccacctgttgaagaaggctgagcttttccaacagcgggtatcaatcgggagggaaagcagtgttttccagccctctccaagaacagtaattaataagaggaaggaaaagagagatgggaaagcaaatcgtgcattgttctgctttgagttgaggcagagggtaggctggtgtttcttcctcatcttcccactagtgttcttccttaaagaagggagctttggtacaccaccttggttcctagtcagaaagtgccctaccggacccttttaaactacaatgagatagctgggtaatcagatatgtaactaaggaggagagcaggtggtttccctttggtctggcggacaactggctccctccccacagcccccacttgaaagactcctaggccctgggaggggcgagtgggcctttagaggatagaatcatagactctctcctactcccatcttagaattccaagattgggcaggattcctggtgaatggtgaggtctgggcaaaggataaactgattaccccagattctctgtccctacaaggcaccagcagctgcttcactctccttttgagccaggtctgccctgaggtaacagtaccctaggccagttttaccatcccaagtgccagacttcagccctgagggaaggagagccagcctctcctgctgtcttcaaaccaaggcttcattttacagtcacccccgatatgagagagagcctccccaccaggttttctggcctttagacacttctcttcaaagaagagaccagaggaacaggactgaaaaactctcaggaagaaagtcctgggctccacactccatggctagtggctggatttggcagaaactgtcttcatgaaaagtggtatcatggagggggatccctggagcaaggaagacctcaagggagaagcagagagatttagtttctgggttcttgccaaaggaagggaaattaggagggaataaatagaaataattgcctgtataaagggccctggggaggagggtgaagacagaggcaccctaggccttaaacttcatctagactccctgggctgtgctgacttctgacccttttagggacctttgtttttgctgacttgggaaaagttgcttcctccagggagacaactcttcttagaggggagagtccataatgaggaagccctctggggtgatttatttatgctgtcaggtatagagctccgtcaggctaactcaccctgtggggccctatcaccccctcttatcacccaggctttttccctaaccaacctctgtgcctttgggggaaaggctttttgatttcccagtctcattcaaggcaatggctgaaaaatgtgcataggtttttctaggggcaggtggggaaaaggtagggacgtggattgtgtgacccagcccatctaatgcctgacatggtgcagatgggcaagacttggaggcaggctgtgggctgtgcagatagagatagcctcacttcgggagcaggattcctagaagctgtggacgtttattatgaaaaactgtcccacacaaattgtcccaaagggcagggaggctctgcattccacctcggcacctctttcaccatttgaggacccattactcttctgtagaaagcagactttgtttgggttggaagcacacctccaatgtaatttaatcagcattggactttggctcttgtaatcaaatatacatatactttctcctgcaagaagaaaaataatttctctgtaactggtattgacttgaagtcatgtaatctctggaaagcatcacatttttaaagggaaaggtaaaattaaggggaaaagaacccgcagtgttagtggtttgctttgtcatactaagaagagccagttaccacttaagaaagggcagaagaagcattcctagagcataaatacttgtgctgctccaattgtagatatttcatttacagttttctctgtgcaatcagccttggagatggttaaggataggaaactaggttgactggctcaccaaattctagaatgtgggctttattacttatgttgcattgacatccttgaaggaacctgtttgacggctcatttttctgccgtatttggagaggccacaggcagcagcagctccttgagttccagcaggatctgggtgggtagcaagcctttccttttaagggtgattggcagccattggcagcttgcttcccactccaccccagtgcccttgagcatgaagctgtgccctactgcgtcctcctggagcaagcttggagtccccaccccccagggtgaggttctgggctttgcccaagttgagtctgctagggaatctgttgtaaacacagatccattgatttgcatttgtcagagagtaaagttaaaccagtgaaaagagaagcccttatccttttatgcagggccagggaaacctttcatattgatcctattgatccaacctttccctttaaggaaaccacatagttaaagaccctcgttcaatagatttacccttcgtgcttgtgatattcctttaagtgttctcatctaggatagctgggcattaagcccacactccaaaccaaacaaaaatgggaaggggggtgggaagagagggggtcaggaggcagaattgtgggaagtgaaattaaatcaaactgaaatgtgtaatgacccagttggggatgtttttctcattcttctaaaatgacatgcagggataaagacaaaatagatgcatttggcatctttttttttatgagaaaagaaaatctgtttatatgcctagagtaaaaatgtctcaggaacatcattttctactgtaaaattatttcaattaagccaccagtttgcttcattaagattggttcacttaaaagcagtgatgttgccacaattattttggttcatttgtagcaaatcagaaaaaggattctccccagaaatgcaatattttggactctgtatatgagcataaacactgaagtcacttgaaaagagagaggatttggagtttttgtgttctgctggatgtgggaagcaacgggtagaacttttgttgtggagcagagtagacgcaataggaattgccagatattgctcagtatccctcttgcttgtagatatgaaaatgtaagtctcatttgcctccagaaccatcggcacaatccatttcatttcttccctgatccttttttcctgtctaaataacatccatttgtgatttttttcaacacggtacatgacctgtttctaattggctatctcttgggttgtttttgtacattcatgtttgttttatctgattgaaaaatattaatgatttcgtaggtgagctaatgtatttatctgctgagcgagttcaaagggcagagttcagctatggttcaggttaattgaacaggaagcagtgagctctccaggctgtgttgaacaagggatcagtcccttaaaatatcacactcagcaaacacaatttcactgtcttcatcctagagtctgatgtaaaaggctcagatcaacttggatcacttgtttaaaaaaccaaagcaaagcacagtaactgcagcaataccctggagtccccctcggggaagaagagttttctcattggctaattgctttattggtagcactgacctgcagagcagctgcaggagcctggatgaaggcttaggcctcagaataatgtgctccattagaacagggcaaggcattttttgtttactcaattggagctccctgcaaagtgccattaaccccggcccaactgcttgtgtgctgcaaaagccaaaggtcacgccagtcagtctgtaggcatagcagctctgccctggtaggaaggttggggtcgcatcctgctggcactgccctcccaggggctcgggccagccctctgggccctttccagagttttgactaaagcaagcaattgcacaacttgtttacatttcccaactgctgaatcatgttttgatgattaaacagttttgatctgagcaccatcaatcacacacatacagaaaatccccccactgcccctctattttctatttatgttctcttcattactgtgcattacagtaaacagaattgtgcaaacggtgcttttagcaggaatatagttctgataagtgcttggatcaaggggaagacagacctccaaacatggctggggggctgtttggtggaagaaaggtttcaagtggagtcggggagcacagtcagggcttccaccgccagcaggtgaactagagtgccacctgccgggagtcttctaactgcactaagccctgcaccttccacaaggtccaagccccttccttcactttgttcctaatatccttgtccccattccccaccctgcagatcactacccatgcaagcattatcttcctagaagtagcttaaagggctttttcctggtcctttgaaactgtaacctctgcctcttctaattcattgccaaggagaaatcaacagttctgctgtcataggtgaggtgatttgcccatcctgcacattgaggtaatagtctcctgcttagttggactgtgcttgggggaagagaagcaaagaaagcaaaaaatagccgtgggagggaaaacgaatgattatgtgtggaagaaaaatggctccgttgattgtgccagtgagggctgtgccaactgtaaggtgttctgcaaagataaaatattgtacaaaggagagaggatgggagagaattagcatctacagggaggacatcgagaaagagatatgccaaatcagcaaactcgagtttaggctttgtgaaatcccctggaaagagaaaaagtgaaccagccgttttgcaattgcaaagaagtgagccagtgagctagacttcgagccagactgtggagctggctgtagctctgtgggtggcagctatttccacacttgcttcacatggacccctgcctggagcccctggtagcagagcgcctgtgggtgggttgctgcctccacgccccggcgcaggcttcagcaccacgaacagcgccatggaggaacgctgtttgagcgaattggagatggaccctctactgcggttaaatccaggcaagagcctgaccagtagctctagctctgtaggtctcagcgccccagtgcagggcctcatattttcctctggagccctgtggcttttcagctctctgtgtgagatcagcgataataaagggaagaggaggcggcatctgggtgagaagacaaaagatgctgaaagactttccctctgaagaggaagagcattaccaccgctggggggcgggggattgaactatttttctccatgttgctgccttctgcaggcatgattgccaccctcaacgggatgttttagatttaggatttcctttcaagtgttactgtctgcctgcccccacgccccaccccccaggtatacacaaacggatgcttttgtttccccagatgcatgctcctgatttttgaaagcatgacttttattatattaaacaatattctcacattatagcagcagtaatgtcacaaggagaaccaactgtggagcatcaccaccttcgataaatctagaaactggatttgatttcttgagagtctagtgatgaggctctttttaataaaaaccttgccactgcttctgtccctgaccccctacgaagggccagagatgttgagtgacttcctccaggccacacagtggagtcatatggcactggccagggtgagaactgacagtaggcactgacccctgactctggcctttttcaatcagttgctttgctttatttctggttttattccagagaaaagagataggagagtccttttggtcaatgattgagcacaactcacatctctttgggtttcgagtaaaatggtccttgacttcccaaagctaattaaaatgtaaaactcttgctttatttcaaataactttagttcagacctaatttattgctaaggtggttctcagggaggtagagcattggaatagacaagtgtgtctcctttaaaagtcaagggtatgataaatgagaattttttttcccctgtgacaatttatcttcaagttccaggtggccctttgtgtaaaaggagggaaaatccatcccaaaacaaaacaaacctggtagagcattcaaatttgatgttgaaaaaaattgtttctgtgtgtctaaatgcccaaaattttgttctaaaaatgagcaggaacatatctgaatcagatataaaaatgggtgttaaatgtattttgtaagctttgactaaagaagtttcttccagctgtgtagtcttcgaatctgtggacgtgcctttctcaggagttgttgggttccactgtcaaaaccttttccagtaaaacatggagtgttggcaacagtaagtgtagcctttttggcctactttatatgcatcactgcatcttactaaaatgaggcattacactctacaaggacttgtactgaatgcatttcctttgtagtgaactcaatatgcttttgaaaagatattttacagaactgccacataaacaagaccttttctattatctgttttgaccctaaatactgaaaagtgtgtggagtaagataattttatgcttttctgaatcagtgccatagatccccaaacctaaaagatgtaggggaaaaattcgtcttggatgcaattgcctcctaatgtataccagagttcatttctgttcatgttcaagggacaagagtgaattctgtattcactttcaatgactaacccttctcatcctttccttcattcttctgaagaggaagaggtggacttcctgttgaagaccaaatcctctcctgccttctcaggaccccatgcttcctgtatatagatgtccctgcttttgtgaagttttctctgtcctcctaaattgggatctctttggaccatccctccctttgcatttagaacatagataggtatcgcctgctgacttgtcagtgtcagcccattagattaagatccagaagaggaggttagatacagcatacaggaggcagccaataaatatctgtgaataagttaataaatacttttcttttatatgacactgtttctacccattgtatttcccccatattattgtagatggcatctgagtaggaatcatcagccccagcacatcatttaggagaagcatttcacaatgtcaagttctcatcaatgtcattttcctcccaaattacgatattataactatgtattaattttaagggaatctcaaagtaggattgagtcttatccaaatcttcagattatcgccaatggagcaagagatgtgaaatgatcatcactagactctagactaaggacccattttgccaattggctctagttaccccaaagtaaccctccccagtcagtcagttctcctcgttttcctgcttaggcattgtcctcactgtcctgtccatgtctttgcacgttctgttccttctgcctggaattccttatctcatcagtccttctccaggtcctatcattcctagccacctccgatctgcctctgaaatcttcccagctaactttggcccattcctttctgtttctttctgaactcgatttgcaatcattgcaaatgacagaacagccttgttggctctggtcttacactgctctctaggtcttttctgtgtctccctttcttccccatggctctggaggggagatagcatatctttgagctccccatggactgctggtccatggctgaacccacaccaggtattcttttttgagtaagtcatttggtggcctcctgtctatctttacagaagcccctattctcaacgagagaataggttgggtatgtttacttacatctatcattcttttctagcttcttctctcaaaagggggtattcttttcttattttatttttttgatctggagccgtactttgtcacccaggctggagtgcagtggtgcgatctcggctaactgcaacatccgtctccagggttcaattgattatcctgcctctgcctcctgagtagctgggattacaggcacctgtcactatgcctggctaatttgtgtatttttagtagagatggggtttcaccatgctggccaggctggtctcaaactcctgaccttaagtgatccacctgccttggcttcctaaagtattgggattacaggcgtgagccactgcacccaacctgaaaaaggggtattgttttctataaatgctttggtcattgttggaaatattggctacataatttaaaatggatttctatgttaatctgaaatgagacataagcttaatatagagaaacagggcttgtgatgtcttcgttaatagcaaaggttgttctgcttcatacaaggtggaaaattttacccacctcagggcaattgtgccagcaattatatcagcaaatcagagggactgctttcctattttaagtcattttaattatcagtaaactaaacttgcatctaaacagccattacttgagatactgcaagtgcttaggttgttaataacgtaaagttacctgtgaagaaaaaaaacagaggttaatatttttatctttttattttattttaattttatattttattattttcctttgatgaatccattgctgcctacactgtactgaactaagtagttgggagtgaaaatatatgaactagcccttgtccctttttgactttactgtatatttaagatttgaatggatacatcctcacttacctttacatatccatatggaattgagtgagaacagagtttattactatgtcaactttagttggaaactgaaactaagatcatttatttgctatacatcttacgtggaaattatatattagctcgtgatatttcatcttttttacagttatgttttgacgttcatattacatgagtaacaaattatgaagactaaccatttatgaacagaatttagtgttaaatgaaagcattccagatttttattttctgttgccttgaattgaatgcattgctgtgctgcatgataactaggtaagcaattgacctgtgtgactgtcatttctgtgccttgcataaccaaaccaagtttcctctgacactgaggcagagacaggcagggttgcgctgggcaggaagcagctctgaggcctccctgaagggccttagactcccaatgggggagtcagaggccaccctgttctctggctacggcaccatagcctagacatgggtgtcaccaaaggctatacacttctttacctccttttctgccctcttcctaaaggaagcatctggaaccagaaggagtccatatcgctagccccactcctccctaaccagttctccatcccgagccttagattcaggcttgcataggcagattctggaaagtccattaaaagggcaggatgtggagtaaataggtgattggattggagggtaaagggcggaaaattcacagcagagacaggtggacttttctaactggataagctacaccaactcatgaatccaagtattccacccctggaaagcaagaggtgaaagcaagttggttccattggtgaaagcaagtcacctgcctgagcccagagacagggtggaaaggctctacaaagttacatggcaggaagcatgggcacagaaaaggcaagcatgaggaatggggggggcggtgttggtgtttttctttgtttgtttgttttgttttgtttgcattctacctcatgccatgtattttagctcatttattcttggaagctgccactgctatggtgatacacagacatcaaggatgtccaatagtatagggctaattttggcaacacagaagataagtgtgggggtatttcacattcataagtaacaaacctatgcccacctggacaggaaccacgcctctttgtattgagactgtttgtgacatgcttgatcttctcgactagatcatagcaagcagggaccctgagctttgttctcctgcatcttccctttagccccaccacaatgcctaacacatagtttgcacttagtaaatatgcaaggataaatgatccccagaatcccactgctctagtgtcccaatgggagatcccctcaagacccaccaggtgattgcttgtagctcaacctgtattttattttattttattttattttattttagagacagagtctcactctgtaacacaggctggagtgcagtagtacaatcttggctcactgcaacctccacctactgggttcaagctattctcctgcctcagcctcccaagtaggtgggattacaggtgcccaccactatgcccagctaattttcatatttttagtagagatggggttttgccatgttggccaggctggtctcgaactcctgacctcaggtgatccactcaccttggcctcccaaagtgctgggattacaggcgtgcgccaccacgcctggcctcaacctgtattgtaaaatagggtttcactttaaacttttaaattttgttctactacaataattaccaaattccaggggagcaaaggtccaagcctgttgcctacagaattaaggcatccaattcagatctcaattattttgtgttaagaaaatctaaacaaagcaaacactgcttagggtttaccaatgaataaagaagcaagttggaagggatatcaaaaagatcaaaatgtttgcgcatttataactttaacaatgtctaagtttttttaaacttaggttctacatctggagcatacttttttaaaaatcataagcagtgttaaaaaatacttgacagttttgtcttgattcttaatgtgggtgttaagggatgccgtccattagtgagtacaccccagatcatgtgtttattgcatcctccttcttccctgcctgtcccctaatgatctggtgcacagagggctacttgagctgagttatatggatctcagttgctgtcatttgcacatacttaattcagacaggtgatcacattgatttccaagacccaatttttaagacactgtactcacgtagatatcttagctgctctgactatgttgtctgaaaaggaaaacattttaagcctttggaagcaattttgatggacatttcattgtgttctatattactcacataattaaatttccttcaagtcaaagtctgtttaaaattaaattgagaaatatttttgagttccatcaggcagataactttgtttagctagatttgttctgcattcacatgaaatggcatcctacgaatcaatacccagtgctcacagttcccctgaatgtgaagaaatggcacccttagtaggcagttgtagtctcctgtaattcataacaagctgtccctagttattgaacgtgtttaccctgtaatcccagaaagttcttgtgtttttatgcctatggttttgcaggctggtttattcagattctgagcattgtgaactaaattcataacttctttcatgcattagccggagtcataggactctgatttacagactcgcagtccagctcacagcggctagctttctttgggtcataccagagtttcatctgcatggccaaaggggtagaattccaacttgggtttgaaagcaaataggataaattgtcagaagatgtattcctgtgtacatctttggaaacaagacataggaacaaacccttatttttcaactccacccaccctgctactgaggacagaagaacaagccctcctcatcttttatcctgcctctccttgagacagccattccattaaattctatggcgagggaatctatggtgttcgagctgtaattgaagaattagcattccataaatgctgccttaatttttttaaaaaaattgttccaaagaactgctttttgttgcattgttaattagcctttgaacatttttgaattcattataaccttcaaggtctgccaaggtctttaaggtttcttctttatggctttgcctctaaataacaataggtacattgtaaggttattgtgagccttaagtaagttaatgcatacagatgcttagaataactggtaaatagtaaatacttgctaaaatatctgccattattgattgattgattaattttttgtaacttctccatatatcagcaggaaatttggcctgagtcaccaatgttcccatagcttttatatattaagaatattgcttggcattgtcaatgacagcatgagccaaacagatccagtttgtatctgagccaccatttactagctctgtgatgtcaggcaggggacgactcttgaagagcctcagttccctcctctgtaggaggaggacaaggtaggtcctgacgttatctagttggtgtacagattaaatgagacgccataagggtatatggcacctggtacattgcctcctatctcctcagttttacagctaacatcctattacacatgggccacatctgtacttcaacataaattttttgtcattttctcagatgagatttaggatgagtgagattgccagactctacactcatcactgggcatgctgtttgcaaactggccaaccatgcagccggactatttactccccacccccaatgtccttttaagactcccttaacagttatggacattttgctaagctcgtgcttagaacccagaagttgactgtgcacacagtaggttctgactgaatccctacaggcttagattggaatacagtccattttgcaagtgtggtatgtattgagcagacattctgtatttgatggaagttcacatataaaaatggcaactgagccaacaaaactcacatcatctgtctctataatgatcacaggtttggggggccttatcagaaagttatttttatagacaccccggtggtcatgagatttaaaatgctaaggagaatggcttcctctttaacctcttttctgtttttgatatgtctgggccctgcttctttatcttgttccccaaatccattcacttaggttctgacttggctccctggagagctcctgttttggttcacaccatcatctttattcccaaattaggatccttaacaagaaaagagaaaagaaagaaaacctgtagacatccagatgttgctttttctgaagtaacaactttatttgataatattttgaagccatgggccaccgaattctcaacatgcaagtttatttaaacagtctctagtatcctttcctgaccccaaattactttcaagcattaattgtcctagtggtttcatggccatattatttcatattcattagtgttttcatgaaaaattataacactaattagagtggcttccagttaattcacttggtgattcattactctctccttcttggtgatctgcatgtggtcatcctggagaaagcatccaagggtaattgcagctctattccctgagtgattgcctaatgccattagttctgatccacaggagcatctcgggaagctctgatggggtctggttacagctgcacccttgtcctgccctttggatgcagggagaaagggaagcctgcagtgaggactggtcctccggaggggtctagggaaacagaggggagggacgtcttagggaaaaggaagtaggggcaggggagggagttcagggatttgaacatcactttaacatcttctagaacttgggtaaggacagtatagagtaaaatctgccctgagaacttgcacgtagagtaaggaaggtggtttctcttcagtttcagcagacttgtggccaggcactgagctggagtttggaaacccggttccctctcagagctctgacatccagttcttccaactgaaagtttatttgacctcattcccattaggatggctgctgtaaagcaaaatgaaaacaaaaaataacaaatgttggcaaggatgtggaaaaattggaaccttgtgtgctgttggtgggactgtaagatggtgtagccactgtggaaatagtatggcagttcctcagaaatttaaaatgtgagttatcacatgacccagaaataccacttctgagtatacactccaaaagaactgaaagcagggtctgaaagagatatttgtacacccgtgttcactgcagtgttattcacaacagccaaaaggtggaagcaacccaacagttcatcaacaggtgaatggataaacaaaatatggagttttcatacagtggaatattatttagccttaaaaaggaaggaaaatctgacatatactatggtctgaatgagtcttgaggatattaagctaagctaagtgaaataagccaatcaccaaaagacaaatactatatgatttcacttatatgaagtgtctagaatagtcaaactcatagaaacggaaagtacaatggtgcttgccaggtgcctgagagagggaaatggaaacttgtttaatgagtatagagttttagttctgcaagatataaaagttctggagattgtacaagaatgtgaatatacttaacactatggagctataaccttaaaagtagttaagatggtaaattttgttgtgtatattttaccataatttcaaagaaagattgtttgttatttatattgtattgcttgctcaatttttaaaaaaaattaaaaatagaaaaacaaaaagccaggtgcggtggcatgtacctgcagtcccagctactggggaagctgaggtgggaggattgcttgagcctgagttctggactgtagtgccccaggcccatcaatgtcctcactaagttcaccatcaatacggtgacttcctgggagtggggtatcaccaggttggtgagggaaaaaacaactactgccatgttgctttcagttcttttggagtatatactcataagtggtatttctgggtcatgtgataattcacactttaaatttccgaggaactgccatactatttccatagtggctacatcatcttacagtcccaccaacagcacacaaggttccaatttttccacatccttgccaacatttgttattttttgttttcattttgttttgacagcagccatcctaatgggaatgaggtcaaataaactttcaactggaagaactggatgtcagagctctgagggggaaccaggtttccaaactccagctcagtgcctggccacaagtctgctgaaactgaagagaaaccaccttccctactctatgtgcaagttctcaaggcagattttactctatcctgcccttaccccaggttctagaagatgttaaagtgatgttcaaattcctgaactccctcccctgcccctacttccttttctctaagacgtccctcccctctgcttccctagacccctccggaggaccagtgctcactgcaggcttccctttctctctgcatccaaaggtcagttgtgtttgctcagtagtgggatactgcctgtgaatagccactgtactccagcagcttaaaactccatttcttaaaaacattttttatcaaaagttctgccactccactattcacaatagcaaagacttggaaccaacccaaatgtccatcagtgatagactggattaagaaaatgtgacacatatacaccatggaatactatgcagccataaaaaaggatgagttcatgtcctttgcagtgacatggatgaagctgaaaaccatcattctcagccaactatcgcaaggacagaaaagcaaacgctgcatgctctcactcgtaggtgggagttgaacaatgagaatacatggacacagggcggggaacatcacacactggggcctgttgtggggtagggggctgggggagggatagcattagaagaaatacctaatgtaaaagacgagttgatgggtgcagcaaaccaacatggcacatgtatacgtatgcaacaaacctgcacgttgtgcacatgtaccctagaatttaaagtataataataaaaaaaagttctgccactcaaagagaaccacattaatattttgcttttattaaaattatttttaattatttaagcaatgcattaaaacattctacttataaaaatcaaaacattaatgatcagaataaagtcctctttgcctatctcctttaataccagtcttcttcattacttcccagcagtaaccactcttctggctacaaagagtgggtctgccaatccaggcacttccagtgcatttatttacctacatatgtactcatataaattgtataaataggtagaaagacagatagatagatcgataggtatcttaggtttgcgtattgttttcacataagtggcatcacactgcatgcatcattccaaagctccttctttcctttgatagtatgcctacccagcttctacatataaatgaggttcttgcaacccacatttattgcatagtgtcctatggcatgactattttcatttatttagccatttctgttttgatgggcaattaggctgtttaccatttttggttgtttgcattatttgctaagcagtgatgagtgaacatccttgtacacacctccctgtgtacccatgggaatgtttcctagggtggacaccgagaagcaaaatgagaggtcatggagatgcacatactgtaattttgataggcactaccacactgtcttcgaaattggctccccatcagcagtggaggagagagctcctatttccctgacacttgccagaagttaatatattagccattttacttttttttgcatagttgctggatttaaaaataacattttgtggttgctttattttgttatatttttatgatttctaatgaaccttgatataatcatatacttgctggtcatatatatttccttttctgagaatgtcctgttcatatccttgtttggcattgttttttatatattctggatgcaaatttttgctttacaaattacaaatgtggtctcagttctccagttaaaaggcataaagtgattgaatggttaaagaaacaagacccatctatatgttgccttcaggaaacccacttcacccataaagacacacatcgactgaaagtgaaagagtagaaaaaatatttcatgcaattggaaaccaaagaagagtgggagtaactatacttatatcagataaaatagactacaaatcaaagactgtgaacaaagatgaggagggtcactacgtaatgagaaaagggtcaatacagcaaggggatataacaattataaatatctatgtgcccaacactagagctcccaggtatataaagcaaacattaatagatctaaagggagggatagactataatatattgaaaacattttatcccatggtattattttgaaacttaataaggcttcttttaactttgatgtatcaaattcatcttttttattatttattttttatgagacagagtttcactcttgtcgcccaggctgagtccaatggtggtgcaatcttggctcactgcaacctctgcctctgggttcaagcaattctcctgcctcagcctcctgagtagctgggattacaggtgctctccaccatgcctgcctaatttttgtatttttagtagagatggagtttctccatgttggtcaggctggtctcgaacttctgacctcagatgatccacccgcctcagcctcccaaagtgctgggattataggcgtgagccaccatgcccggcccaaataaatatttttgttgctcttcctttactttatgtgttttgcttcttgggtcatttttatttattttatttattttttagaggcaggatctcactctgttgcctaggctgagatgcagagccccaatcatagctcactgcaacctcgaactcttgggctcaagcgatcctcctacaaaagcttcccaagcagctaggactacaggtgcctgccacctcatccagctaattttattttatttttttcatacagatggagtcttgctatgttacccaggctagtctcaaactcctgagctcaagcaatccccccacctcagcctgtgtgctggggttataggcgtgagccaccatgcctggccttgggtcatttttaaacatttgaatctttattctttaatttttctgaagttgctttttataaattatgtgaaattggaatctatttttttaaaatctcaaatggatagccaactaatccaacagtttctgaacaattcatctcttctcactatttgaaatgcaatactttctttataatatattatattcccttatgtacttgggtcagtttctgcactccattctgttccatggatctattaaattctgtgtcaacgtcatactatttaaattatttttgctttatgatatatcttgagctctaataggatatatattttctctcctcatcttctgtttctacatcttcttagccttccttgtattttcacttttccataggaattatagaatcagcttgaatttatatattattttgatcttctcaattatacatagggcacagagttctattcattcaaatcttttttttttttttttttttgagatggggtctcactctgttgctcaggcctgagtgcagtggcacaatcacagctcactgcagccttgacctccctagctcgggtgatcctcctacctcagcctcctgaataactgggactacaggcacacccaccacacctggctaatttttttgtattttttgtagagacagggtgtcactctcttgcccaggctggtctcaaatgcctgagttcaagtgatcctcccacctcagcctccctggcattatggcgtgagccaccacgcctggaccccaaatctttatttatgtcctcagcaagtaaaaataagttttagttttggccttttgatcttttggttagagttatttctagctacttgttactgttgtgaaggtttttttctgttgcgttttggtttcatagttctttatactcaagtatcctaaccactatagtttagtgttgctgttttttttttaacttcatataaacagactcactatatgtgtattcctttgtgtctgatttcttttttccaacattatcttcatgctgttatgtgttgctgcatgtagtagcagtcattccttctttttcataactctataatattccactaaactcatatgccacagttaatcaattctcctgtcaatgagcatttggattgtttccagttttactacagagctgctctgaacattcttgtacatgtacatgcatcctaatgtacttaaccatacatttctgtggggttttcttaatttgagtttcttcagaagcaaaccctaaaacaagaattcaagtatgggtagtttatttgaaaggtgattccagaaaacactagtaaaagagtggagaagcaagacagggaagggaagaagcccaataagagtcacttcatgaagcacattagtagagtgggcaaatggagcttaatcctgctgagtaactctgtgaaactccagagaaaatatgccttagagttgttccagctgaagaacaagggtgctggggtatttatctggcagctccaattattccctaattgaggaaatctcctggacccttccccagcccttctggcctgcactgcatgtgggcagggcaggctctggcagccagacaaagccctcaggcaaagagctgaaggtactggcagttagaagttgggctgtcgtgccccgcagtggtgaaggccaggagagtgtggcagcacatgacagagtctgctacaagagagtctttccatgagcagaatttctgggtcatagggcacatatatattcaaccattgcagatactgccaaacagtcttccaatctgttgtcccagtttgccctcccaccagcagcctaggagaactcccgcaaggctgtgtccttgccagctcttggtattgacttttacatttaagccattttgataggtgtttaatgttgtctaatttgcaattcctggattactgataattttgagcatcttttcatgtaatttttgaaaatttggatttcttctgtgaagtgcctgttcaagtctcttgcctgtttttctattggaatgtttggcatttccttattgatttccagaagattttatatattctggattcaggccctgtggcagacatatgtgtttaagatatctgtggctctcctttttactgtcattcctgtcttttgaaaaacagaagttcttaaatttttttaagagacagggtctcgctctgttacccaggctggagtatagtggtacgatcatagctcactgcagctttcacctcctgggctcaggcagtcctcctgcctcaaccttccaagtagctgggactactataggcatgcaccaccacgctggctaacttcttaaaattgttttttgtagagacagggtctcactttgttgcacaggagaagttcttaattttaacgggccccaatatataactatttctctttgggctagtactttttgagtactaagaaatctttcctgtgattatgaagaattaccctatgttattttctttctttttttttttttttttttttttttgagacagagttttgctcttgttgcccaggctggagtgcaatggcccaatctcggctcactggaacctctgcctcccaggttcaagcgattctcctgcctcagccttccgagtagctgggacaacaggcatctgccaccacgcctggctaatttttgtatttttagtagacacggagttttaccatgttggccaggctggtctcgaactcctgacctcaagtgatctgcccgcctcggcctcccaaagtactgggattacaggcataagccaccgtgctcggcctaccctatgttattttctaaaaactttattgttttgccatccatactaaggtctgtaatccatgcagaacttattttttgtgtatgacatgaggtaggggtcaagaattacattgtgacacaatgcctatccagttattccaactccattacaggagagaacacatgttcctcatgttctgcatatccaaccttgtcattgaatccagtgtccatatgtgtatggatctatttctgggtttctgtccttttccactggtctggagttgtatgtccttgctgcagtattacaccatctattgtagcctcattaaagatcttggtagttgaaacagaaagttgtcctacgttgttcttcttcatctagaatagcttaactgttcttcgatttttttgcattcccagttaaatttcagagtcagcttgtcaaactcaaactttctttcctttcctcttgaaaggaaggaaagaaggaaggaagagagggagagaaatctgctgggattctgattagagattgcattgtacctgtagatcaatatggaaagaattaaaactcttcacaatattgagttttccaatcaatttatttaggtattctttaatttctctaacaaagttttgtagttttccctgtcaatgtcttgtatacctattgctagatctattctatgtacactcttgatgttttgatcctattgtaaatgatatcattttcatttactgtttgatgtgttatggagaaatacaattgattttgtctactgacttgagtcttagaatcttactaaattctcatactaattctaacagttcattgtgtattctcgtggatttttaagtacacacaatcaatattgattttctatgttcatcttgaaactggccaccttactgaacttttttattagttctagtaatttgcctttcaaaatcttgagttttctaggttacaaaaccaaaaaaaaaaaaaagtccctcatattaacttataattatgaggattctgtttctggctgaagacgctgttaagtaaaagaagtatggagtcacactacctgaatttgactcccagcctgttatttactatgtaactttaagtaatttgcttaatcctctgtaccttggtatcattaattataagctgcctcatagggtggttgtaataattaaatgagtttatacacgtagaattctgcctgtcaaataatgagcactcaacttatgtaagcttttgccatttcatcagtttcctaaattcctttataaattttctttctaaattttcacttcttatttattttttcttattttattgtattggctccttttccgatataacattgaatcatagtggtgcttacacacctcatctgaaatttcaacactttgaaacatttctttctagtattttttttgttttttgtttttttgtttttgtttttgtttttttatataggcatgttgttttgttttgcttttcatgtttgacgtatctgaaattgtctttgactggacttccaaatctggtggtaaactatgcaagacagagatacttttccaaaggaatgtcttttgttcaaactatattattcacataaagatgaaaagtaataacgaaacaatttgtttttaaacattgagatttggttgtgaatggagacaccgaccctttttccttcctgcagattcattagtgtagtcttaacaaagaggtgctcttcattcatgtaataaaactttttaggatgtttggaaggagctcagggatattcgtagccacatagggctgttggccaattcttttttaagacaatatcacattcttgagcttttaagtttgattaaattcttagtaagctagagtatgtcttcaagttattttcatagaaaatattttcatagaaaattttcatagaagttattttcatagaaagcctatagttagaatttttgagtcattaaataactaagaatgcctttctacgggaaagaccacctgaaccacataaaattctagcattaccgccacagtgtcagttttgctcttaatttcctccaatgccactactgtatttctcattttcctgcaaattttaaaaatcttactcctctttttttgcggggggcgggggttgtttgtttgttttgagacagggtttcattctgtcacccaggctggagtgcagtggcatgattgtggctcaccacagtctcaaccctctgggctcaattgttctccctgcttcagtctcctgagtagctgggaccacaggtgcacaccacccacgcctggctaatttttgtagtttttgtagagacagggtttcgccatgttgcccaggctggtcacaaattcctgggcttaagcaatccgcccgccttggcctcccaaagtgctgggattacaggcatgagccacctcatccagcccatcttttgtcttactactttttcattacatatggttacttacaaattgctattttcttcttaataattttctgttcctgtttcataaaagccacctctttttgcatcatattgttatatcaaatgattctctaaaatgttctttaagtttctggaagatattatctggtaaattttctctggttttcagatgaggatccctttttgtcttctactattttttcaattgtctctttttcctgtttattcattctcaaatgagaagagacccattctggcttgccatggtcaatagaaagggtgtatgttttgctcatgacctcttttctggatgttagtgcactcattctctaagccctatactaaatcgccagttgatacacctaaccaagcttccatctaatcagcttccttgttgtgtggccctgctgaactgatgtgcactcatctcctgcatccgatcctgggatgctgagaagctgatcaaatggaatacacacgacaacccccggtatactgcacatcgagggctcctcttgtacctgtgctcaccctgagtgctctggaaactacttctccaagggagtgatgtaccagccttggtgtccctcctccaccctgcagttttgttttgttttgttttgtttttttgcctagttgttttctgagagttgcagttcttaattggcaggtggaagggagtggggagtactctggctctttcaaaaggcagcacctaccaagtagatggatggctgctgaatttaaatttctcaacagttggaggactcagatgttattttttcaatcctgatgtcccatttcaacccagttccattggccttggccttgtgtttaggtaaaaaatctccagatcccccaaaacagactgactgcagtcctggtttttggtgtgctaagttttgtgtttcattacaggacttcgagatgattttagcagaaagttgaagaagctgccccatgctctcctagccattttaagccagatgtttgtatctggaattaaatatttgttttagcaactcacgacttcctggatggcttacaggaatgcagcttggcagcagagctaaagatccctctttgccaggcttctgcataggcagaagagatgactgggaattgtgatttcaaaggctgagtgccccaaactatttattctaataggaaggtgggaaataaaagccccactggactagacaggagggaatatgggttctcagggctgtgtcactgcataggtgaccctagctgggagttctgatctcttatttctaaaaacaaggttagaccaagtgctctctaaaatcctgcctttctaggagtctgtggttttagcagctgacctagaccatctgctattagaagcctgttctttgaggctactcatgtttgttagagcctctgctggagagaagcagaagtaagaggtacatctccactcggtgtacaggctccagtgtgcttcctacaggcagcacctgcgggcagctacaggggcctgaaccttcccctgggagatctgcccaccaggggcactctgggcctttttcaggccatgcctccatataagaaagtcgtgagacatccaagagccctcatttcctgagtccccttcagtgactttgtattgaaagtaaaaatagagacaggaaataaaacttgtttttttcagagaatgtctttgaagcttgggaacacagaatggtcgctgtgcggtctgcctccagccgacagtaagtggacactggggagttgctctagcgcttgtcaagaccagcttcgacatccaagtgaaagcagaggcggcggtgtggagaaagagcagagatttgccattgatcatccacatttcctttggtttttttttttgtttgtttttttgttttttttcctaagacagagccttgctctgtcacccaggcgggagcgcaatggcgtgatcttggctcactgcaatctctgcctcccgggttgaagtgattctcctgcctcggcctcccgagtatctgggattacaggcacacgccaccacacttggctaatttttttttatttttagtagagacagggtttcaccatgttatccaggatagcctcgatctcctgacctcgtgatccacccgcctcagcctcccgaagtgctgggattacaggcatgagccacctcacctggcctatcatccacattttctagatgagaggaagaatgtactacaggaaatctccccaggatctgagatttgtcctgtgtcagaggtgaagcccaagacacggctcacaccgacattccagggcagtgccaagccttcccgggctccgggcagctcggaacttggggactttgcccccaccctccagcatctccagaatgaggggagtgtgtatgtgtgcatcgtgcatggcccctcctgccttcttgttccttctccctcctgtctcctttttcctcttgctccgccattctcccgcccacaatatctgctctaataagccaggcggcagtgctccaactagcccataggtggttcacgctggagtaccttgtgcaggataatttgccaaatgggttagaggtctgtcttgcaaggcctgtgcatacatccacaattagaagggagtgaaaggaggaggggaacctaacaaccaagaatggctccacatccatttgcacagtgtccaccctgtctctgcccttggcctcccaaatggatgttggtctggacgtcactggctccgctgcctgtctgtattggcatctggtacatgaagaccaagtttctgaggaaagccagctctcaaccttgaaacaaagccattaagtttctcatctgactcagatcaggcacgtttggagaaatgagggccaagttagagtttagttctagaggtggttgggggcggagggcaggttcatggtactggctccatggtcatctgaacctaagtggcctttggtgatgcgtcagaaatcacaatgaagcaaggaaacctgcaaggcatctaactgggaactatttatagtttccaaaatttaggcagcacaaaataatccaataatgattttaagacagaccctccccatccatcaaggcctggctcctcccaggtgggtgatcagtgcttctggcaccagctggccctgagtggccagtggagctgcttagagcctgagccccaagtcttgtgtgttaggccccctgctcccagggtctctgtggcaatgtgctggcacctaattatttgctgaccctgagaagcatgcattgctgagatttaccagcatttatggcttactgaatatcaaatatttattagcagagtgtacagttattctattttctttcttccttgtttgaattcaaggaatcttattatttttactttaaaggctcttgatcatgcagattagttccaaaggaagggttctctactggacaccatcacctctcccatagtcttgtcattctatcagtactgaagggccaccagttcagagcagggaagtgaaggggggttatttccattcttcttacctcaaacacctgtaggtttctcagggaacaagcccagaggtacaaatgtgaacctacttttgtaattgatttttccaacataaccccaattgactgccttagttaatctttccaacagaactgcaggccctatgtcctcccgggagagtgccctccttagtggaaagggtcacgctccccactttgcacaagccttcctaggagggaagctgcgagctcttcagctgaaaagcgaaaaggcctcttctgcaggtgtacttttcaaacctgtatccttggaggttaagtgtctgctgacaaatgcacaccctggatggtctctctccccactccccacccttgccctgacaagatcacattgaactattcagggaaagtatttactgaatgcaaggagaatagagcacttctgcattatttattaggggctaacaatacccatcatatgtagatgatattgatacccatcaatgtatttggacataaattagtatgttaggaaactccagtggtccaaaaccttttaggatctctgacacgtatgtaaaaacacgtcgtagtcttacctcttatatgaggctgggaattggctatgagacaacctcacaaagaaaacaaacatctttaaccttttatttgccattagccctctgggcagttcatctactatcgagtaagacttgaaatcatgaactcttaacctctccttacacaccttctttctgctttctctaaggaaggaagaatgttcacatttcctgagtgtctactctgtgccaagtgttacagcaagccttttgatgtcctggagtgctggacattagcatccccactctataggatcaggaaactaaggctcacagtcctgcagctgataagtggctgacaaggagtaggaaacagggtcttggcttccatctgagcttcttacagtacatttgactcacccctgggcaggaaggcaaaggtcattcttggcttctgtatcagttacctgtcaccacaataatgctgcaaaacacagaaccacagcatgggtgatataaaacaataaacatctatttttgcccagaagcttgtttgttggctgggtgtgtctgctgatacaggccgtgcttggctgatctcagctggactcaagtgtgcatctttagtcagctgctggatcagctggggctgtcccgtccaagatggccttggccaggacagcccatccaagttgagtggggagttccagttctggggcagcaaggactggaagattctgacccggtgttgagttgctcttacttcacaggcttcccagaaactgtggaggctgggaaggggttttccaagatcaaatccaggatccagtgctaattgagtcaccctaaacaaacgtgtttccttctccaagagtaaaatgggaatccatacctctgccccatcttcctttcagagatgttgtgaaaagaaattcccaatgggggatccagactttggcttccactgggactcacctcactgtgccttcagttcctaatgtgaaactgacaaccctggactggacaaaacactgaggttctatggctctgtgaggaggaccaagctaagggagataaaagatgttcaggtgccttgaagagctaacaccactgcacctgcggaactgggtgtcaaggtgacatgcggttccagggtaattccccaacctgtatctgcctccctgaaccaaccagatactgtcccccttaccttaccctccacaccacacacacacaaccacacacacacacacacaaccgaggtcagtctaccctctgttcgggaatgggccctcccccatctctctccttgcttcccctccccaccagcacaaaggccctggcttccaacaccccattactgctcagcatccaaatatccaaagacttttgttactagaaggaaaacgcacgatgcgtgacaagcagcctttctggccggggaagctactctgttactgaccacgcagtcggtggcaaggtccctccccaagctgagagagaagggagagcacaggacaccacggggccttttctgtcctccatgatgttctccagtctcacacaatccctcaccctgtcccgcctccctttgcatcccctctggatgggaatcatccctggcttgatgagcgttgctgcacgactctgaccacatacctttgtgctgcccatgggtaggcgatggacagggccagggccggttagtctgggtgtcagagggcagctgagctcctagaacgcccaggagcagccactctggaggcaaagtagacctggcccacatggagttgggttgggatggggaaggcatggagaaagggtcagttgtggagagacattctctctctccaggttagaggtggggaagatcagctatggggagcagcacattcttggaaatgcactttgtttgtcctgtgtctgacctcctgaggggcaaaaatccagtggccaccagggagaagcaagttggtgtctgaagatctcagagagggcttgtgcccgaggccagggcttcccttgttttaccctgggaacccagtgttttgaaaaatttatctaccaaggaacctatatttttaggcagtagctgtctgccatccttgttaatcacagattatacacagatgtgtacatgcctgccagtaccaggtcctgggccacaggacacaaccagcatgaccaatctgagtcaatattatttctttcaaaaagtggggaaacgtagccttattgtaggtaaacaaatgacttctcttcgagtctttgaaatggaagcgagcgcttggccttccatgtggtcctacataggacctgcttccctgtgagagggagggagctcaagaatgtctgagggcttttgggatctacacccacctccccatcaggcagtgacacatcagctcctggcatgccctccctgctttcctcctaaaagagagaggagaagaatcagatccaaatggtctagacagggctgggctaaccttgcaccttccgtggcagaactggctttgagcagttggagttcaggagaccctgaccagcatgtgactgtgtcaagactgaatccatcaatgccactggaacacctgctgtttcgttgggtttctatcgcatccttgggttggagggagctattgacactttcctggctgttcaaaaatgggcacatgtggactatagagtgtagtaattgaacagcaccaaagccgtttgcactctgcttgtgcctgcaggcacacctggctccacagcccgggtctgaggatgctgaggtcacagcctcacaccagctcccagacgtcattggatctgtctcctttttcttagactttcaaggcaggtgttctccctcctgtttttattttcctttagctcctgaccaactgcttttgtcaaaatcaacagctggcaattgctagctataaaaaccctgggcaacatatggacatactgcctcattatttagggcatttgggcttgctgtacacttctagactgcaagctacagctttgcatttgttgctgtggcatctggtggcttccaaaggctgttgggaaggcataggcaggatgtattgatctgttctctctgtgcagtttgcttcacgttaagtctttaatatttttatcttaaatatgtgtgtgtatatatatatataattttaaatatatgtatctcacacaaaatataatccgacaagccaatgtggacctgtacccaaactgtctaatcaccctattaaaagcacaaatacagcattatctgaagaataatcaatattggtatgaaaattgagagctatgtggttaatccaaaggagcgtgaattgacagaggacctcagccaatgtttgcagaagatatttgcctggattttgttatcaggagattatcatgcatcactatttattcagaatcctccagatgaaggcttgacaccagttgtcccaggggtagggtcagggacggttgtccagggacctgaagtggcagtaggggcaagcatagtggtttctacatcttaaaaggggctgcagaggtttatagaagcacagattccagaaccttgccccacatggtgaaaatcagaatttctgggggtggagacccagaggctgccctgcaaagagggcccctctgatgtgcagttgggtatgggtgccattccctacaagagaagtgtttattctttctttccctgggtctgcagcaaacctgggatgcggtgtcagtgtcatcacatatactccaaggtctccatgtatttccttttaaaatgaaaatcatttttcctgatttgcctagctcagagttcctggggtaatacaatgagaaggagagtatgaagtgaagaggtacctgttatctcacttaagcctctctagaattgaacatttttatttccttatttagatgaggaagacaggcacaaagaggctacgtaatttgcaaggccccaggtcttggaggtgtggaagcccaggtttgaatccagagctttccattgcataacatgctcctctgagactgtagaaatcaggcagacccttgcaactcaaaccgaggcatgtggaccagcagcatcagcatcacctgggtgctcatgagaaatgcagaatcccaggccctgtccaggctgaactgcatgagaatctgcgttttgatgagccctccagatgattcctatgcaccttaaagtttagcagcactgctgtagaggacttcagattgagcaagagagagtagacctcaaaacaaggttcccctgcaaaggctatttctgtgtgttaccaccacacaggaatcatcagaatccaacaaaaatatgcagtcttcacaggaattagcaaagaagaaatcattaccggtaagctgttggaaggatggcagtgagcagtcttagccctttctgtctgagttcccactgcaggggaagcgctcctcatccaagaaagccaaaaggccccaaaagaatgagttttaagatgaaaacaaattgtttttatgtggatgtgttgtgtgtgtttaattttgaagacaatatgaatacttttagaaatgagagaaggaaaaatcaggaagaaagtttagccaagctgatacagcctagcagctttcccattcaggggctctcctcttcctgccctttgagagtatcagtgcattttgattatttcaggaatgattcatttatattactttatagcacacagcatccagcagggagggcagccagttaggtagaaggaaattcagcttccaagtatctttcccgtaagtgtttgtcttcaggttaaatcctgtcttagtctgttaaggctccagtaacaaccacaacaacaaaataccgtgacttagtgcttataaacaatagaagtttatttctgacagttctggaggctgggaagtctaagattaaggtgccagcggattcagcgtcaggcgatagtctgtgtcctggttcacagagaagactttctcactgtgtcctcccgtggtagaaggggcaagaggtctctctcaggcttattttataagggcactaaccctattcctgagggctccaactttatggcccaatcacctcccaaaggccccacctcttagtaccatcaccttggatgttaggattgtaacatatgaatttttggggggacataaacattcagacaccgtagcagaccgtccacataagatgctgcctgcagaacacattgaacaggaaatgcagtgcccgaaggccaggaaacaaaatatacaagccagtgctttgagaaacataggaaagcatctgagcagcaccctgggtgccagtcttgggggaatgtcagtccactgcaaagggattctcaacctctggccagaatatccagtaggatggattctgagggcgactgccccatctgggcctctgctccttcctggcctttccccagtttttcctgttgaggccacactgtcaccacacccctaggggagctgggacttatttcaagtgattttttttttttttttttttgagatggactctcaccctgtcacccaggctggagtgcaatggcatgatctcgactcactgcaacttccacctcctgggttcaagcgattctcctgcctcagcatcccgagtagctgggattacaggtgcccaccaccatgcccagctatttttttgtatctttagtaaagacagggtttcaccatgttggccaggctggtctcaaactcctgacctcatgatacgcctgccttggcctcccaaagtgctgggattacaggtgtgagccactgcacctggccatttcaagtgattataacacacgttctcatgttttagcattatgatttgtaatactgtatttaacctttacaggtcacttttctgagacaccgaacctgtctgtgaagtgtacagattccctgaaagcgtcaagaagccatttgtcctcattgtcccaaacattcattgtatccatggctccaaaaagaatcagtcaggaatactacagaggcctggttgctgccttctaggaacttgtaggctaagggagaggtcgtgacacataatggccttgactgcatatgtcagcccaggcatggatactcacttctgctaaatcaaagagactctgcatatactaacatgtctacaagcctgaagtcctattgtaacattgggcttcttcccccaccctcatcccctgtcttgtactagcttccaatttcaaactagccaaatgagaattggctaaaccaatttttctagtctttctctcccttggtcttctgtttgttttgttctaatttttcaaaagtctggacgaaaggaatttgggttgggatgataccatcattctgtcacttctaaattcattctgttaacaatttttagagtcacatgggtagaagctttgattttgaaaaactatgcacttttaagttttgactccagaaggtaatttcaactcagctgtaaacaattcgagagggtgaatatgaaagaggaactgcctcaccaggcttcccccaccctggcgtctggagtcctccctgccttcgtggcacctgatttcagagataaagaatttcaaggatatgctagagcagggaggatgtaaaagggaaagacaactgcagttagctcaaaaccagactgtgtgaaacagccctgctgctttgtcctttctcccatcccccactcactcactgatgccttccatcacccggagattacagggaaggctggttattgacagctgggcagtttgcacaataaagtttaacggtttacatctctttgtgcaactttgtcaatgttttccatggatcaccttctcaggtgagcccactgactcctctccttcttctctttcccttcaagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaatgagaatgacctcatttgctttccacatgcttagcctcattataccatgttatgtccaagttcacagccataacataaaaaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttagatcattaatgtgtccttggttgatcagtcatctggtccctcctactgtgtgttatgaccaccacgtaatccattctcactctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatgattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagttgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatact

SEQ ID NO: 12429 - DNA, 38078 bp, Human
  misc_feature (1)...(38078): n = A,T,C or G
aaaagtttgataacactttgagaattgtggagaaataggcactctcatacaggctggtgggagtgtacatttggacagcttttatggagaatgatttgcaatatctgtgaaatgttacacatatgtatactctttgactcagcaattctgtttctagaaatgtttcctacatatttacctgcattgtataaatttccacattcattcactatagctgtatctgtaataggaaaagttggaaccatcctaatgtgcaatgtaggggtggaaaaggtgtgatacttttctttacccatcttaagggtcacagctgacactaccataacaaaaaacaggttagcaagataaatggataacttattgaatcacagttttatgggatgtaagtgccttcagaaatgaagacccaaagacccagggaaagctgtccatttttatgcttagatgagatgaagaatggacagctgtgtagaaatgtgattgtacaaaaggagtatgatctaatagtaacagactgaaggaggaatccagcaagtcctgtctgttcagattcttcttggcctctctgtgcagctttccttcttcctgagtgtagggcaagacccttttggaacgagggtcttatgacaaggtacatcaaagaatgtctttatggccagctcttacacaaaaaggtgggggaaggctagattaatatttctaggtttttctagaataatgtttctggcttgcttgggagaaaaggggttctagtttccatgacccgccttggggaacagaaattctggtttctattatttgctttaggagacacagaggggtgggagacaagagggcaggagaaagtcagagacagactttgcttttaaggcttctctgaggcactttcagtcttctttagttcaaagcactcagtgtgccaaagagccatactctggggtgtcgtttcctgagcaccaacaatattggccaaggacattgtgactatccttaccagtgctgtggtcctttaggaagttgagaaggggctagagttccatgagagcccaggtgtagatgtgtatttggtagtcatcggcttagggtcaaagacagaagtgatatagaatcagttcatctaaggcaagagtaggttcaaaaggttgccccttaagggtaaggaccaaattttattcatctccgtaaggccaggatcaaacacaatcaagatttgataaaacaggccgggcgcagtggctcacgcctgtaatcccagcactttgggaggccaaggtaggcagatcaccttaagtcaggagttctagaccaccctggccaatatggtgaaacctcatctctactaaaaatacaaaaattagctgggcgtggtggtgcgcacctgtaatcccagctactcgggaggctgaggcaagagaattgcttgaacctaggaggtggaggttgcagtgagctgaagactgcagtccaggctgggcgacagagcaactccacctcaaaaaataaaaaaggaaaaaaaaaagatttgataaaataatgtacatataggacagagctggagggaaacccaggaaaggtgaatcagagagagaaaagacgccaagataatgtggtgacttgggagccagagagacggagcctgagacttggagcagggcacagcacaggaatacaacacttttcaccagaacgacattccgacctctgaatcaaccctggaaaggcccttccattgaacttcttgtgatggaggaaaagaaaccctcagtttcgtcatcgcaaggcggaagagtttaaataccatacctcaagatctccctccagccctgacacgcgactccgcggccctttcagcgtcggtcgcctaggagacaagcgccacttccggcagcgaagtcacttccgcggaggtcctgcctctccctgcggacgggcgctgattggcccgtttgaaatgcgccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgtgagtacgaggccgccgagcagggagagagggcggacgggggccgaggcctcggggctgggggcaggcgtctccactcaggccgcggccgtacgcgggcagcgcggacagcatcccgcccggtgctgctgcggccgcgaccccaaagtgggaacctccacgtgtggccgctccgcgggagcctgggcgcggagacccctgccgcgtcgccccccgccgccccgcctgggcctccaaggggccaggaagggtcggcccggagccggggttgttttacgccgcacccggttcccgggggcggggcagtcctcctcggggtcccgggacagcctttcccttctccctcgctggctgccgccgcctccagagtgcagttggccaacttagtgcgggtcggaggtggtctcgtgtgtggagcagagcgagtgtgctgggcattggttagatgggctccgtttctggagagccctggcaccggtgatcgccgctagcttttttttcagccgagcaccctgtccttgaggccgagcccatccgcttacacaggccagttacttctgctgtattttgtggccgcagagaacctccgcccacattcctaagctaatattttcggcgcagcatcattcctgggtaaagaaatatttgtcgtgcaaaggagaggattggctttattaccatttagggagtcgtttgcaaaagacaacttgtttattaagaggccgaagtcaaaatctttagatgaaaaaaattatatataagaaatatacgttgagtttaacttaagcccaccacaaagtattttgcactgaataacacgaatttgcttgtgtttcatctgagaatatgtttggaaaaatatttttaaactacagtcgaagccaataatcttacttaattttaatgtgttaaatgtatatctagcctatagataaatgtgaagggaaaaagatgagatgctagagaaatggtgaaatcaatcaaaataactttttgattgcccctacttaagaaaccaagaaattggcagtttgggaccagattttgtttggagacaaagagtaatgttttgagcattcaatgactggttgttccttgaaagtacaggcgtaacccttgacgaaagaatggtttcctccatgtgcatttttatagtgtattgaagttaatcgcttgtcagtctgtaaagtgtgggcagttataatttgtagtgcctctgttaaattgttgctcaagaaaatatgcaagccattttaagtatagaactaatcagagaataagtaggtagctttggtaccaaaaatgtattctaaagcaaattttaattacttttggattacgcatgccacaaacactctgctactatgattattaatgttatttgggatgcagtgttttgcaactgctaagggataatttacagataacctagaaagattgtataagttttaggtgaggcttttgtattcgtgttgaactgaaaaaaaagttattattattttttaatctatgaccaggagagctaagacaccccggaaacctaccgtgaaaaaagggtcccaaacgaaccttaaagacccagttggggtaaggtatccctgtaaatttatgtgtggtgtttaagaaacttatctcttcagtcctttctgtcttatgtgtatgcttggaagggaaagaagaagacatgtggaagtataatcaaagaacatttagttaaatggatgtactacattgtgtaaaactagtgctagctgtgaaattttctctataagattaattaaattagtccagtaaaatgaagtctttggttgtcaactgcataccttctgtaattataatttggagagttagataattaaaaatctccaactgggttcatattcatcccagagaatatgaactgagttcatgccatacagtaactgatggcatgaggagagttccaaacttcttgggaccaagtttaattcagttaaattatgaagaaaaaatgaagcaggcaaaaagaataagaattttaaaacaaaacaacaaatggcaaacaaaaagggttctttgctctgaggtattttaaatctatccctcgttgccactggagtgggtccctggctctgagttaagggaaccgggtgctttgcacacagctgaatgagttttcctcaagccccctcccctgctttcaaaaatgtctctgtaggccgggtgcggtggctcacatctgtaatcccagcactttgggaggctgaggcgggtggatcacctgaggtcaggagttcgagaccagcctggccaacatggcgaaaccctgtctctactaaaattacaaaaattagctgggtgtggtggtgggtgcctgtaatcccagctactcgggaggctgaggcaggagaattgcttgaacccaggaggttgcagtgagctgagatcatgccattgcactccagcctgggtgacaagagagaaactctgtctctaaataaataaataaataaataaaaatgtctttgtatattaaatgttgggttaagctgacaagtttttaaattgacatccatttccaagaaattctaacagttttaaaaatctcgtgtgacatgttgttgacttttagagatattagtagtagtataactattatttgtgtacaatataatagtgaatacactgcaatttgatttttattaaaatttattttaattttgtgtgtatttaaagtattctcatatctaatacatacttgtatttgtcaatctcaagtagcagattttaattttcttagcccttggagatacagagctcttaaattgagagactgaatgtttgttgaatgaatgaatgaatgagaagcttaagtgaaaaatcaggcaaaaggtcaaactttcttcttaaagcaccttcctatttcttcaggtatactgtagggtgcgcccactgggctttcctgatcaagagtgttgcatagaagtgatcaataatacaactgttcagcttcatactcctgagggctacagactcaaccgaaatggagactataaggaggtaattctgatttggaccaagttgtttttactcaatatgttgtttcctgaatgacttctagatttttagatgtaacaaagttcatttgtgagcccacattttcaaaagacttatttacttcattataaccactgtatctaaagtgtttttgacttctgggatgcacagacatacctttggtatgctggggttagaggattgcttttagcagataatttcttacactgagtattattgtttcttagagcatgtgttagggatgatttaatgtggaatgatacatgattgtgctaggcagttttatatatacaacttgatgtgtggaaatgaaaataacatttaataatagacattgtttacttgcatcaacctcctatgcagtgtttttatttttagtaaagttttgagtcagctcaaaaatattgtttagcaaatgtgctaagctaatagttggagggtggaaggagattaaaaaaaagagcatgacatactccttgcctttagaaagtttataacttaagatatatggtaaacaaataattctcatataaataagacagaaagttagatgtgctaaagatgaggggaccgtgggaatgcagtaggattaattcaggctaccatttctacttctagctgtcactcactcttttgtgcctactattcctgtgaaattgctcttcagaagactaccagtggcctctttgctgctaaatttgatgtatacctcttcatcctcattttaacctgtttgtcagcagcactctcctgtctccccctccagctctccttgtatctccagctgaaaccttttctctggctctcaacattcaaccacttacttgatatctctgcttggatgtcacatgtgcatctcaaattttacatgcccaaaaaggagttcttgatttttcttattccctctctaaatacttcctcccttgttttcttctcaaggaatggcactatcgtgtgtccagttgctcaagccagaaacctggtacctaccttttacttgcctctccttataactagttcattagtagctcctatcagttatattccaacatgtgtcttgaaactgtcctttcatttccatctccactgccaccaccctagtctgagccccattattaatcactgagaccagagctactgtaatgaaggagtagcttttttatttttaatgcgtcacagctgagacttttgtacaacttgtgctagatggaactgcccgtgtgagttagacaatagggaactagttcataatctcttcatagagatgagcctattgaatacatgctgaaatactgataattgagcagtgccagatggaggctcatgcctgcagtctcagcactttgggaggccaaggtgggtggatcacctgaggtcaggagttcaagaccagcctgaccaatatgatgaaaccctgtctctactaaaaatacaaaaattagccgggcatgatgacgtgtgcctgtaatcccagctactcagtagcctgagacaggagaatcacttgaacccaggaggcggaggttgcagtgagccgagatcgcgccattgcactccagcttgggcaacaagagtgaaactccatctcaaaaaacaaacaaacaaagaaacaaacaaacaaaaaacaactttctaaacatttaagtagtctggtaaccaatctcagactggcattggtttgctgagtgtgctttgggtatcattgacaagacttccaaagcccaactgcctccacttggaatcttctctaatccatttctacagagcagacagtgatcttttaaaacataaaatctcattttcctgttcaaaacctttcaaagaataaaatctttgaacagacaaaatcctgcttcatccgtctcccatctgtctctccaccttcattcatcttttagtattcatccaatcctttgagtttcttggataaggcagaatcctggctgttagctgttgccttaacctggacttctctttttctgggtcttagcatgggtcatcgttgggtttcagcttaaatatcacctcctcgggttgtatagactacccaatcagaaacagcaccccacaacccctctcccctggtctgtactctgtatgcctcctttacattacttaaccacaatctatttgtttacttgtttattgtctttcctctaccataatgtaaacttccagggaatatgtaccttatatgttctgttcatcaaatagtaaatatggcttcagcaagaatgaatggtctgggagggttttttggaggagcaggtctttaaggatataatatagttaaacactgatttactgagttttacttctttaagtaaatttcaagtatgtataaatataggtatcgagtaggtatcgagtaggtataaaaaggtttgatggggattaaaaatagtcactgctttctgacagaaggcaacattgtataatgaaaagagcattgctgccgggcatgatggtttacatgtgtaatcccagcactttgggaggccgaggcagagggattacttgagatcaggagttcgagactagcttggccaacatggcgaaaccccatcactactaaaaatacaaaaattacccagcgtggaggcatgcgcctgtaatcacagctactcgggaggctgaggcaggagtattgcttgaacccaggaggcagaggttgcagtgagccgagatcctaccactgcactccagcctgggtgacagagtgagactctgtttcaaaaaaaaaaagaagaaaacaaaaacattgcactgatgatggctttgatactaattaactccatgggctcagagaagtttcaccttcgggcctcagttttctttaccttgaaaggagggagtcattcatgaggactgtgaggtcatgtatcttctcagtattagcctatgtgtatcctttcagttccaagattctttgttctttttgaactctaaagctgatttttacaggatattttattaattgtatttagagagccttgataattgaagtattcttgctttcttaaaggtcacaatttatttaaaatgtatttcatgtaagaactcagagatgagataatatttacagtttacttctggttttaaactatagtacatcaaaacgtggtattatgctgctatgccattttattttatatgtcttttttctttttcttttttgagacagggtctcacttgttgcccaggctggtgtgcaatggtgtgaccacagctcactgttttttggtgaggtttttttgttgtttttacttttaaaattttttattagatgagcttgcccaggctggtctcttaactcatggcctcaagtgatcctcctgcctcagccttccaaagtgggattataagtgtgagccactatgcccatgctttgctattttaaatgacacctttataaagaaaaactaggaaacagtaaagttgtgtatgacataatgcttgtagatttccacaaatctgtgactatgaatcgttacaataccttttgatctctgtcacttaattaaaacaaaatcagccttagattagaagcattagtagacttaagacttttctacatttttggccaggtgtggtggctcacgcctgtaatcccagcactttggaaggctgaggtgggtggatcacctaagatcaggagtttgacaccagcctaacatggtgaaacccgtctctactaaaaatataaaaattagccgggtgtggtggcacgtgcctgtaattccagctacttgggaggctgaggcaggggaatcgcttgaacccaggaggcagaggttgcagtgagccgagattgtgtcattgcactccagcctgggcaacaagagcaaaactctgtctcaaaaaaaaagagttttctacattttctttagtagttgtgactgaaaacgtttaccagtttataattggtatgatataggtatgtcatgactttttagtaactaaataactaagggttccaactgtaaaaagaccatttatattttttctttgcatgcttagatcttaaatgtcataaacaccttaagtttaaggagatgtatttttagcctagataatagtggaattctatttagtgcatttttttctctctccacagactcagtattcatttaaacaagtatttggcactcacaccacccagaaggaactctttgatgttgtggctaatcccttggtcaatgacctcattcatggcaaaaatggtatgatatgactcttggagttttgttagattttcctttttctcctcttctgataaaacttttttgatatttatatatttgatttatgtttggtgttgaatccatatttaatttgttagggtggtgctaaacttgccttttttgagctggctaattgttagtgttttctaatgcagtgaagaaatactctaagtggagaacttctaagatataactcattgtgacttgctacactgtaggtcttctttttacatatggtgtgacgggaagtggaaaaactcacacaatgactggttctccaggggaaggagggctgcttcctcgttgtttggacatgatctttaacagtatagggtcatttcaagctaaacgatatgtaagtatgattcttttgtgttgtgactatcttactggactaagacacctatggatacagtagtagtaaagaagaaccaaagcactggattcattttgaaaccttaactgttccttagtttttaaacatatttcttactatttaagttaaattctaaaaaacgtggtgtgatttttttttttttgcccccacttcaggttttcaaatctaatgataggaatagtatggatatacagtgtgaggttgatgccttattagaacgtcagaaaagagaagctatgcccaatccaaagacttcttctagcaagtaagtaattatatttgtctgcagcactggcctaggggcacaggattctttcctgtggtttgcccagacatgaggaatggtgaacattaaatagagaagttgacttttgtgagattaaagttaaggaatgttcttaagttctttgctcagatgttttctctttggctttgagcacattttgtttcaatcactgttttaagagggtgccactctggatggggagagggtataaaagccattgttgtgtgttcgggaggacgtgggaatactgttggcaaaccatgagtatgaataaagctgctttgtgcatttctgcttgtaattgcagatatttattttatctgttagtttccccttgggatcagttacttttttttttttttgagacagagtctcactttgctgcccagggtggagtgcagtggcatgatctcggctcactgcaacctctgccttccaggttcaaacgatcctcctgcctcagccccgctagtagctgggattagaggcacacgccaccatgcccggctaatttgtatttttagtagagacggggtttcaccatgttggccaggctggtcttgagttcctgatctcaggtgatccgcctgcctcggcctcccaaagtgctgggattatagctgtgagccaccatgcccggctgggatcatttacttttaaaatggacttataacgtatacaattgaacttttttttttttagacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaagtaagtaataaagagagccccttcttagctgttaatgttggggaagttactttgcctcaaggagttttagtttcttcagttatgaaagagaataatgcttgcatttgttttcagaatgaaatgatataatttgtatatcacgtggttttgtgtttgagtatgtttattattaactagatatgtacctgtattagggaactagtgggttaaagcatctaaggagaagagggacccaaatattcatcttggagattacttttgaaaactctgggccctgggctatgttttgagaaggatcttaattatataattaagaacgtttcaagaacctgagacagtaaaaggagttttgtaggctctttaaccacccgtgtcttggtgatttctacagactggagcctaaagctgttatctatacaagtaatacttacatatcttctatcattcattaatatggtatgatatctgcactgtaattccatcagagttgaaatactacttcctagatttccttgggtcttgcctttctgagacgtaagactggttaccacttggcatcacaaatgataaatctgcatttgtgccagagttgaccctgggatcttatgtttaatattagtatcttgttcctgagttgatggttttgtttttcagctaaaggcttgtctttaatgctgtctttattagggcctctcaggacataaataatacgaagacctgtggcttatatttaactttgtatatctaagggaacattattggagaaacagctggatttagaaaatcattagactgagaatacataccagtatatccacttttaattacatgaagaatttatggactctggttgaggccatacttgatacaagcatttctgtggttcttagtgagtcacattttgatacagttatcttcaccagagtccttgaattttcatcacgtttattgggaaaacaattacaatatggctaagtaagctaaatgtaaaaatattaacactcttaatactaagagtttatgccaaggaagactctttggctctgtttaacatttcttcaagtgagaactttacaaagggacttatttctggagtgacctatctatatttacccttggaatgttggtaatagtaaaaatacttgggttaggttgtggagcaatacatggaagagttaaaaccttgtgagacagttactttttatttatttttgagacagggtcttgctctgccatgtcagctcactgcagccaacctcctgggttcaggtgatcctcccgccttagcctcctaagtagctggaactacaagcacaagccaccatgcctggctaattttctaatttcttgtagagataggagtgataagggtctcactaggttgcccaggttggtctcgaactcctggcctcaagcagtcctcccaccttggtctcccaaagtgctgggattacaagtgtgagccacgatgcctggcctgaccatcactttttatatcaaactaattactttcccatttgttttaaagtgtcaactgtcttgactctaatcttgagtatacccattttcatgtatgctcgtgtgccaactttttgtttggtttgttctaaatgagattattttcaaaggatcatatcttggctttatttagttatacaaaagaagattgacaaaagtaccttgtgtgctttgtaacctttctgggtaactccttaaatgaacatacaagggtgcttgtttggccctgaattcagatttaatttgttaggttggtgttagacctgcttttttaagctagttaacttttagtacttttaatacaatgaaaaactattacaagtggagggtttttaagatatgactcattgtgattgtcacatagtctggactgaacatgttggtgtgagatggctgctgtagaaacagtaacttctaccttattcctttggtaggtggaacagttgcagcacacccatgaggaacacagattttgtgtatgtgatggtgttggctcttttcttaaggagaagggtgcagttatactatggttggcattctgtggcatgtttgcatgtaggttattttccattgtcactgggctggctgctgtctctaagccctccttgcttcctgaaaaatctgctattgactatcagtgatggtggctggtaaatgtctctaccctcaccattcacaagacttaagaccaaacaggtagctctcatacccaaccttcatcttgtcatacagactaaaacttcataagccactttgaaaggattgccactcctggtatataccaaactctttctgaatttgttttctgctgttgctgaggaggtcagaactggttctatctgctagtcttttcaaattaggaaaatactagattttgatgcttaacctgtgcatgtgatgttgctgtaatactactttggtctctaaattgtttagtgtattgtttcatgtgctttcttagagcaaattagagcaaagcttttaaaacaaaattggtttctgttatcttgttacttaactaatcttgactatttagctttacaatcttatctaagtttaatatttctctggagtattatacgttatatatatattataaaatatatataattttcattagaagaataacatgtcatgtcacttggcgttttagtcctagtcttaaatgaagataccagcatctcataatttaggagactaatcttttttttctttcccatagacctccacaatctaaattgcttcgtgaagataagaaccataacatgtatgttgcaggatgtacagaagttgaagtgaaatctactgaggaggcttttgaagttttctggagaggttagaaacacctagaactagaaaaatacagaatgatgaatatcacctagagttgctactaagtttgatggcaattttttttgacttattagaaagcatgtataatgaaatgactgagttcaggtttgaccaatgatttctctgttgtcctaggccagaaaaagagacgtattgctaatacccatttgaatcgtgagtccagccgttcccatagcgtgttcaacattaaattagttcaggctcccttggatgcagatggagacaatgtcttacaggtaaagttgtagtatgtggagtttttctggttctaactctatccttaatttttggaattagagtaatccagccaacatggcaaaaacctgtctcgagtaaaattggaaaaatcagccaggcatggtgatgcaccactcctgtaatcccagctacttgtgtacctgaggcaggaggatcgcttgaacctgggaggcagaggtacagtgaactgagatcgcgccactgtagtccagcctgggtgacagagtgagaccctgtcttgaaaaaaaaagttaaattagagaggttttattgcaatgaagattgctctagaataaatatacagttggttctctgtatctgtgagttctacatctatagattcaaccaactgtggattgaaaatattcgaaaataaaatgctgcatttgtgctgaccatgtacagactttttttggtcattattccttaaacaatacagtataacaacttgttacatagtgtttacattgtattagatattataagtactctaaatatgatttaaaatatacaggagggctgggtgcgtgcgtggctcatgcctgtaatcccagtgctttgggaggccaaggcaggaggatcacttgaggccaggagtttgagaccagcctggacaacaaaacaagactcttgtctttgcaaaaaaataaaataaggctaaaaaataaaaaaataaaaaaatagaactttaaaaagtgtatgggaggatgtgcataggtcatatgaaaatactacaccattttatacacaagatttgagcatccatggaatttggtatctgtgaaatttagtatccataggagatcctacaactaatccctcgaggacaccaagggatgactctgtatgtaggcgatgacattaaaacttttttttccccattattatagttttgggaagctggatatcgaatcttagagcctgaattttgctgtgaaaaaagtttgcaaatctttaaaaatccctttggtagaagtgataaaataagactgtgattttttctctctggcgactccttctgtaagtggaaattcagttagtggttttaaaatgtcagtaattcatttttcagggtaggtatagtttaggaagtggctagtgttataagttgttcatctcttggtcgataggccagtagggtcccccatatgcagatcactatttactgcctggcctgccacagtacaaggcttgtgtcaattagtaacagcatttgagtctgagtatacataatctaataactgtaatccattaaagtgtaattttattcaaactgtatcatgaaattgtggcattatgaagatttataagtggcaggagtggtattgaagacctccaggatttgaatgctcatttctatttatttaccgactagctataataaaacctccttataaggttgtgagaattaaaggaggtaatgcgtgtaaagttcttaatccagtgcttagcttatagtcagccctcaataaccgttagctagaaaatagttataagggccaggcgcagtgactcacgcctgtaatcccagcactttgggaggccaagacgggtggatcatgaggtcgggagattgagaccatcctggccaacatggcgaaaccccgtctctactaaaaatacaaaaattagcagggcatagtggcgcatgcctgtagtcccagctacttgggactgaggcaggagaattgtttgaaccaggaaggtggaggttgtagtgagccaagatcgcgccactgcactccagcctggcgacagagtgagactctgtctaaaaaaaaaaaatggttataagtcagccttccatatgcacctgatttccattgaatcacatctaatattacagcattagttcggtaccacttgactttcacttctttttataagaattatttgctgggcgtggtggctcacccctgtaatcccaagcactttgggaggctgaggcgggcggatcaactgaggtcaggagttcgagaccagcctggtccacatggtgaaaccctgtctctaccaaaaatacaaaaaaaatgagctgggcatggtggcacacgcctgtaatcccagttactcggaaggctgaggcaagagaaccgcttgaacccaggagggggaggttgtagtgagcagagatggcgccactgcaatccagccgggaggtagagcgagactctgtctcccaaaaaaaaaaaaaaaaaaaaaaccaaaagaattatttatagcattatgaaattataagattattaaatatctgattatagaagaatttaggataatcctgttctagactcttattcagcaaatatctgctgagttcctactcagtggtaggcactgtgcagcatgctggtgataaggtagtaaaagacagagtccctgctctcagggggcttactgtctgatgcagaaggaagaccagccaattgacaagtaatcattaatgtcatgagtatatttatcatactcttctagcaaactctcccctaaaataggtatcctttgcctgtcctgtgcattttgtactgtgcaaatgttcattaagacttagcttgttgatatgaatctatttaaagaacattataaaccagttataacccattttaagttattggctttgtgatctttttaggaaaaagaacaaatcactataagtcagttgtccttggtagatcttgctggaagtgaaagaactaaccggaccagagcagaagggaacagattacgtgaagctggtgagtaaagcatggtatttatttattgctacaactttcagaaacttgcaatgccagtttattatctacttatcaatgggtggttctttgttttttaatttttattttattgagacggtcttactctgttacccaggatggaatgcagtggtgtgatcatggctcattgcagcctcaaactcctgggctcaattgattctcccattgtaaccttctgagtagatgggactacaggtatgcaccaccatgcctgtctaatttttaaaaattttttgtagaggtggggtctccttatgttgcccaggctggtctcaaattcctgggctctagtaatctctcaccttggccgccccaaagtcttgggattacaggaatgagccactgtaaccggcctcgatgggtggtttaagcacaattgtcctccattagataatttagaggctaagtttatagttaggctggtttggtattaatctattacaatacactgatttctttaagaatgaggaaagttgtattcaattagtctgggtgcggtggctcacacctgtaatcctggcaatttgggaggccaaggcatgtggatcacttgagcccaggagttcaagaccagccttggcaacatgatgaaaccccatctctacaaaaaatacaaaaaattagctgggcgtggtgcgtctatagttccaaggtacttggaggctgaggtgggagaattgcttgagccctggaggtcaagactgcagcaatccctgatctcaccactgtactccagcctgggcaacagagaacctgtctcaaaaacaacaacaacaacaacaaaaaaggactctatttttagtgttgtaggtcagaattgggtccttgaaatgttatttcaatacttattagtggtaaaaattggcttctagagatgggaaaattctgaacacaagccaattgaaggctttaaatatatatatagccaatctgtatatgtgttttttaaaattcatgcatgttatgtcctgttacctttttgtagttttttaaaaattaatatatcatagttgtacatactttttgggtatatgttatattttgatagatgtatgcagtgtgatcaatcagtgtaattgggttttctgtcaccttgcatgttgtgttttatgttaataaacatgtattgagtacctactatgtgccaggaattaaacacaaattaattcccattaattctctctgctggagcgagcccatcctaatagaggagatcagtagataaactagattgtttgagtagagtatgatgggagtgcagggtagggctgcctaaaccaatctgggagtgggaaggtgaaaaattgagtaggagtgagctgtatgaagcaggataggattaaaggcaacgttcctgtcccaggaggcagttgcttggtcctgagatactatggcagagtcaaagtagctgaagtagaggatgtaagttggtgaactatgagaactgaggcaggagagcaaggcaaggtcatgaagacccctgtctgtcatatcaagaagtttgaattttatcttgaaggaataatgttagctgccaactattaagggtctagtgtgtatgatagtatccacacactagataggtaggattgtatcacacccatttttcagatgaggaaataggtttgggaaggttaattttctcaaggctggagccaggttggttggactctcatagcttgtgtctttatactatgtcatacagcctccccttaaagaaggattagtcttttagaaagatcattttgccagtgtagagaaataatttaccaggagcgagcctaaatacatgaaagagcagttaggagccttttgccccaattcaggtaagcaattgtgtgacctggaggcaaaggtcagacaacactgagagctagttaggatgtggagaataaggaggtgtttgattgaggagaagcagttttaggagcaggtataggcaggtaatgagttgtatttgaaatgttcaatttatgcaagtgaaagtgccttgtaattggatgcagaggtacatggatttggaaggagagagattttgacttgaggtttataggtttaggctttgccaatagagaaatgattggctggatgcagtggctcacgcctgtaatcccagcactttgggaggccaaggcaggcggatcacgaggtcaggggatcgagaccatcctggctaacagggtgaaaccccatctctactaaaaatacaaaaaaattagctgggcgtggtggtgggcgcctgtagtcccagctactcgggagcctgaggcaggagaatggcgtgaacccgtgaagcagagcttgcagtgagccgagatcgcgccattgcactccagcctgggcgacagagcgagactccgtctcaaaaaaaaaaaaagaaatgattgaagcaattgggtgagataagataattcatagcgaatggagaggaacaagctgagagcagaagcttgaggaacagcaagcccttgattattagcttgggatggacagagaagggtgatagctaaaagggatttgagggattatgaaatgatgaaaaaatacacacacacattatatatgtacattagaagatagtaaagacttgagtttattcatatgctgaagagatgatgtttaagtccagtggtgagaaatggggcctttagagctgcctctaccctggcccaaaggactcttgcaatttgtctgaatcatttgaatttcatgagagtggactgtgtgtgtgctgtctgtcaatgtctacccagtgcagcttacctactaggtgttcataataaagtggtgattattggcggagcaagatcctggaagaggcaggaaaatctgaatctagatccaagaggaaggattaactttgatgggacaagagctggtttgggaagaaagtaaaaacttgaagttttggatgctttggggaaaagctagaaaggactgttagtgttaatatagagttagggagtgagagtagaaaaggagattgtagttggggcatatggcagaggctccaggtttttagaagtggtacacttctgagggatagggtttgggctgtcagctgtaatggaatagagataaagatttactggagctgggacattgggaccctgtgactacagcatatgagaatgattgttgttctcatggacaccgaaataaaccagggactggcatgtaggaggaatatttcaaggcaataaggaggaactaggaaaatgttgctagcctctccctctgtttaccatacttgtagaatgtcagcctttagaaaacaagtagcttttttttttttactccaaaaggctacagggctgcagcaagagataaatggttaggttgcagggctgtgtgccatggatgtagggtgaagcctatggacccttcctggtatagtatttctgaaggtataacacagagaggattacagaggaaaccaattgcattgaaatgtgttttaaaagtattcttaagtttgtcatacagtaattatgtgcttctttattaataccttaaagacacagcagcaggtctgattaaataaatgcagtgtaatgatgaacataaatatcttgatgagcaacaaactgtaacatgctataaaaatatctgtgatttgtattgataccaattacaggtactactaatgctgtggtttttggcctgcattcataattgaaggaactagtgaattccagttggtttggtaaaaagtaaataatgtaatttattttccatctaagtatgcagacaccccatcatgttcccccggacaatatagacctcaggttaagaacccctgaccactagggaaagctatcaatggattattttgtgagagatttgaagatgcagggaaatctgttaataacatgagttcctgagagcacagtggaagaagaaagaacattaggagtttgggtcaaggaacgtaaatcatgaatcatggaatattacagaggtacagatgagttctgtattttgggaggtgtatccaagatcctccaaggaggccaagggtgaaagcataatcgagttagctgacctcaatcaaggtttcaaaatgaactcattcttatggggtctaatcagatgagagctgcattcttgaaagcttgattagactgttagacttgccttggctcagaaatccaaataagagtggtcagaagtaacaagtatgccacctaagaaatccttgctgagatgtagaggggacagagttagctgattctgaagacacttgactgttagaaacaacaggagagcccctctagatgcagcaagagcttcagactcttgcatgcttcttatgagaatctaatgcctgattatctgagctggaatgatttcatcccaaaccacacccctcaagcctcaacccatctgtgtaaaaattgtcttccatgaaactggtccctgatgccagaaagtttggggatctgctgccttagagaatatattttatttatttattttttattttattttattatttttattttttagccacataaaaggtagcagcacacttatttggaaaacaataatttcaaaatcatctcctgaactcagaatcgatgggtcagggtagacaccctaagtaaacaggtgaaatcttcattaattgttcacttattaagtaaaaatttaaattaattgattatgtacagcagtgtttttccacatttccctgataagaatcatttggagtactctgtaaacacagcttcactggagattaatcccatcaaattgatttagtggctctgggatgggccacagtagtttggaaatttttatttttacaaatgcttcctgatgatgaccaaatccaaggaaatttgggaaacactgatctggaacataactttcagttttccctgcagtttttaagtcttgaacgactgatcatcctagagataacccactgaaaagtcttgtccaatccagttttatgaaagaaaactctagaacatttggtttgataaaatttttccgaagcaccagaagtactttactttggctttttaaatttctggtccatcccttctagttcatgttttcttgaagaatccatcttctttgagttgagccacagcaatctaatcttttttttaaataattggtttcttattaaaggattgcgacatttaatagccgttgcttgcttttgtctttctcccttctccctgaaacttgttaagagatgactcaatattctggcctttccaccttcaatctcatactgaccacgccgtgtatgccagcctggatctcatagttttctttaactggttcaactccctttgttgtcctggtcaagataacatctccttcttccaaggtcatgatcttagaaacatagttgatgatgtaggggatggaaaaagtcatggaggatgtctcaccctcctgtcttgagttcgccgttgaccttgagccagagcctcagattgggaggatcagggatcttctccttgggcacgaacgcgctgactgggcaggaggccataaagctcttggccagagtccaaggcagccccttcttcttgcactcatcctgcacgtccctggcagtaatgtccaggcacagggcatagctgctcacgtagtccatagctgcgcggccatgcttgcccatcaccatgcccagctccagctcgtggtgcaggttgcagctgtacgcgggcatgaggatgggcgagccctcaggtgtgtaggccgtggacagcttcagaaacagcacggactcgctcaacaccgcgttggcatctccctggtgtggtccccatagttcctccccacacagacgatattcttcccccacccccagaagcgggacggtggcctgggggtcgccatgattcctgtcaattgcctagagaatatattttaatatgaggatattaaacatctctatataagatattccttcagagaatttaggatttggaagaaaccttatagtcattaactgtaatgttgcattttgtggaaaatcctgttggtagaatccctgaaggatggctgtttaaccttcccagaaatactgctattgaaagagagcctggaccatgcatagacagctctttatattgagccacaaaaatttgttatttataatttctatctagtagttgtttgaagttgagattttataggcaaacagaacacactttagctactatactgttgttctgaaatggcgtctatgtatttttttctgtcaggtaatattaatcagtcactaatgacgctaagaacatgtatggatgtcctaagagagaaccaaatgtatggaactaacaaggtaagcagcagccttctctgttcttttgtatagtttcatttgtgtgcattttttttgcgtaacacatttggatatgaatgtctttgtagatggttccatatcgagattcaaagttaacccatctgttcaagaactactttgatggggaaggaaaagtgcggatgatcgtgtgtgtgaaccccaaggctgaagattatgaagaaaacttggtaattttaatgtatttgtcctataaagtcttgagtttttgtcgggaaaacagttacttggatgagcagaatgacattttgaatattttaaaaatggatagagaaccattgattgtagaagtaaactaggcttggtgtggtggcttatgcttataatcccaacatgttgggaagctgaggtgggacgatcaattgggcccacctgggaggtcgaagctgcagtgagtcgtgttcatgccactgcactccagcctggtgacagactgtctcaaataaataaaaataagcaatctttgcttcatttagtaatttctgggacttggatatccttatttttttttaaactccatttgttttgtgttttagcaagtcatgagatttgcggaagtgactcaagaagttgaagtagcaagacctgtagacaaggcaatatgtggtttaacgcctgggaggagatacagaaaccagcctcgaggtccagttggaaatggtatgatttggtgttgtatcatttgtccactcattggtctgtctgtttctctcttttttaaaaaaaattatttcatttaagagaaatgtttacataccttctgaagaaccaagcacataataatttgaacaaaatttaaatgagcttattttgcatactatgattcttaggtaagtaaacttatgtcagctcaagaaattgcaatggttagttgcactggggctgtatgcagtgttaaacttgtttaaataagctctttctctcctatgtaactttttgtaattttctataattcaatacagaaccattggttactgacgtggttttgcagagttttccacctttgccatcatgcgaaattttggatatcaacgatgagcagacacttccaaggctgattgaagccttagagaaacgacataacttacgacaaatgatgattgatgagtttaacaaacaatgtaagggcaaaactatttgaaataattttatttaattattttttttttttgagacatagtttcactctgtaccccagggtggagtgcagtggcacaatctcggttcactgcaacctccgcctcctgggttcaagcgattctcctgccttagtctcccgagtagctgggactacaggcacatgccaccacgcctggctaatttttgtactgttagtagagacggggtttcgccatgtaggccaggctggtctcaaactcctgacctcaagtgatccgcctgcctcggcctcctaaagtgctgggattacaggcatgagccaccactcccagccaatttgcaataattgtaacttctgaaattgaaagtattttcaatgaatctgagttatatggtagattgcatatttaaggaagttaaagaaaattgtgtctttagaactttgaagcactcaaggcattgtttgattagtatgacaaggcatttttccacagctcttttttgtattctaaggaagtcaaaaagaaaaaagtgagcgtgtgttctttcttttgttttttacagtgatggagacacaaagaaatattttttagtttcccctgtctacatagtggggattgtaattgtttctacctcaggatatgttgtgaagataaataagataaagtatgaaaatcctgtagaacagtaaattctggtacatagtgaatgtatctcagtgaatgaatgtatctacttttttttttttttttttttttgagactgagtctcgctctgttgcccaagttggagtgcaatggcgcaatctcggctcactgcaacctccgcctcctgggttcaagcgattttcctgcctcagcctcctgagtagctgggattataggtgcacaccaccacgccctgctaatttttgtatttttagtagagacggggtttcaccatgttggtcaggctggtctcaaactcctgacatcgtgatccacccaccttggcctcccaacatgctgggattacagacgtgagccaccatgcctggctctactatttttattatcattattcatttgaatctttaccaaaaagttgtgagataaagtggtatttaaatttccatactgaaatgaaatttgcccagaaatattaattaactcgcctaagtcataactagtaagtgatgttccaaggatttcagctcaggtttaattaatcccaaatagtagtgttgtttctatttttgcgtttgttgttgtgaagcaaagtacctgtaaggattgggaagagaatgctatagtgcacagtgaaagacttgagtattttttcagcatttaacagaaagcttctgtgaatatcttgtcaactggagaatgaagctcctgatttccctctaaacttgttttctcattatagactgattctcacagagatttgctgaataactacattttatctagtgtctgctagcaaaagttgatatcattgtttgttttagaactggtgtaaaacttgacctgtatgtttttgtttcagctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataaggtttgttttgacattattatgatagatgtatgtgctggtgttttagcactgttctctgagggagatattgtgctccaacggcctgtaaatgctgcttattaagagttctcggttgagtgcggtggctcatgcaggtaattccaacactttgggaggctgaggtggccagatcatctgaggtcaggagttcaagaacgagcctggccaacatggcaaaagcccatctctactaaaaaagtacaaaagttagctgggcgtggtggcgagtgcctgtaatcccagctactcaggaggctgaggcaggagaatcgcttgaactggggaggtggaggttgcagtgagccgagattgagccactgcactccagcctgggcgacaagagcaagactctgtctcaaaaaaaaaaagagttctcaggctgagtgcgggggctcatgcctgtagtctcagcacattgggaggccaaggcagggagatcacttgagcccaggagttccagaccagaccgggcaacgtggcgaaaccccatatctacaaaaaaaattagccaggcatggtggtacatgtctgtagtcccagctactcggaaggctgagatgggagaacagcttgagcctgggaggttgaggctgcagtgagctgggattgcacgactgcactccagcctaggtgacagagcgagagcctgtctcaaaaaaaaaaaaaaagttctcaattggttgtttactaatcctcatcccatgctaaggaggaaatgtgagtgaaatgaagaatcatatgttctttaattttatgagagttttaacagttgaaaaggatgttctctgacccaaacaagggagctttctagagcttagctttggttgtagcttgcttttgaatttattagaaatatttccttagtatgctttttttttttaatgagataaatgattaaatgaaatggtataaaagtgccagcatcgggccttggacgtaacagatactcagtaaagcttaattggatctgtatttggtttacaaatcgattgtaaaagtataaactcaggattaatctcttacaatggggtagaaggaaataccgttttgttgggaagcattgcagcactgtgtaatgtatgtctgttctctcatttacagagggtcatttagaggtttggtgggggtacacattcataagagaagttagtctcaaccaatatagtttttttaaattctgaaaatagcctaaaaactaaattttagcccttaattttaggagaaagtaattttcacatgaagttagttgtaaatgtctttgggtgaggagcttgtttaacatgttttcatttctgagaatgggggtgggaattcagatgaaatgttagagaaaaaagtgctttctccatgatgtttctttccacaaatatgcttgcataagcaaattaaggaagactattttatagcgacatgaaatgtttatataccaaatattgaacatagtggtctaccttcctagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgtgagtatcgtttgggtagtgcttgtctcagagtcggatgatttattttacattgtagttaggttcaatattttgaattattgtatttgcggtagggttttggtggtggttgttaactctcaggaagaattggagaactgtcatttttaggaaataaagagattgggtaatctggtgtactcgtttgctgtgatggaatgataatatacattgccactgataatctgtaggagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctgtaagttatttgtaattgtgtagtaactttgtactagagaaattttgttcagattagatgactatttctatgaggatttttacattttataatacttacatttctgaaatttctctaaaaatattttaaaatttagaataaacacaaatttagcacaaaaaaatagaacaaataattatttgtaatgttaagtcttcatgtgctaacattatagaaaagtaatgaattgtttctctcagtttttcagtcttgctcattaatttttctccaatttttctagctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggcgagggatgtactggactgaaggcagggaggtggttcctacattcagaaatgagatagaaatagaagaggatcattgcggcagggttagtgccagtattattttaacgcattgtagcaatagattttatcttctttgttttttgtaacttgtgtctgaaagttcattggaaaaatggttgggctatagtataaagaaggtctaatttctcagttaatttgaaagattgacttacggaaattgaggcctggctcctcatctgaaaaagcctaaacacatctggcagcggaagtgtgttcagtgaacacaggtcagtttggtgcatcccagagtagtctgagcttttcagctgcatacgctaataagctttgcacagaattggtgaatgtgtcttaaagcatactttccatatttttcttttggttccccttccccaaattagattttttatacctcctttcatgccctagttttaaaaattgttttcccaaatttttattttgaaaaatttcagacccaaagcaaagtagaaagaatagtatggtaatgtctttccctccttgcctaagtttaccaattgttacttgatatagatatgtaaacctttttcccctaagccttgtgaaaggaaatcacagacttagagacacttaatctctaagaataaggacattgtactacctagccacaatctttatcacatccaagaaaaatcaacattaattaattatcctctattgagacattgtgcagttgtcccaaaattggattggcttttctttttttttttttaaagacagagtctcactctgtcacccaggatggagtgcagtggcatgattatggctcactgcagcctcagtcttcctgagctgaagtgatcctctcacctcagcctcccaagtagctgagattacgggcaggccaccatgctaattttttattttcagtagagacaaggtctcaccatgttgcccaggctggtattgaactcttgaactccagcaatcctcctgccttggcctccaaaggtgctgagattacaggcaagccactgcaccagccagcttttttttcaatccatgatactatgaaagtgtatgcattgcatatcatgattatgtctttcatctcttttaatataaaatagtctcaccctgtccccctactttttttatttttatgacattgactattttcattgaagagtttaggccagttattttaaaattactgatttccatgcccaataaattgcttttaatcttgaggcatttatctcaatttacatttgcctcattcaagggtatttaaataaattcactttcatatttttcttcttaaagattaaggtaaagtttcttttgaatctgaataaatggaccaagttaatgtttgcgaattttatatttagtaaaatcttcacaaagctctcttagaatatttcttctaaatcttacagtaaacatttactttagattttcttatataagtcagggtatagatgaatgttcatttatgtggcctgaattcctgattattaagggatggtgatgaatcccaagttatttaccagggaaacagatgattctaaagtctcttaagttctttactttgcagatttttccttaaacatttttagacagcaaattaggtaaatggtcattctgaccaactctagtcagtcattttatgaaagtttataggctgaaaactattcaaggcttgcgtatgccttgcaaaccgtaatgagatatctaatttggctatgagatatttaagggaatttactagagattcttacgtgaaatcaaaatctctttagaagtgcagcagaaaagttactgtaaggttagtatctgtgcatctaagtttgttggtcaaaaattatgtcaggtggactgaatttatacttcagtgaggaaaaaatttaaatatttgtttcataaatgctagtagattgtatggattatcatctttctgaagcgtgtttcatcatatgcttattgttaaatgtttgaagaaaacctttgtttttgctaaatggtagatgataaggaccagactttctttcgtgttcaacattaaataaatcattgtaggaatggaaagttcctgtttgtcttgaggctcagcatctttagtggcaaactgtattgcccatgtcttagagctgtcactagtgctgcatttgtttcttgttaactatatagcgaaaatgattcagttcctcagatgtgcattttgaaattgaggtcttcatacttgactagctttgacagatttggcctgtgatagactttttccatttgctttcagttttgttttttgggttttttttttttttttttttttttttttttgagatgaggtcttgatctgttgcccaggctggagtgcagtggtgtcatctaggctcactgcagccttgaccttccaggctcaagtgatcgttctacctcagcctcctgagtagctgggaccacaggcatgtgctatcgcacctggctaatttttaaattttttgtaaagatggggtcttcttacattgcctaagctggtctcgggtgatccttctcccacctcagcctcacaaatgttgggataacaggtatgagccactgcacccagccctgctttcagttttacaaacaggagatgttcataaaattctaaagataattcattgcttcaaactataactatggcatatatgtgacatattattttcttaggctgaatgtgcttaatttagcattcccaggtttacatgacatttgactggaagcaacttgtttgtttttgaggcagggtctcattctattgcccaggctggagtgcagtggtgcgatcttggctcactgcaatttccacctcctgggctcaagcaatcctcccacctcaacctcctgagtagctgggactacaggcacgtgtcaccaagcccagctaatatatatatatatatttttgtttgttttgttttgtttttgttgagtctgggtttcaccatgttgcctaggctgaacttgaacttctgagttcaagtgattcctccacctcggccttccaaagtgctgattacaggcatgtaccaccatgcctggcctagcaactagtcttttattgtgtgatagagactgatttgacactgtattatttatttgtttcttggaacctgtatgaaatgtttgggggaaaaattagttggtatattgtagccattactgtatttgaacttttcatgaagttctattatgagattttaaaatcttaactgaaagcactcagaagtatttcacatttctttaatcattttattcatatggttcttattatacctatgttcttaggattgttttctgttttgtttagaagcctagaaaatgtgtagggctttcattgatcttattgaagattttaacagagttgtggacataatagattacctctcaatagcagggataaatattggtttttgatcaagaatatgaaatgagttgtttgtcctgaaccacccccaagcaggaaagacttgcagcattaccagaattttttcttttatcctttattgaaagggaaactcccagatagaatgtgtaacatacaagttggtgttaaagatgtttgttggttttgtgtttaaatgcaaagatcatgtttaaattacttgaataaaatatttagctttggaaaggtttgctatgatactgtcatcaactaatgtagccaaacctgctgcacttctaataatacccttaaattaattctgggttatgcttgtttctcagttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaaggtaaaaaactaattttcacaggagaaaaaaatatatttaaaaattcaacaaaagtccatttgtcctgctactcctttggtgacacacaggtagtgtcaactggaacatcagtaggtatttgatataacctttttgttagcagaaaattagtcactgcttaggttttaagtctgccaaactgggactaagtatgctttaaataggtatagattcttcggtttcttagaattctagatccatgatgtactttaattttttaatgactgtatatttagttttaaccactacttaaagtaatctaagcaaagaattcctattgctctccatcagttcaagataaaaaaacaaaaacaaaacaaaacgaaacctatgttaaaatttgacccgtcaaaattactcagtattgagctgcctaaagccgttttccagaaagagacttgcctgactatagaagaattcccctttgatcatagggtcagtgaataatcaggaaagtaaaagataagaccaaaaaaaaaaaaaagctttttatttcaatttcaatttagagtttttgttcttattataattagctacaaataagactatactgtcatttgaatatgggcaacagggggcactcagagaagaaagtaccatgccttagagcgtgtagaaacttccagcaaatttcttgatccttagtgcagtttagtttttaaattacagatggagcaaaaggaatatttttttctgcaattatgaatgttactgattacattgaattggacttcttttatttgtgagagatatgtactcaaatttctaaattattttgatagtacgtactcagcaagtaccaagtaccatctgattttgtggatgggaatttctataaaatagaatcatgagaacagtttgaaatatatatgtgtgtttttcgtttgggtgtatcaatgtgtaacagtgaccttttcttttggctttagggtgatatttataaaacaaggggtggtggacaatctgttcagtttactgatattgagactttaaagcaagaatcaccaaatgggtaagtaaccatcaaaaatctctgtataaaagttggtcattttcttagctgctcattttggaggaacagaatagcctgtgaaatgtatcattaattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcatgttttaaaccccacagctctagatttttatgctctttgaaaatgctgaggtataatctcacattgccagtgcaccatgtaggcctattcctagaataacaagaatccacttcatcaggaactcccttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaattacgagtgactggtgttttaacgtaagagtctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagtgagtactgactgtaattggggtcttgctgtgtgcttttttcctcctctggtctttacattatcactccttctaccagccatccacttattcttcagaagaaatatatggttttggttttccccttggactatctgggcctccatgggcagactgcagtaggcagctggaatgctgagagcctcagaaggctggataagagcaatcagagctgcaaggcaggcggtggtggaagattggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttcttcttctgttaaacttatactcaggagtctgacccagtctttttccatattttaataaaatcccttctttacaaatacatacatatatgtatatcacatgttacatacatatatgtatataaaatgttatatgtatataacattttaaacatttacataccttactgagcaatttagaaaattgttgcagcaggataaagatgggaaatcctttctaaatttaatactaagataagcatattttataaaagttgtttgctttctcagagggacttgaattatctcatcataaaacagcagttctcaaaggcctcctaaagattgatttgctatgaatgtgttactaattgcaaagttcaactctaagtgctggttgttatgttttaggcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaatacatagttgtgtgatggctgttcattcaacacgtcctcccagcacctggcacagtgccctgcatttacctggcactcattgtttgcgggatgaattaaaagaaagctctaaaaaatacaagataatatgatgttaaacggacaatgcctttttttatgtgacaaccataattatctacatattaagtatgacttctagacatttaaacaaaaagcatagtttggggacaacataaattagaaaaaatactgtcgaaaccatggtgaaatatcccattgcatgggtgaacacacattttacttggatttaatttggatttcttttgaggctgagcttttttttttttgagatgagtttcgctcttgttgcctaggctggagtgcaatggcacgattttggctcaccgcaaactctgtctcctgggttcaggcaattcttctgccttagcctccgagtagctgggattacaggcatgcgccactacgcccagctaattttgtatttttagtagagatggtttcttaatgttggtcagactggttttgaactcccaacctcagccacctgcctcggcctcccatagtgctgggattacaggtgtgagccactgtgcccggccactttttttttttttttaactaaaatgatagtttaatcttttgttattaataataaaagtgtgatatcagtccttgccaaaagccaactcaaaagttaagggagaagacaaaatgcactagtcactcacagtatagtagtaaacaatgtcatatatgtgtgtgtgtgtgtgtttttgaggggagggatggattttcactcttgcccaggcttgagtgcaatggcgcaatctcggctcaccgcaacctccgcctcctgggttcaagcgattctcctgcctcagcctccccagtagctgggattaaaagcatgagccaccaggcccagctaattttgtatttttagtagagacggggtttctccatgttggtcaggctggtcttgaactcctcaggtgatccgccctcctcagcttcccaaagtactgggattacaggcgtgagccactgcacctggcctatatgtgtgtttttagaatgcttcaggacactaaaggttaaattgctattgcagtagatacagaatttatttcttgattttcttcttaaagttttttttttagaaacagggtcttgctctgttgcccaggctgaaatgcagtggtgcaatcatggctcactataacctcaaactcctggattcatgtgatcctcctgcctcagcctcccaagaagctgggactacaggtgctcaccaccatgcccagctaattaaatttttaaaaatatttttgtagagctggtgtcttgctatgttgcctaggctggcttttttctttcttttttgagatggggtctcattctgtcacccaaaatggagtgcaatgacatgatcacagctcactgtagtctcaacctcccaggctcaagcaatcctctcacctcagcctcttgagtagctgcaactacaggcaaatgccagcacacctggctaattttttattttttgtagagatggggccttgctctgtggccttgtctggtctcaaactcctggcctcaagcaatcctcccgacttggcctcccaaagtgctagaattacaggcatgagccacagcacccagcctgctttttaaattattatttaaaataatagagacagcccgggcatggtggctcacaactgtaatcccagtactttgagaggctgaaacaggatggcttgaggtcaggagttcaagaccagcctgagcaacatggtgaaatcccatccctacaaaaagtttaaaaattagccaggtgtggtggcacgcacctgtagtcccacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12430 - DNA, 7007 bp, Human
gcctctaatcccagtactttgggaggccgaggccagcggatcacaaggtcaggagattgagaccatcctagctaacacggtgaaaccccatctctactaaaaatacaaaaaaaaattagccaggcgtggtggggggtgctcatagtcccagctactcaggaggctgaggcaggagaatagcatgaacctgggagctggagcttgcacattggagtgcaatggcatgatctcagctcactgcaacctccgcctcctgggttcaagcgattctcctgcctcaggctcccgagcagctgggattacaggcatgtgccaccacgaccggttaatttctgaaattttttagtagagacagggtttcatcatgttggtcaggctggtctcgaactcctgacctcaggtgatccgcccgccttggcctcccaaagtgctgggattacaggcgtgagccactgcacctggccaggggctagagttttaatttttaaggattttggagtgggctgaagtgtggaggtcattgcttggtgaaagagtgcaggaggtgaagtcacagacagtaagaaactgtattctcatgcagattccgttcctctgtggggtcttcacactggtgggtgtcattggttaaggatttcaaaaacatcttaagaaattcttctaaaaagtcttatgattctaaggtcggaaatcacatctatagcaaatggtcggtatcaggtgctacaagcaacttgcggtcacaaggaagtgggtcaaagtgcagcctgattagtgcttaattataactaagtttctgtccagaattctttttttttgagacagagttttgctcttgttgatcaggcggaagtgcaatggtgaaaacttggctcactgcaacctccgccctctgggttcaagcgattctcttgcttcagcctctcgagtagctgggattacaggcatgtaatcccaccaccaagcccagctaattttgtatatttagtagagacagggtttctccatgttggtcaggctagtctagaactcttgacgtcagatgatccacgtgcctcggcctcccaaagtgctgggattacaggcgagagccaccgtgcccggcgcagaattcttttttttagagacgaggtattgccatcttgcccagacttgtctcgaactcctgggctcaaacaatccacccacctcggcctcccaaagtgctgagattactgacataagccaccatgcctggcccccagaattatgaatcctgtgaggatggcttcaaggtgagcgctgagccagacaaaaggatggggtttgggagcaccctgcttagactggaaagataatgttggagaagacttcctggaagaggggctttttgcgtagagttttgaagaatgagtaggagttctccagaggaggatgagtaactgcaataacacccagtttatcaagtgcctcctatgtgtctggccctgtgctttacccctcatttgaccacctctccagtgagagtctcagtcctttttttcctggtgaggaaacaggcatggcagagaggcatgacacatcaaggttgcccttcctggctccatctagcccgttctcctctgcttcctttgtttttcaccatctttagcctttgaccccaaccaaaaagagaagagaggaaatcccatgggcatagacagccacctcttaaactcttgtctggaatttttcacatagtaacaatgtctttttttcctccaaaaagactcccaggctggaatggtgtcctcatatcgaggaagaggatactgaggcccagaaatgtgccctagctttactaggagcgcccccacctaaagatcctccccctaaatacacccccagaccccgcccagctgtggtcattggagtgtttactctgcaggcagggggaggagggcgggactgagcaggcggagacggacaaagtccggggactataaaggccggtccggcagcatctggtcagtcccagctcagagccgcaacctgcacagccatgcccgggcaagaactcaggacggtgaatggctctcagatgctcctggtgttgctggtgctctcgtggctgccgcatgggggcgccctgtctctggccgaggcgagccgcgcaagtttcccgggaccctcagagttgcactccgaagactccagattccgagagttgcggaaacgctacgaggacctgctaaccaggctgcgggccaaccagagctgggaagattcgaacaccgacctcgtcccggcccctgcagtccggatactcacgccagaaggtaagtgaaatcttagagatcccctcccaccccccaagcagcccccatatctaatcagggattcctcatcttgaaaagcccagacctacctttgagcctcagttgccccatctgtgccctgggtaggaatatcctggatccccttgggtctgatggggtagccgatgcctgatttgcacccacaacgtgggaggttataacctgtccccaagttgcaaatggggaaactgaggtacagggatgccagggaccctcctgaatgtgcacagcacctgggaaacccggggacggggtcgggcgtgcggtgtgggcatggtccctgacctgggctggggccaggatccaagagaaacaatgggggtgtggtgcatggatagaagtttgtgatgggcagagccagctggagctggttctgaatctgatgaaatcgcttgtcaaggcactgctaaagtcacatgcaacgagcgacttgttaggggaggaggagagtattttccccatctctgtgccctccatggaggctccaggggtgcagggcactggatgaggtctgggctgtggtgggacccaggagggggcaggcagaggggcacactcttagcccgccctaaacccatctgtgccgtgtgactccggcaaacctctcacccttgctaagcctagcaactaggttaaggcaccctcaaaccccagtctccccagtctccctaacacttgtaccagcctgaggggctgtgattcctagaggctcagtagtctggaatgtgatgggtttggcactcttcatttctcgggattacacctgtaatcccagcactttaggaggccaaggtgggagcatcgctttaggccagaacattgcagcctgggcagtatagcgagaatccatctctaccaaaaatgtttaaaaaaaattagccagacatgatggtgtgtgcctgtagtctcagttattcaggaggctgaggcgggaggagcacttgaatccaggagattgaggctgcactgagccatgagtgccccactgcactccagcctgggtaacagcaagaccataataaataaataaataagtgaagcaagtaagtttttgactgccagaagaaaagcagagccatggttggaatctcaggctgcctgaatatcagatatacattaattccttcaagtatttactaagcacctattgtgtgccaggcacagtgtcaaccaagctaagattctaagtagggaatatgaatgatacacaaggaaataaaatagggtgcttcctattttaggcaggctggaaggaagaggaggagccagccatactgagattcaggagattcaaggggagaaatgcccttttttttttttttttttttttttttgagagggagtcttcctctgttgcccaggctggagtgcagtggcacgatcttggctcactgcaacctccaccgccccgattcaagccattcttctgcctcagcctcccgagtagctgggatcacaggcgccagccaccatgcccagctaatttttggtatttttagtagaagcgggcgtttcaccatattggccacatatcggccaggctggtcttgaactcctgacctcaagtgatccacctgcatcggcctcccaaagtgctgggattacaggcgtgagccaccgcgcccgcacggagaaatgctcttggtaggggaaataacttgtgcaaaggcgccgccgccgtggtgagatccagcttggcgtgttaggggaaatgggcaccctcgttcctggaaaacggtaggcctgtgggtgaccagcttccctatctgtcttcccacagtgcggctgggatccggcggccacctgcacctgcgtatctctcgggccgcccttcccgaggggctccccgaggcctcccgccttcaccgggctctgttccggctgtccccgacggcgtcaaggtcgtgggacgtgacacgaccgctgcggcgtcagctcagccttgcaagaccccaggcgcccgcgctgcacctgcgactgtcgccgccgccgtcgcagtcggaccaactgctggcagaatcttcgtccgcacggccccagctggagttgcacttgcggccgcaagccgccagggggcgccgcagagcgcgtgcgcgcaacggggaccactgtccgctcgggcccgggcgttgctgccgtctgcacacggtccgcgcgtcgctggaagacctgggctgggccgattgggtgctgtcgccacgggaggtgcaagtgaccatgtgcatcggcgcgtgcccgagccagttccgggcggcaaacatgcacgcgcagatcaagacgagcctgcaccgcctgaagcccgacacggtgccagcgccctgctgcgtgcccgccagctacaatcccatggtgctcattcaaaagaccgacaccggggtgtcgctccagacctatgatgacttgttagccaaagactgccactgcatatgagcagtcctggtccttccactgtgcacctgcgcgggggacgcgacctcagttgtcctgccctgtggaatgggctcaaggttcctgagacacccgattcctgcccaaacagctgtatttatataagtctgttatttattattaatttattggggtgaccttcttggggactcgggggctggtctgatggaactgtgtatttatttaaaactctggtgataaaaataaagctgtctgaactgttccctgtggtgtccaggataagggaaggtgaccttgagaagatcctcctctccctgacctcagtttctctaggagacctgggagggggtaagtggaaaggctcaaggaatgagtggcaaggtgttctcggagatgccaagccattggaaggtgcttacgacacctgtgggctctaagggcagccttggccattcctgactccctgactctctgtctctatttctctatctccttattgctgtttcttttttctttttattttttttagacggggtctcactctgttgcccaggccgaagtgcagtggcacaatcacagctcactgcagcctcaaccacccgggctcaatcgatcctcccacctcagccacctgagtagctgggactacaagtgcatgccatcatgcccaactaacttttgtattttttgtagaggctgagtttcgccatgttgcccaggctggtgtttctgttttggaaacagctgagaccccatacctttttaagtctcagcttccctccatctttcctcattcctcaaaacttctctctttggggtctgaggcagaggatctgtctctgtctttgtctctatcaccatcctgttgctctccccacttgggagtcacctttccaaacacaggcagctcagagccaagtctatctgcaaccaagtgccttgttttgtggtactgtccccaacctgaggggttagtcccatcacccctcctgtttgtggcacttccatgttagtgacacctcattctttcacatataaagagtagggagaaacaaataagttgtgaagaatattttcatgcacaccacatctcccaggttatatatacttcctgtttaggatgttggaattttgaggtgtgctgagtccagccccctctccacaccaaactgcctgcccatcctgaatctctgagaggaatggcgatgggtgtcttgagggacagagtacccacttccagcagtgaggtgtatctgctgggaatgccatcacccacaggccaacctgaatgactgcaggttccccttaacgtattcagtgagtgcccactttatgccaggccccggacacagctgtaaaaagacacacaaggaccaccccactttgcggagcctggttgagtgaaggggacaaatgagtaaatcctaagaaagtagttgattgcagtaagatttgtgctggggattcaacccatcagttcattagtgaacggaggcagaggtgatctagatagttggatggggaggcctccctggggagggaggtcacatttgagctgagacctggaggaagaaaaggagtcggggagggggtagttgagggtggacattgcaagtaaatgcaaacagcaagtgcaaaggccctgagatgggagcaggctcacttcagtcacagcaaagctgttgaaaatgggcacctaggaggcttcaaaattaaactcaataccaaaaggcagcagatggtgtcactgagtctttccccaaacaacagctgttgcctttgcaaggtatagggctgggcctgtgccttctctgtgcttctccaggctcttgcacaagttggtccacccagccagcatgccctttcctctccaattctcaaactcctatgcatccttcaaaacccactgcagattcccctcttacatgcagccttattcaaactcattcaattgtctccatgtggggactgtgctcccattcttccctttggcccaggcttgatctcccaggactgagggtacttgtctctagttctatctcccccaggttggaggattgggctgggaccagctgataggaaacccagttgaggcatgagcctgaaaaaactcttgaaatacagacatctgtgagtcattaactctgcctgagaagaaaccagggacagcttctcaaaggaggtggcattgcaccagggtcttgaaagattttctcagaatattagagctaaaggaatatatacatttttttattttggggt

SEQ ID NO: 12431 - DNA, 7855 bp, Human
tctggctaattctaaaatttttttttgtagagacggggtgtctcgccatgttgcccgcccaggctggtcttgaactcctggcctgagcgatcctcttgcctcggcctcccaaagtgctgggattacaggtgtgagccactctgcctggccccaaaactgctgtgcttctgagggacccctgtgctgcagcccccacccaagtcacagcagcagcacctacctgggggacaaaacgctgtggcagaggggccagagtctggcctgaccctattcactcttccttgggatcagaaaggagcatggggattgctttcctctgttctcctggccttgacacaggataacatgactaactttgtcagcaaagttccagtgttttggttaaattaatgaaatatacaggtggagtatcccaaatccaaacatctgaaatctaaaatactccaaaacctgaacctgagtgcggatgtaatgctaaaagggagtgctcactcatgcatttcagagttcagatgttcaaatttgggatgcttaaccagtaggtataatgcaaatattccaaaatctgaaaaaaccccaaacccgaaacacctgtgggtggtcccaagcatttcagataaagtattcccaaaccaggaaatgcaagccagcaaaatgtgccctatgtacttagtgatatcaacacaaaaggacacacagcatcgccattctggggagcagcaactcccacccacagcgacaggctgaggagatgtccgagcagcatgggacaagcttgttggagccctctagagcccacagaatggaggtagcagaggagtggccagtggattagggtggagagcacgagaaccacatgtcccagagacagccgagctgtgtactaaagagcagcggaggccagcctgtagcaggggagtgactggcagagcagaactcgcggagtgcacaggtgcgtttgggaaggggtggagtggagggtggtggcgggttggaaatgctctctgaggcatgctccacccagggacttctggtgccacattaatgaacatgactacatatgctcctacttcccagctgacttccatgcaaaacataactgctttgagaatgtgctcacgcctacccacgcctgctggcagcttcctcctgagaggaggctgaggcgagtcagagcaggccttgctttggtaggcgccagcacaggcagtctcatgccaggctctctgggttcgccaggctctggctgtctggtgcagcattagtctgctttggtctggcagcagcacaaccctgcccaaagcctgctaggtcactccctaatgaagtactggggaatgaaggccccttcacagaagtgcagtgtctcagagtctgagacataacatgttgggctggtgacaagaaagagcctgcccaggagttggcggcccagccgctgcccccacgcctgagttggagatgagccaggcccctggcgcctgcctctgcacgtgccactcctctctctcccactgagcggactcggtgcaccgccacctctacgtgcctcccctgtacccaggcctgactcccttcggccagggccctggccttcctgaacgcagcatcagcccatcctagtatcacaccagtgcccctcgcctccctgtgcgatgaggtagtcgaggccaggaggttttaccttgtttatttttgtatctccaggggtcagcacagaggtgcttctcctaccttaaccctcaaaatatggctacaatgaatgaacacatgaacaaatgattgatgagaagtcttcctgtcttgttctagaacacctgaaaataactggggcagcttaacttggagaagcaagaatttagggaggaggccgggtgtggtggtgggcgcctgtaatcccagatacttgggaggctgaggcaggagaatcgcttgagcccgggaggcggagcttgcagtgagctgagatcacaggagaatcacttgaacctgggaggcggaggttgcagtgagctgagatcgcaccacagcactccagcctgggcgacagagtgagactctgtctggaagaaaaaaaaaaaaaaaaaaaaaaaaaaagaattcagagagggaacacatttttaatcttcaaatacttttcttttttttttttttttttttttttatgagacggagtctcactctgtcgcccaggctggagtgcagtgacgtggtctcaactcactgcaacctctgcctcctgtgttcaggcgattctcccgcctcagcctcccaagtagctgggactacaagcacgtgccaacacacccggctaatttttgtatttttagtagagacggggtttcactatgttggccaagctgctctcgaactcctgacctcgtgatctgcccgcctcggcctcccaaagtgctgggattacaggcgtgagccactgtgcccggccttgtttttgtttgtgagatagagtcttgctctgtcgcccaggctggagtccagtggcgtggtctcagctcactccgacctccacctcccaggttcaagtgattctcctgcctcagcctcttgagtagctggaattacaggcactgccactatgcctggctaattattattttttgtatttttagcagagacggggtttcaccaggttggctaggctggtctcgattcctgacctcaagtgatcttcctgcctcagcttcccaaagtgctgggattacaggcatgagccgccgcgcctggccattgagtcttgaatagttaaaacttccaagaggaggagactgccagggtggtaaggaggcccatgtgcacgcggagcagcagaagcagccgaagcagctgaactccccccacaggtcctgggggcgggctgtgagcgtcccggcactgcaggtgcccgcagatgcaggcggggcacaggatgagccattggagacttccctcttgcttgagagatgggttctagaatgctgttttaaaataactcttagaggtgggttaagtgggtggaatatagatagagcaggaaactgcagaaggcactggctgggggaaagagtcccctcagagatgaggatgagttgagttttttctctgttcagtgaccgcgccccctgcccccgctccagcgaagccccctgtttatcaacccacttggtcagaagacatttcaccacagccagaaaccaggtatgaatgaatacccagggagctggaaacgcaaataagaacctcagaacttataagcaatcagccccatcactctaacaacaataacaacaacaaaataaatcaacaaagcttactgaaccaaagccaatggcaacaaagaatgctgaagtggcccccagattcccctggctccaccctcaggaccagctttccttcttctgtgagagacccgtgcaggccctttaaccagccggactccgctcggagggtctcgcctcggcctggtgctatgactgctgatgcctacacaactgcttcccctcctcactaaaccccagctcccatgctgccaccaagcggcaggttgctattctttcccggggttgaaatccaaatactacctgggctgtgtgactctctagtgtggatgcagattagggtggtaagccaaagggttgaactcccagttccacacccgatgggaaatgtcatctctacacagggtcagctacttcatgtccatcgcacgcaccaccaccacgtgcatggtctgcacctgacccaagctgaatgatggacatcacctgtgtaagcatcttgatgaagggaaaagctcactgggtgccagtcccatcccttccgtcctctgggcctcagtcttctctgtcaaacaggcaagactcaaaaggctcctggagacccaacaggccaggctataaagcaagacatgaccccagagcagccacctatctcatccttgggccagccggggcaggggcagctggggggacctcagtgacacttttgactgcaagccactgaaaatgtcttgtacttgctatgtatctcctgcttgcttcctatcattttttttttaaaaaacactaattgtgcactaagtgcctttgccaggcactattctaggtacttggaatagaggaaaagaaaaaggatgaagatcgctgccgcatggggctcacattctagtaagtgtggggagagtagccacaaagggcaacacaactgtgtaactcatgctgacgttggtgtgacaggggcagatggtgaaagggcagagttgggcacagaggcccgagtgcgctttttggtgtcacagccagggcaggcctcttagaggaggagggaggcagagagccttcagttggtctaagctcttaccccaagctcattgcttttacctgttctctaggaatatctgcaaaagctctggcccagggaggtggcagtacaggcctgtaaactcctaatagaaggtccagagtccagaactctccatcttagaaatgggaacaatttccttaccaagtctccactcgataggcaatgtcctctcctgagggccagggagcacgccattcaaggacttgactgcactggctaagccaggagagggaggaagagaagagggttagtgtgtgattttttttttttttttcggagacagggtctggctctgccatccaggctggagtgcagtggtgcaatcttggctcactgcaacctctgcctcctgggttcaagctattctcgtgtcttagcctcccaagtagctgggactccaggtgcatgccaccacgcccagctaatttttgtatttttagtagagatggggttttgccatgttggccaggctggtcttgaaatcctgacctcaagtgatccatccacttcagcctcccaaaatgctgggattattggtgtgagccactgtgcctggcctttaatggaacttttcaaggaaccattcaaaaatagttgttggggctgggtgaggtggctcacgcctgtagtcccagtactttgggaggctgaggtaggaggattgcctgagcccaggaattcaaaccagcctaggcaacagaacaagaccctgtctgtacgaaaaataaaattagctgggcacaagcctgtggtcccagctactcaggaggttgaggtgggaggatcacttgagcccaggaggtcaaggctgcactgagctgtgattgcgccactgtacttcagtctgggtgacagaacgaaaccctgtctcaaaaacaaaacgaaacaaaacaaacccaagacaaacaaaacaaacaaaaatagctgttgaactgtttcctttctcctcgactggcaatgacactgagttccttccactcatggaggagtcactccgggactccccgtgcactgtcagaacacctctaaggcaccatcttcacttcactcccttgaagagcaacaatctctcccgtctaaagggcccctgagctgcgtggcaaaccagcaatgaaagaaacaaaaaacctgcaacagagtcgtaaggtttcaactcttgagcacaagctctttctcattttgatgcccctctgagacggactggaagggacagtgcgtgggaaacacccctcttctgcccctgctctgcctggtgccacacccatggaaggggcaactgctctgcagacctgaaggtcagcacgaaggtcgcttactgggtaggggctgcctgacgcagcttccatagtgactataatttattcacaggcccatgtatggaggtttttcttctaaatatcattattctaagcatcatcatgggcacagtggctcacgcctgtaattccagtactttgggaggtcgaggcgggaggatcacgaggtcaggtgatcaagaccatcctggctaacacggcgaaaccccgtctctactaaaaaatagaaaaaattagccaggcgtggtggcaggtgcctgtagtcccaactactcgggaggctgaggcaggagaatggtgtgaagccgggagacggagcttgtagtgagccgagatcgcgccactgcactccagcctgagccacagcgtgagactctgtcttaaaaaaataaaaaaataaaataaaataaaatagaaatcattattgtctaggcttttggagaagcatatgctgtgaaaatgatcacggctgtgctcctaaaagccagtcatgtttctgtaacagttttctgcatggaccctcactttcagaaatgcaaaggtggcctgagagctgggcacctcacttacttgtaggagtatggttttggttcctctaatgtgcctgatgtagaagagagggaagtcggcactcaacgaagaggaacaccattgtcaggattaggagaatgctctgcttggcaggtaaatcaaaccagcagcacagccccactaggtgtctcacctcacttctgagagatttccaggtggttgatgagggaaaaatgcagtctcttttgattttcaatggtcgtagaatatcccttttcaaaattcattgtatgcagaataaaaatgtcacattctgagaatggagaatctatagaaagggcctggaaccttagtaatgaatgagttttcacattttaaccttggtaaagggaatactacccatgttgccatgaaaatcaagccaagatcaattagtaacatagtcttataaacataacgcacttgggtaactttctgtggatgaatactagtctctgagacacgcactccttatttgaccaagtaacacattaaaacgcagccactgcttatgacaagtgagcccctcaagaaaatacgagcataaagagtggccactgcatcagggcattccagaaactcatttttcttaaaggaatttaacttctagtactcaatgtgtccttgagaatgcaaaaatggaaaacaattcaaaatcagtcccagctacaaagataaggaagaggaagtccgctgtggcccagcctctgcttggcagggctctgctccacctctgcagaaattatgcacaggaacctgctgtgatgggtgtttctggggtaggaatcttttttttttttttttttttgagatgaagtcttgctctgttgcccaggtttgagcataatggcaagatctcggttcactgcaaccttcgcctcctgggttcaagcgattctcctgtctccgcctcccgagtagctgggattacaggtgtgcgccacatgcctggctaattttttttttatatttttgtagagacggggtttcaccatgttggccaggctggtctcgaactcctgaactcaggtgatccacccgcctcggcctcccaaattgttgggattacagacatgagcccctgcgcctggccttggggtaggaatcttaaggaagtcagtttcgtagtcatgaatttcatagaacagctcagaaacatctacccagaggaggaagtaatttatggcagaacatctccttggttttctgctcagcagaagggacagtgacagacaaggacagcaaagggggagagaagtctgtgtgtagatctccttaaagaggctcatgtgtgccgggcgcagtggctcacgcctgtaatcccagcactttgggaggccaaggcgggtggatcacgaggtcaggagatcgagaccatcctggctaacatggtgaaaccccgtctctactaaaaatacaaaaaaattagccaggcatggtggcgggtgcctgtagtcccagctactcaggaggctgaggcaggagaatggcaagaacccaggaggtggagcttgcagtgagccgagatcacgccactgcactccagcctgggcaacagagcaagactccgtctccggggaaacaaacaaacaaacaaaaaggctcatgtg

SEQ ID NO: 12432 - DNA, 19167 bp, Human
ggctcacacctgtaatcccagcactttgggaggccaaggcgggtggatcacgaggtcagaagatcgagaccatcctggctaacatggtgaaaccccgtctctactaaaaatacaaaaaattagccgggcgtggtggcgggcacctgtagtcccagctacttgggaggctgagacaggagaatggtgtgaacccgggaggtggagcttgcagtgagccaagatagagagacactgtctcaaaaaaaaaaaaaaaaaaaaaaagaaactaaggttcacagcttaactggaggtcatgtcttctcaaagtgctctgccacaaacttcctcatttgtgaaatttggaaaataatatcctctacttgtccacaaatagcatctaatcatacataagcatgtgagagctctttaaaaatgcaaggtattaattattattggtttttattttaaatgtggttatacatgttgagatttaaaagatttcctcccggccaggcgcagtggctcacgcctgtaatcccagcactttgggaggctgtaggtgggcggaccacgaggtcaggagatcgagaccatcctggctaacacggtgaaaccccgtctctactaaaaatacaaaaaaattagccatgcttggtggcaggtgcctgtagtcccagctactcaggaggctgaggcaggagaatggcgtgaacccagggggcggagcttgcagtgagccgagatcgcaccactgcactccagcctgggagacaaagacagactcagtctcaaaaaaaaaaaaaaaaaaagatttcctcccatgaagtaagccagaataaactcatacctactaaattctttctaaaatcttttctaaattgacactcttgagaaagaatagagcttggaggaagagctattattataattaatagcacaataatcagtttgtcattaaaccacttaggtctctttgtaacaagatttctaagctttagtagatggattccttattctattctattttatattgttttgttttgttttattttattttatttttcgagacagtctagctgtgtcacccaggctgaagtgcagtagtgcgatctcggctcaccgcaacctctgcctcctgaattgaagtgattctcattccttagccgaccaagtagctgggaccacaggtgtgtgccaccatgcccagctaattttttgtatttttagtagagacgggatttcaccatcttggccagggtggcctcaagtgatctgcccgcctcagcttcccaaagtgctgaggttacacgcatgagccaccgtgcccagccacttattttatttcattttttaaatttattattattattattattttgagactgagtcttgctcagtcgcccaggcaggaatgcagtggtgtgatctcggctcactgcaaccttcatcccctgagttcaagtaattctcctgcctcagcctcctgagtagctgggaccacaggcaggtaccaccacacctggctaatttttgttattttagtagagatggggtttcgctatgttggccaggctggtcttgaactcctgacctcgtgatctgcctgccttggcctcccaaaatgctgggattaaaggcatcctgttactaatttcacaggattttagaaacgcaagcagcgttgtggagtcaatgggggagggcaaagaacaggaggagagatctgtgagaacgggatcggcgaggaggcgacggggaggaggcgacgcggaggggtgaggggtcctctccgccgccaggcggagttgggagccggacgatcccgcacgcagcgcgaggcgggaccccggactgactacatttcccagtctccgtcgctccgcgcggcccaccccttcggctctgggccccgcctcgtggtgccggctggttcttcgcgctcgcccgacttcccagcggccccgtgcggcccgggcatgcccagtgcgggcgcagcggccccggccctggaagcgccccggcggagctggcccgcggtgggctaggggcagggccggagccgcggcggcggagctgtgggtaggtgcgggctcagccgagctaggcctcggggccgccgcgcccgcccattctgagtggcagggaccgggagggcaggcagggcccgagcgtgggttggtggggctaccggcgaggaccccttatgggaaggggccggagggagcgggacggggccgggcacatccccgggcgaggctgccccaggtgcggcgcagctatctttagctccctgtgtgacccggagcgtgcgtgatccgcacctcgcgtgatccgtacctcgtgcacagttgtgcctagggagaccagttttctgccgaattgcctaggagctgtggggagatgggcctgaatggacccgtggactcagaggcagcccgtggagccccgtgggaagtgaggatgtttaccttccctgtacctggagtgggctacgacagcttcctgtttgccgagacttgggtttagtgacttagaaataaaagtgtgtctcagcagatgcttattagcttctaatgactgttgggaatttaatggcatttgtatttccaggtttgagaggttatttgtccatgggatgctcgtgttaaaacaaaaatcttcattgcaaagcttaagtaaaaacaagtctcgaccgaggtaacgttagaacaccgggttctgaggttcactgtagctgccattcatttgctgtcagtctgggcaagtcatttaacttctgagactgggttctctcacctgttaaatgagccagatgcatcttcatctgtctagctcagctgtaggattccccctgtgtcattcagtctgtgtgtgtgttctcaaattgtggcaggttatttttccccatgcctcagctatttgtcagactgggtaattcaccaaatattcctgtaggaaggatgttaggatctaagtataaaagtgaagtgatttatccttcataggtcactcttaggaggtgtcctgccacttggtacatgcagaaaccaggtgttagctggccagggatcaaatgacacagctgttgtggactgagacagaatgtttcaggttccctgtcagttccctgtgagaaatccaggccaagtaatgggcttccttaaacctccaagctggctcactttggtggggttgtgtttatatagaattttaagtttttttcatgctgttgtgccctattagatgcaagaaacctatgaagaagtttagtacccttaatttatagatgagccagtggcaggttacgggagtggatctgtgagtctttacaaactagtgtcgtgcatatcactgagcctttgctagttatctagctcagctgccctcacctcaaccctgagaacatgtctgtatggctgtacctacgcgactggaactctgaggtgtttgttttcaggaggaaacagtgggagtattaacagaagtttcttaccctagagacttctatccgaagtgagcctatctgtgtaggatttgacctaaggagcagagggtatatacaatgttgggcaaattgccttcctactgccatatcccctgctcttccagttctgaatggcattagtccagttgggtcaatgaggagcagtttggtgaagtggttaaaggtcggggaaagtgtgcttatattttgaaatttaaggtttgtacaagctgcttgtgaaattctgtctttgtattatggtcatacctcttaaactgagaatactgcaacttgattgagtgagtgttgagaactttagaatatcaggttcttaaaaaatgcctgaaagtgggttttctattcatcttagaagtcaccacagattaaatgagagaatagtatattaattacaagtatttctcacatgaactctcaagttcttaatttttgaaactagatatcccattcacctgagaaataaaatgggaaagccttactgttttaaagactgtttatacatatgaacttttttgaggcctagtttaaaatccactatttattgcatgtttattaaaattgtatctgtatatatttaaagttagaaaacagaaaagaccagccgggcgtggtggctcatgcctgtaatcctagcactttgggaggctgagatggatggatcacctgagatcaggagtttgagatcagcctggccaacatggcgaaaccccatctctactaaaaatacacaaaattagctgggcgtggtggcgggttcctgtaatctcagctactcgggaggctgaggcaagagaatcacttgaacctgggaggtggaggttgcagtgagccgagcccagtgttgcactccagcctgggcaacaagagcgagactctgtctcaaaaaataaaataaaataaaaaagacctatttggaggttttggtacgcaatttcatgtcataccttaaactttactgtgcccgagggctctgtatgactgaagcatgtatttagtaatttttgtaagaacttttatcttgctcttgtattttcattcaagtatttgaaggtatccagcaaacataaaaattgcttaagaagatattgaaatgtaattatcttccatctccaaaccctcaaaagtgcttagaatgtgtaggagggatagttaggggcattgaggctcagaggaggttactggtcaagagcacattgtaaaaatgtaaaatgtaaaaatgagagggtgtaaaatgtaaaaccccttgtaaaaatgaaagggtggtgagtgttttagaaaaaaaatagggattttaggtttcagctgtacaggaatagcttcacttgattcactctattagtgctagaatctactgctatcttactagagctacaagtatgtgaggtcatcatgtggaaatgtgcatgaagtaacttatctttaaaataaatatttgcctccattatgttccatctgtttccagatccttcatgatgagagatttggggacacttctctctcctgtgtgtagttgatagtttggtggtgaagagatggctgacagtgtcaaaacctttctccaggaccttgccagagtgagtacatcttgtttataggaattcatctctcggccttttttttttttgctgaaggaaccatctaggaaatcctttagggtttttggaacttttatcatatttcttgggttctttacataaaggttgttattctagaccacactactcaagaaataggtattgttctacatcttgcagacagtcttgcaggtgcttggaagacctcttcggtggatgtctccagtattgggaccctaatcatcttggcttcagagctttttttttttttttttttaactttttattttggaatgtgtttagatttacagaaaagttataaggtagtacagagagttcctgtatgtccttcatcagcttcccttaatgttaacatataaccgtggtatatttgtcaactaagaaatgaacattggttcagtactatcacctaaactaattaattcagatttaaattagagaacctatcttttttttttcccaatttttcatttatttaaaaatttttctgttaaaagtagagacgaagttttggcatgttgcccaggctggtctcaaactcctgggctcaagtgatccacccgccttgtcctcccaaagtgccgggattataggagtgagccactgcacctgccagaaccttttttctccccattctacaagctgtgcacgtgaggaggatactctaggaaaatgccctataaagatctggttaggacccagtcatccaaattaccaatagcacaaaagtctgctacttttaatgtatgtctgaagcctaataatgtctcacttgtaaccccctcttatatttccactagcatgaaagaggccaattcttggagtggggaggttctttctttagtggaagagtttaaaaggttacctttatggccaggggaggtggctcacagctgtaatctcagcactttgggagaccaaggaggcaggattgcttgagtctgggagtatgaagcagtagtgaactatgatggtaccagtgcactatagcagggcaagaaagtaaaaaggttattacttttgagtaaaagagggaggattgaaagagtatcttagaaggtctaaaaagactttatgcatatgatctccttttttttttttttttttttttgacagagtctcactgtgtcgcccaggctggagggcagtggtgcaatctcggctcactgcaacctccacttcttgggttccagtgattctcctgcctcaacctcccaggtagctgggattacaagcacacaccaccacgcctggctaatttttatatttttagtagagacggagtttcaccatgttggccaggctggtcttgaactcctgacctcaggtgatctgcccaccttagcctcccaaagtgctaggattacaggcatgagccaccgtgcccagcagcatatgatctacttttaacatctttaccttgttgtcttgccattcatgtgctgtaaaatttcaaccctcccagcctggctaacacagcaaaaccccctctctactaaaaatacaaaaaagatttagccaggcgtggtgcacatgcctataatcccagctactcaggaggctgaggcaggagaatcgtttgaacctgggaggtagaggttgcaatgagccaagatcatgccactgcactccagcctgggcgacagagtaagactctgtttaaaaaaaaaaaaaaattcaaccctgtgttggttctacagtgtgctatttacatgtttgtctgccccactggactgtagatgtcttagaggtggggatcctatcatcctagcatgtactaggccctcagccatttgaacttaactatcttagatagttggagtttcctgagttaaaagcaaaattaagagtaaaaattactcagacaaaaaaagatcaaaggcacactgtgccaatttatgttcctgttaacagataatacatcaacttgcccatttctctgtattccagctattatttctaaaattcgttttgtctgataacagtagacgagaatgctatccattcttaaatccagcttggccattgcttccagaataattttttctgccttctcatgaagttgaatgccccagtgctaacactctacttgggccatacatctgttgtggcacttactaaactatgtgtgcttgcttctgcagcacatgtactaaaattggaacaatacagagattaccatggctcctgtgcatgacacacaaattcatgaaatgtttcatatttaaaaacttttttaaaaaaaaacctttaatgtaattttttggtttacttgtgtgcttttcctactaagttataagcttcttgagcatttctatatgacaatatatagcttattgaagatactcagtacgtgggtgggagatggatgcatgagtgaattcttagcctttgggaggcttaggcaggaggattgcttgaggacaggagtatgaaaccagcctgatcaacatggtgagatccccatcgctacagaagaaaaatttaaaagccaggtgtggtggtgcacatctgtactcatagctctttgggaggctgaggcaggaggatcatttgaacccaggagttggaggctgcagtgagctatgattgagtcactgcactgtagcttgggtgacaaagcaagaccctgtctcaaataataataataataatgatagccttttctatagggaatcaaagactccatctggggtatttgtaccatctcaaagctagatgctcgaatccagcaaaagagagaggagcagcgtcgaagaagggcaagtagtgtcttggcacagagaagagcccagagtatagagcggaagcaagagaggtaaggagtgcatgcctgatatcaaaatgtccaagggagggaagaccttacatagtgacttgatgtttcagtgccattttatttcttttgtgctttttcccagaaaaatgttgcaagtgatttccccccaacaacattgacttaaactagggtctaacaataatccttgctaaaaatgtcatggtgttaaatcagaaagctgaatagagaatcgcaaaatattatttggtttgatagatacttctagggaagcctgtgtggatttatgtattaatagaagaaccctggccccacactttctcttaatcttttccatcatcagactttagaaaataaattatttttcttttaaaagctggttccatatatatacacattttttttttttttttgagacggattcttgccctgtcaccaagctgtcacctgagattgccgtggtgcaatctcagcttactgcagcctctgcctcccaggtccaagcaattcttctgcctcagcgaaccggctggctggaagtacaggtgcgcaccaccacgcctggctaattttttatattctttagtggagacagggttttgccatgttggccaggctggtctcgaactcctgacctcagttgatcgcctaccacggcctcccaaagtgttaggattacagccgtgagccactgcgcttgaccatttttttagtcttttctcattgactgacattagaacattgggagaacatgaggcactgaaaaataatacagtacccacaaaagataagatataaaatgaactactgaatgacaattaggaaataacttatgctttataaactaaatacatgtgatcttttccagtgagccacgtattgttagtagaattttccagtgttgtgcttggaatggtggagtgttctgggtaagttctttaaattccaggtgccttataagcatcttcagattgttgctgggttgatagctatgaactgttttcttgaaacactgagacaaatagttttcatctgctgatgtacacttagaaatataactcaggagtctgtgcatctgcagagattttattcccactcaggaaagcacacttatatgtaagcaaacgtcacagccctgaatatacacttgaattttgtttctaaaatgactcattcacaagtattagaggtagcagtttctcttgacactgtctagacattttaaaatgctaacagcaactatggggactcgggaagggcagatacggctagacaagaacaaggttctccctgcttctgcttatagtgatcaacaagagttaatttgcattgaaacctatagcagaaaagattgcctaccgtttactgagaatcccagtgcaggcttaactgaaatttgggtactttgaagaatggataaatatttcctttgacttagaatttagagtaattcatcacttcttaatctaaacaattcacagatgttttcagatgttagttttaaatttaattaatatgtattcctgtgtacttagtacatgcctgtattttggcctgaatactacttgaaatgttcctgtatgcccccaaaagtttcattgttttataggcaatatcaagtttgtatctctcaattggagtgttgggaaatagaaatggatccagttttggtgctttttcaggcctcctgatttattttatttatttatttatgtatttatttgagatggaggctcgctctgttgctcaggctggagtgcagtggcatgatcttggctcactgcaacctctgcctcccgggttcaagcgattctcctgcctcagccttcccagtagctgggattacaggcatgcaccaccacacccgaccaattgttgtatttttagtagagacggggtttcaccatcttggccaggctggtctcgaactcctgacctcaagtgatctgcctgccttggcctctcaaagtgaaccaccgcgcatgagccaccgcgcccggcctaggcctcctgatttataaaagtcactcccatctataaaatcattacactaaaaattgaagctcctgttttaaagactggattttgatgtttgccttgttgcttcttttctttagttcagtctcctcttgttttatcgagtatttattcctgtgcttcagtcggtaacagcccgaattatcggtaagtgtataccctgctccttgtctgttggggacagagtgggagatgatgtttcagtctccctcagtttactgaacatttcctgtgtaccaggagctttcactgtttattttcttttttgttgttttattctttttaaaaatttatatttcgttattctcctagaggccctttaagaatgggtactgttgttctatccattttatgaatgaggaaatgcaagttaccaaggttaaaccattagtaagaggcaaagctgagatttaaacccagatggtatcctgcagatagcgtactggtaatcactgtggcatctcgttaccatcatgtaagcaggtttgtgtcaagcagcacatatctatggtttctttgaattggaattgtggccagaatgtggtgcgtctattatgagttagactctttgagataggtatagtgatgtgctggcaagaactagaaagatccaggaggagacagagaatagtcacgagatgggggttccgcatttggtcttctggatttccatttctccatttctagtaactcgtttcctctttcttaggtgacccatcactacatggagatgtttggtcgtggctggaattcttcctcacgtcaattttcagtgctctttgggtgctccccttgtttgtgcttagcaaagtggtgaatgccatttggtttcaggtaggtccagggcagaatggagtctgggtcccgcagcatgattggctgacaggtgacaagtttcagcctgtgaagttagtgggcatgtagggggacctgtttttcagccttaatgtttcttggccaggtagccagtagctgatctttgtgttcttacagaatggaattattgtctcagcatctcattggcaggtgtctggtgccttttctttttcgttttggcttttttttttttttttttttttttgagacagtctcactctgtcgcccaggctggagtgcactgcaacctttgcctcccgggttcaagcaattctcctgcttcagccttccaagtagctgggactacaggcacgtgccaccatgcctggctaattttttttgtatttttattagtgacagggtttcaccatgttggccaggctggtctcaaactcctgacctgctgatctgcctgcctcggcctcccaaagtgctgggattataggcgtgagccacggcataaggcagcaatcctcctaccttagcctcctgagtagctgggactataggcacatgccatcgtgcccagcttatttttaaataagccttttcttaactggcagctctagtggcggactagtggccttagctttggggatgtatatcaaggccatttaattcatgttttggtacactttctctgttacaggatatagctgacctggcatttgaggtatcagggaggaagcctcacccattccctagtgtcagcaaaataattgctgacatgctcttcaaccttttgctgcaggctcttttcctcattcaggtgagactgaccttctgggcatatgggcagctttattaaaaagaaaaactgtttcactagagagaacttcacaaagacagagtattatatttatacagagtattatatatatgctggtgggaggtaatgatttttaaatctttttttccccacggaaatgagaattttaaaattacattataaaattataagaaacatgaatttacctgcttttttctgctactctggttattctccagtcctgccaggtggaaactttttttctttttatagttatgcctaatttttttttttttttaaagagacagacgggtcggctgggcgcagtagttcatgcctgtgatcccagcactttgggaggccgaggtgggcggatcacctaaggtcaggcatttgagaccagcctggccaacatggtgaaaccccatctctactaaaaatacaaaaattagctgcgcgtggtggcaacatgcttgtaatcccagctactcgggaagctgaggcaggagaatcgcttgaacccaggaggcagagattgtagtgagccgagatcgcgccattgcactccagcctgggcgacaagagcaaaactgtctcaaaaataaataaataaataaaagacagggtcttattttgccacctaggctggagtacagtggcacaatcatacctcactgcagcctcaaactctgggctcaagcaatcctcctgccttagcctcctgagtagctgggactacaggcacatgccatcatgctcattttaaaaatcttgttgtagagacagggtctcagtatgttgcccagtctggtctttaactcttggcctcaagagatcctcccgcctcatcctcccaaactgttgggattacaggaatgagtcactgtgcccaccctgcactcggccttttagaaacttgagaagcagctaggaagctatctcagacagtgattggagagtgacaggtgaatggtgctaggtttccgaggctttgggattaagattttccatatttgttcttcagggaatgtttgtgagtctctttcccatccatcttgtcggtcagctggttagtctcctgcatatgtcccttctctactcactgtactgctttgaatatcgttggttcaataaaggtaagtccatctaaagaaatccagaaaatggaggcccagtttggaaatgctactgctaagcagacttcttaaactactcatagtcaggcttttggcaaacaatcctttgagggaagcagcctcattggcaagagggagcttaccttcggcttagtgggtttaactctcaactttgaggctgggggatgtggtagtatggcattatctttttggtgcttaacatggtatatctctgactgggttgtaagatggcataaatgagcatgagttgctctaaattagagaagtcaaattgatgtcagcatctggatccttttgggggtgttttagaaagaccttcagatatttaccagggtgtgcgtggttgaaagaggttaactgatacttacaggatggcatccttttgatttgctatcttgcttagttccagactaatcctgacaaaggatgctggtgctgaaattcttaattcacttagcctgtcagctttgaaattacgattatagaattctaagaaactttgcatgctttatatcagatttgtacacttctaatttatatgctgtagctctgttctaaatctgtacctaggctgggtgtggtggctcacacctgtaatcccaacactttgggaggccaaggtgggtggatcgcctgaggtcaggagttcaagaccagcttggccaatatggtgaaaccctgtctctactaaaaatacaaaaattagctgggcgaggtggcaggcgcctgtaatcccagctacttgggaggctgaggtgggagaatcgcttgaaaccaggaggtggaggttgcagtgagctgagattgcaccaccgcactcccgcctgggcatcaaagcaagactccatctcaaataataataataataataataataataataataaaatctgtacctaaaactcatggtttgtctaccatagttacttagtcacttgactaaaaggaaatataatatctaattgtattggctttcttgttttaggaattgaaatgcaccagcggttgtctaacatagaaaggaattggccttactactttgggtttggtttgcccttggcttttctcacagcaatgcagtcctcatatattatcaggtaatttggctacagggatttgaaggagactagtaaaaataaaaattcatgaagtcagtgccttttgtttgcttcgttctgtttcgcattctacatcatcatttgtccatcaggagacctgcagggtatttctacatttgttagcatgaagatctagtctgaatgtccctatatcccatattctttttctatgttgcctcctgaagcaattattctttttttttttttttttttttttttttttgagacagagtctcactctgtcgcccaggctagagtgcagtggtgtaatctcagctcactgcaacctccgcctcctgggtttaactgattctcctgcctcagcctcccaagtagctgggattacaggcgcccaccatcacgcctagctaatttttgtgtttttagtagagatggggtttcactatgttggccaggctggtcttgaactcctgacatcgagtgatccacccaccttggcctcccaaagtgctcagattatagacatgagctaccatgcccagccctgcagcaatgttaaacatgcccagtgcttagaaaaatcttctgttctttttgaaagatgtgtttgatgggctgggtgccacggctcacgcctgtaattccagcactttgggaggctgaggtgggcagattacctgaggtcaggagttcgagaccagcctggccaacatggtgaaatcccatctctactgaaaatacaaaaattagccaggcgtggtggcacacacctgtaatcccagctacttgggaggctgaggcaggagaatcgcttgaacacaggaggcggaggttgcggtgagttgagatcttgccactgtactccagcctgggcgacaagaacgcgactccatctcaaaaaaaaaaatgtttgaaatattgaggtttcatcaagccataatgtttacactggaagcaaaagaacttggagcttctaatatcttcttcaaagtcatgtctgttatgaaggtgactaattatttcttttttttttttttaaacagtggctgccttttctctatcctctttcctttattcattatcagcgccaatgaagcaaagacccctggcaaagcatagtaagtattagccagtgatgaaatttttgctgtgtaaagggttggggctgtaacaccagttatgtcagtgaggctttttaaaaaaaaaaattcttactgtaggaaaatcttaatataaggtttaatgagagagaaacacttctgggatataacccaaacttttctccatgcatatatgcacatgagtatatatatatttccaaaaccgatcccattatacatattcaagtagagggctgtatgacctggccacatgagtttattgataacagtagtaaaatatactttaaaatgagtttttagcaataataatagcattctaaaagttttattacttcaaagaaaagctcaattcatctttgatcaattttggttaagtcagtgtggatacttgtattagagacttaggtctgctttgggtttttgtatgctcttgctatacagcacagctcactgtttatcttaagaggaatatttgactttcttttgaaactcttcttcctgcaaccacagatagcatatgataccttcagacatagcttgaagtctgtaccccgaagtcagccatagaaaagtacttctcaaatcaaagttaatctaaaatataactatttcctgtaagagccacaatacttcaacgctggtgactgcattacattcatggcagcagcagggcccaatgcattctttttttttttgagacggagtctcgctctgtcacccaagctggagtgcagtggcgtgatctcggctcactgcaacctccgcctaccaggttcaagcgattctcctgcctcagcctcctgggtagctgggattgcaggcgcatgctaccatgccctgctaatttttttctcaagtgatccacctgcttcagcctcccaaagtgctgggattacaggtatgaggcaccacgcccggctccaatgtattctttagttgcctgttccatccatgtatctaatatctgtatttccttgatcaagtttcatttgtcttgtctttccctgtgtagttttaaatttaatgtcaagttgtcaaacaacggaaataattttgagtaactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtttcccacaaagtgtctaatggttgaatttgcaaatcttgatttcgagaaatgtattcatggaatataagactttgtcttggataatttagttacagttttgagaaattagccctgaaaaatgttccctgagaaagcctggattatatgattataatcacatttatatttggtagaagagtcagattattactttttctaaagtctatatgtatatcgctactgtatattcatgaagggagaaagaccctcctagatattggtgtattgagtattaatcgagggaagccgttaaacatctggttaacagagacctttactatgtgcaagataaaatatggaattaaaaattgttgctggggccaggcatggtaactgatggctgggattccagcactttggcaggggccaaggcaggaggatcacttgagtccaggagtgcgagaccagtctgggcaacatagtaaaaccccgtctctattaactataaaataggttaggccgggcatggtggctcatgcctgtaatcccagcactttgggaggctggggcaggtggatcacctgaggttgggagttcaagaccagcctggccagcatggtgaaatctcgtctctactaaaaatacaaaaaattagccgggcgtggtggcacacacctgtaatcccagctgctcagaaggctgaggcaggagaattgcttgaacccaggaggcagaggttgcagtgagccgagatcgtgccattgcactcaagcctgggcaagaagagcaaaactccatctcaaaaaaaaaaaaaggttaaaaaaaaattgttgctgagagttgtaaaccaagtttgaaggtttatgcggttgatggaaggagggtttttaaatggtaggcatcttggaagtgaacactttccagcttgggcagaaaaaattgtaaaagacatggtttaaagtaaggtttacttccaacattctcctatgacatctctggtcatttaacaatagtattgcagactacttccagattgctatgggtgtggtttgcagaagacttcagtatttcatcagcttgtaagtgataagtgattgccttatttaagcttagtttcttaaaactaagttttaaaagtaggcttagttatttaagcagtcacatctttgcttcctgaaatttatatttgtaccatttagaagcatctcataaactattgaaaaaaaaaatagaaacatctcagtttggtttaaaagggtgaaggagactgggcgtggtggctcaggcctgtaatcccagcactttgggaggctcgaggcaggtggatgatgaggtcaggaatccaagaccagcctggccaacatggtgaaaccctgtctctactaaaaatacaaaaattagctgggcatggtggtgtacacctctattcccagctactcgggaggctgaggcaggagaatcgcttgaacctgggaggtggaggttgcagtaagccacgatcgcaccactgcacaccagcctgggtgacagagtgagactctgttttgcgggggaaaaaaagggtgagggaagttgagtggatgaaggtatatgatttttatccccagcactgtgcctggctatagaaaatgtgtaaaggtttaaatgactggaagtgaggaatctccagagttttattagcacagttgagcagccaagccttttgtataaaggctagattaggcatatctgtgataagagaaatgtgaccatctcaaatgagttatatacacaaagcagtgtaaatttttcctgcctttcacgagggtattgtcactgagagcagtgattaggaaatgggtcaaaaagagactatatttttgccaagtgcagaatacctgtttgaggcagactaataattagtaaccaaaaacaagggagctcacaaaactaaaaatgaaaatttgtttgttttaatcacaaaaccagtaggatctgaggaattgttcccagaagcacttttcaagggatagacatcacagcttggac

SEQ ID NO: 12433 - DNA, 52523 bp, Human
  misc_feature (1)...(52523): n = A,T,C or G
tggtttctagtgtgactttctttgccacctcttatttatacctggcttcgctagtatttctttgcctgtgtggcattttcatctattctctttgttatgttgatatttaagtcccagaaaagagtgggtaggaaccagagtagctctcaaggtgacaggcaaatcttctaagtgaaaaaaaccatttttcacttttattaattaaagatttgcattgtttttgctgctttcttttcacagttcaaacagacaacaatatcagtgttactatagttatttattttttttgagatggagtctcgctctgtcaccaggctggagtgcagtggcgcaatcttggctcactgcaatctctgcctcctaggtttaagtgatcctcctgcctcagcctaccgagtagctaggattacagacgtgcaccaccatgccccgctgatttttgtatttttagtagagacggggtttcgccatgttggccaggctggtctcaaacttctgacctcaagtgatccgtccgcctcggcctctcaaagtgctggaattatagactgtgagccaccacgcctggcccaaatatgtgcatttaaagctacaaattttccttttacacagtgtcactgcattccacaaatttgatatgttgtattattatcttttatttcaaattattttatttttattattttttatttttgagacagagtcttgctctgtcgcccaggctggagtgcagtggctccatctcgggcactgcaacctccgcttcccggattcaagagatactcgtgtctgacctcaggtgatccacctgccttggcctcccaaagtgttgggattacaagtgtgagcctccgtgcccggcctcaacttatttttaaatttccattgatctcttctttgacctagagatttggaattatgttgcttaatttccaatatttccggaattttctggcttgtttgggttgatttctaattttaattctattgcggttagagatgatactctgatttcaatcctcttaaatttgaggctcacactgaggattaagtataaaaaaattttttttgatacctgtttcatggactcgcctcacaaacttctgttttaaggtggggtaattatagtgcgttcagggatggatttttcttctgctttggttatgcatagagtgcactgtggcccttcaacactatactctgaaatcccacacagtattttcctcatctggaggtcctataggcttacactagggaggaggatccagttcaggccagcgtagtcttcagctgcgccgtgggactttcgggggagcgcctttgccctctcagaacggctgggcggaacggtgggtttgtgagccctccaggctcagggtgggtcgctcaggggccatctggggactttgggaagcaatgaaagttgtaccctaggatttttttctactggtcttctcttcagaggcgagaaagccaagttaagaaaacccagactcagaaggaggtggagcgggactgcgttcaggcaaggtggcagaacgcctcgccgtggacgaagagagcacatctcttcttgcgaggcctaaggaagtagggctcccactcgcctcggcaacccaaggacccagccaaggagagagcctccagatgaatccttcctctcctccttccttcccagccgctcaaactttcacaaagaggaactgggtgcggtaaagaggccggacacggaaccgctcgtccggtgaccgaagagacggcgaggaggagcccgcgaacccgcctctgttcaggccccgcccactcgacgtaatttgcccgcccctctccaccctccgaagggtggagcctgaggccccgcctccaagcggcctctccccggagtgcctggcggccagcagggcggggcaggaggctgggagagggacgggtgccggggtgggggagaggaagggagcggtcacgtgtgaggggcggcccgaggtcacgtgacggagcgccggagcggagggagccggggctgggagttctcctgagggaagaggagtggagtaggggggacgcggcggcggtgttgacaatggtgagtgcgccgcggccagcgcgctcgcctcccgccctcgtcccggagcgcgaggcgggccggccaaccgcgggccgggccgtcgccggaggaggggacgggggagcagggcggggagcggggttaggcctgtcgggccacccctgggtctgggaaaagctggcggcgccacctcttcccggtctcggcgaggcccgagcacctacgggcggcggcgtgctctcctggccatgtcggagcctctgcccgcgttcttcgactgcttgttggggctctggctggggactcggaccccgcctctgcgggggctggtcgccgcctccccttcctaggtagccagtccctgttctcctcccgggcagcctctcttccatccaggtggggcgacccgggagccccccacctccggactcttcgggggacttgggcactcagtgtgtcacgaacttgataaactctgatattttaaaacctgactatggtgacattctttgatttcatgaccccagttcaggctttctgttgacacttgtaaaatgggagagaaaaataaaaggacgttggaatgggggatatctttaactccagagacacccgtttggtgcccgccgttttaagcattggctctcatttccgtccgcaagctatttctctgaacttaacgctctgggttgttgaaacggcctatgaggcagaggagggaggggaatcagtgctctcaccacagtccgcggaagcactagcctgggcattgtggtatttagctgggtgtcggcagtctctaggttagatctcattttacccattttctggtagtagtcgtcaattctcttcatttagcgcctactgtatgctctcctaatactacctgctcttcccaaagctcactgattcaatagactgcttgagacttttggcttaaaaggccgagccaggtatatttttaaaaagctactttgaataaataacttttaatttcagtaatgatgttgctttcaaaacaaaacaaaacaaaatccagacattcatgttcattcttagagcttttttctttcattcaacaaataattgctcaggtgtgcctaggggaccccagtaaaatggaaacagcgcctacctgctctcgtagcttacaatgtagggagagataaacatttatttgtgtaaattatttgtttaacgtggaaattagaattgtgacagatactaagaaggaagtattgggggaccttgcctagtcagtgttagggcaggcttctttaattgaatatcatttgaaaagaaaacttaaaaggtcctcctattttttgcttacatttgtaattattacttttaatacgcttttttgaattatgttcaagagcagtttatattttcaagttacccaaacagaaactaaattgtaaaactttaaaacactgaaatggtcacagatgtaatatatgtatgaaaatttgctgtttcattgcttgtgtatgggctaagtgaatgaattttgagagtcagccttccacctcagaaatgcaatgagttgcatttctttacatccactggacttagtgaaattccttcagtggggactaaaaagttgcctttttatgtatctaccatgtatttttgctaattggtaatgctcaatattgggttcagaaattatatgaaaaatcctaaattaacctaaagtcagtgataggaggtttaggccaagattagaaaactataaaaacaattgctagcatgtttttatagtcatatatattgcagtccagttatttaaaagctcaagagttttaacttgcatattaatagttaatcctgaaaatcgcaatattccaaatacgcccttgaagatatctttaccaaaagaagtgagtagtatttttgcacttaaaagatctcacggggtgcggtggctcacacctgtaatcccaacaatttgggaggccgaggtgggcggatcacctgaagtcgggagtttgagaccagcctggccaacatggcgaaaccccgtcttcactaaaaatacaaaaacaaaaaaaaattggccaagtgtggtggcgcattgctgtagtcccacctactcgggaggcggaagttgcctgaccaacatggtgaaactccgtctcaactaaaaataaaaaaattaggtgtggcgcacacctgtaatcccagctactcaggaggctgaggcaggagaatcaattgaacccgggaggcagaggttgcagtgagccgagatcgcgctgctgtactccagcctggcgacagagtgagactccgtctcaaaaaaaaaaaaaaaaaatctcaaaactgaattgctgtctgcatcatatcctaaccctcaacaaattttattctctttccttctagtctttaccagcttgacagttgtgtattttacttcctctttaacatatcagaagtattagaattttatttagaataattagaaaaagaatttaatttcattaccctttatttcaaatgacagaagttgcacatcttagaaaaaactttgaaagagagactttgggtagagatctttctctttcagttctttctaaaagacaagcttttttcctcagtatttttttctttttgttctctacctgtaaaatgtaagatatccacaattttctggaggtgttttttagtaagactagttcttttattattattattattttttgagacggagtctcgctctgtcgcccaggctggagtgcagtggcgcgatcttggctcactgcaacttccgcctcctgagtagctgggactacaggaatgcgccaccacacccggccaattttttttttttttttttttttttgtatttttagtggagannnnnnnnnnnnnnnnnnnnatgtaaaaaactgaatgttggtcgggcgtggtgcactttgggaggccgaggcgggcggatcacgaggtcaggagatcaagagcatcctggctaacacggtgaaaccccgtctccactaaaaatacgaaaaattagccaggcgcggtggcgggcacctgtagtcccagctactcgggaggctgaggcaggagaatggcatgaacccgggaggcggagcttgcagtgagccgagctagcgccactgcactccggcctgggcgaaagagcgagactccatctcaaaaaaaaaaaaaacctgaatgttaacccaatgccatattgtcatggaataactggttaaagtgcagtaatttattactcaacctattacttttttgcatatgctatactaggctttttaaaaatgccatttgattgcttccaattttagtgttttgattgtatttaaaaatatcttttttttttttttttttttttgagacaagctcttgctctgccgcccagtcagtggcttactgcagcctcgacctcctgggttcagcctcccaagtagctgggactgcaggcacacaccactatgctgggctaattttttaaatttttgtagatatgggggtctagctgtattgacgaagctggtcttgaacttctgggctcaagtgatcctcctgcttcagcttcccaaagtgctaggattacaggtgtgagccactgtgttctgctactttttttaaaattatgaaatatttcttgcatccagaaaataatagaggatagcacgtagtttttcacatatttttaatggttaggaatttaaatatttaaggaatggtgtcaaaacactgtttatcattatggtgttaattgtgaaattttataaaatgaacttggtttataccattttaattggtggcaattttagttctatcaaaattttatttaactttgggatttgattttttttttttttttttgaggcagaatctcactctgtcgcccaggctggagtgcagtggcaagatctcggctcactgcaacttctgcctcctgggttcaagcgattctgctgcctcagcctcccgcatagctgggactacaagtgcatgccaccacgtctggcaaatttgttctgtttttgtagagatggggtttcaccgtgttagtcaggatggtctcgatctcctgaccttgtgatcctcctgcttcggcctcccaaactgctgggattacacgcgtgagccaccgcgcctggcgatttgatcttttaatgtcagctttcaaatcccaagtggaactctgtgtgtttaggtatatgcatgtggaaaaaagttataatatttccttttctctgtaaaacaatttttatagttttcaaatctcatttttcttttaagtagctctgggaagtgtcaggaggaatgagaaaattaattttaaggccaagcaaggtggctcacgcctgtaatcccagcattttgggaggctgaggcgggtggatcacttgagcccaggagtttgcgcctggcctgggcaatgtggcagaaaccctgtctctacaaaaaatataaaaacgagccaggtgttgtggctcacgcctgtagtcccagctacttgggaggcttgaggtgggaggcttgcttgagcccatgaggcagaagttgcagtcagctgagatcataccactgcactccagcctgggtgacagagtgagactctgtctcaaaaaaaaaaaaaaaaaaaaagaattaattttaatttttctatctctgttttataactcaaatgagttataaatgtggatgtcataaggaaggagagctcattcttattgctctctctgccaattagcattatccttcaatataactgattttgttttccatctaaaatagactgctacttgaagatgttgtcttctaccctttcatgattgctcctcccacacaacccctgtaccctgctagctcagcacatattcgattagtaaatgtgagctgcatgattttaagctgctatacattctcatttctgtagcccttagaggaaatgtactacagtatttcagaatttaccattttgagtttaagacttggagtacgaaagccacctaggaatggacagtgtgtgtgacctatcactgatgattttcattctcttttttctaaattagttcagaatagttttctgattaaaattagttttctggttaaaattcgagtttgttatttgtaattttgccagaaaagattaaaacgtgtcaaaaagaaaaaaaaattttttttttttttaaacagagtctcactctgtcccgagggctggagtgcagtggcgcgatctcggctcactgcaacctccacctcctgggtgcaagtgattctcctgcctcaggtgcataccactacgcccagttaattttttgtatgtttagtagagacggggtttcaccgtgttagccaggctggtctcgaactcctgaccttgtgattcgcccaccttggcctcccaaagtgctgggattacaggtgtgagctaccgcgcctggcccaaaaagaaaatttgctacatatgtcaaaagtactaatctggtaattcttttagttggttgcttaaaattataatcccttttgttaatacaggatttaggaaaacatctcatttgagtatagcatcaccttgtgccctacatagccacaaagcaagctaacagaaagcaaactaatgactctcctaagtgaggacagaactgaggtttaatataaattccattgatatagtttgctactataccaatgctaatttgctcagaaaggctaatattattgactattccagatttcagttaatttctcttgtatatttgtttattttctgttattaaaatggtatgtgtttgttcaaaattaacattcaataggtattttaatgccttctgctaaatgccatacgctgccttagatgagcctcatggagtttacagttcagtaggagagtcaggtactaagtaagccttgtgaaacctaaatttggagaatccagttttgattaggaagtcaaggaaggtctcatggagagggagtcaaactgaaactcaaagggtgaattaggttaagaatactttgcttggctctaagacaagaaggacactagcaaattggaactgttgaagaaagagctctgaacgttggaggctgagtagttggagagatgactagtgtcagatatatgtagaccacattagagaatacattgtgtgtgtgtctgtttttaaaatcacaactgaagtaaaataactatgaaaaagtacacgaataggtgtatagcttgatgaattttcaccaagtgaaatacctctgtatcaaatgctcagttataaaaaaaacagccagaacattactagcagccagaagctccctttgtgctttctttcagtcactgcctgacctgtaataccataatgtaccttacatggtttttgcttactatgtgagtggagttatacgtacgttttgtgtattccttttgtgtctggcctctttcactcaacattatgtgtatgagattcattcttgtgtgtagttgtatctcctctaattctattgctgtttggtgttcccatttgtatgaatatatactaaattgcatatatccattctcttgttgattgatacttggattgtttctatttggggctattatgaataacacttgtgaacattttttttctggagacaaattcttgctctgttgcccgggctagagcgcagtggtgcgatcttggctcactgcaacctctgccttctgggtccaggtgattctcctgcctcagcctcccgagtagctgggactgcaggcatgcaccaccatgcccgactaatttttgtattaaagacggggcttcaccatgttggccaggcttgtcccgaactgctgacctcaagtgatctgcctgccttggtctctgaaagtgctgggattacaagtgtgagccagcgcgcccagccagatatgttttttaaagatcattcagagccaggtgcagtggctcacgcccataatcccaacactttgggaggccgaggcaggaggattgcttgagcccaggagtttgagaccagcctgggcaacagagtgagaccctgtctctacaaaaatttttttaaaaaagatcattctgggccgggcgcggtggctcatgcctgtaatcccagcactttgggaggccaaggcgagtggatcacgaggtcaggagatcgagaccgtcctggctaacatagtgaaaccctgtctctactaaaaatacaaaaattagctgggtgtggttgcagatggctgtagttccagctacttgggaggctgaggcaggagaatggtgtgaacccgggaggcggagcttgtagtgagccaagattgcaccactgcccttcagcctgggcaacagagcaagactctgtctcaaaaaaaaaatcattctggttgttatgtaggacagaatatgaagggatgtaggatgacatgataggagactgttctctgtgtaaacttaaaaagattagaagactaaatttcattgtggctaaaataatccataactatatccagtatcaaaattgctaatggattctgtattattaccaactgatgtgttttggcattgataagcaattgattttgtcccttatatttgtcatcttcaggatttatagaacaaggcttgtagattttctttggaaaaattcacagaaattttattttccttcattatagccagttttactacaagggctttcacagtgtaacatatcctgttcagaccaaatatagcagtagattttacagtaagtagtgcattatagtagtacatttggatttgtgtgagtactttgaattgtgtaaattctgctataataaaagaacctcataaataaaagtataaataaaggtaatttttcaagcctagctgttaagaattaacttcttagatttctgacatatgttaatatttgattatagtggttttgtatggaaatgattgaaattatagcatgctgaaatttgtttagggttttttttttggtctttttggtggttaaaaacacataacatgaaatctaccctcttaacattgtacttaagttgttcagttttgatgtagtttttttttttttttctttctttcttttttgagacggagttttgctcttgttgcctaggctggagtgcaatggcgcgatcttggctcactgcaacttctgcctcctggattcaagtgattcccctgtctcagcctcccgagtagctggtatcacaggcgcatgccaccacgcccggctaatttttgtgtttttagtagagacagggtttcatcatattggtcaggctggtcttgaactcctgacctcaggtgatccgcccacctcagcctcccaaagtgctgggtttacaggcgtgagacaccatgcccggcctttgatgtagcatttgatatatgtttttatcatttccttatgaactcacagatttgcagtctatttaaccgtagttcataggtaattaaattcaaattataaaatgtagtgactgactaaacatgataattatgaccattttcattttatttcagagttttcttggaggcttttttggtccaatttgtgagatcgatattgttcttaatgatggggaaaccaggaaaatggcagaaatgaaaactgaagatggcaaagtagaaaaacactatctcttctatgacggagaatctgtttcaggaaaggtaaatcttctgtttgacaaaactatctaattgtaagatatcagaattagttatcaaagtggtctgtgctgtttcttaaatttgaataattttatgagggagagagatttttttttccctaaagttcagctaaaatatttgattgattagaagataatctttcctgcaaaggaaagattcttaccctggaaggctttcaagggaagagcctctaaatttcatgcaaaattttctgtttaagtctcctgtgtggttcatgaaaaaaaaaatattttttttttctgtttgtgattatgtgcttctgtctggtttcagacagtttcttcagatcggagctgtaattcacccaaagtttgtttttcctttaacattaagttagagattgagagtaattctctggtataactttctaaaggtttttttacattctttgtaacttacctctctgtactgctactattgtgtctgttgatcttatttctaggtactctgtagaggacttgagtacttttgggatgtgtctatgcatggtcagatatgtttatgacgccttctataaggtttcacttttttccccttttctttatccggtaatgtatacggttttttgttttgggttttttgggttttttgttttgttttgtttcgttttttaaatagggtctcactctgttgctcaagctggagtgcagtggtgtgatcatggcttactgcatgcggccttgtactcctggactcaggtgattctcccacctcatcctctctggtagctgggactacaggcacacaccaccacttcagctaattttttaatttttttgtagagatggggtttgtccatgttgcccaggctagtcttgaacttctgggctcaagcaacccacccacgtaggcctacaaaagtgctgggattacaggtttgagccaccacacctgactgattattcttatattttagggagtatgatcaatacttattagtggtcagtgatagtggagaatggtaatatcatagacaaaagcaaaccacaaaacatttgaaataatttaaaaatagaaaatactaggatttttctcccctgcttgttcagttaatatattcatgtggtagacagttttggaaatatatataatctcttcatatagaaataattcactgttaaaatttggatgtgtttcctctaatctccgcattaattgatatttatgtatatgtaatatattcagcatactttttcctctattgtttgatatttaagcagtttctgtttttcagatggctttcttcatatctttggtaatatggacatcggtatacgtaaatttttctctaaatttctgtaggacgagattatttccttagaatagattgctgaaagtgagctgctaggccaaaattcgtgaaatatctgaaggatcttaatacacattaatctggaaaatgtatttgcattaaattacatgtccacctgtgggtctttttcacccaaggcagcattgaatatgatcactttgtaatctttgctattttggtaggcagaaacaatcttattattttaatttgcatttctttggttactagataaattgaacttagatttaccagccatgtgaggttattttttttttttgtactgcattgtctcttctggtcctttgccagattacctactggggtcttagtgttgaatccgaagtgaattttttggttttcaactttacttcccttttattcttccttttaaaagatgaaaaaagaaaaaggccaagtgcagtggctcacacctttaatcccatcactttaggaggccgaggagggaggatcacttgagcccaggaattcaagaccagcttgggcaacatggggagaccctgtatctatttaaaaaaaaaaaatggagaaaaaggcctaaagaagagcagacaatcatcaaaaggatggagcatgtcaaatgaaagaagagtaaaagtagtagtgtttggcctattgaaatgacttgttaatgggctgggggcataggaataccaatctagctttctttctagggagagactgaacctagcatctcaggtatttcttttacagatatgacatgtaaatatctctcctactaatttgtaagctccttaagttcaggggatcagagtgtgcttctgtagtctccataaaatacatgatagtgttgattatataataggctttcactaaatatttatttggtttatttactgtttttaagtcttgtagagaatatcttcagtctagtttaaagtaatcttatgtcacctggaccagttgaagttcatggctgatgtttatgggataaaggaaaaggggggtgtttaaagtaaaagtaaagctactccagtgtgttctttaaaaagaatagttggtgttcaaattacattttgatcctgggtgtggtggctcatgcctgtaatcccagctctttgggaggctgaggagggaggattgtttgagcccaagagttcaagaccagattgggcaatgtagcaagatcctgtctctaacactaagtaaataatttttttaaaaattacattttggaattgctggaaaccatacgtagacctgatcaactatggatagcattttttaaaatgataagatctcttataggtaagtattttcagttcaaaagttactatatcttgaatctgattgtttattggtttgagatttttttcatttttaatgtttttattgaaaaaacacgtgtagaaaaccatatacaacaaaaataaattattataaggcatattttcttattatcaccatccaagtcaagaagtagtactttgccagctaccccatgtgtcctgtctccatcacactcccatcccctcaaaagtaaccagtgtactgacttttatagtagtactttcttgtgtttgtttagtcttgctcatttaagaaaaatttggtacggtttttaaatctctcttaatctcaggttccctcttcatacctttctttaacttgcaatatctgttgaagaacacttggtcatttgaattgtagagttctctgtgtttgtgtattcctggtacagttattgcctatcagttggcagctaggtccagaggcttgaatcaaactcaagtttgattcttctggcaagaatataggtggtggtgtgtttttccattgcaggtgcaaaatgtctggttttctttctctgtcatttttcttttcttttctttttttttttttgagacagagtcttgctctgtcccccaggctggagtgcagtggcgtgatcttggctcctgcaacttcccgcttcctgggtccaagtgattctcctgcctcagcctcctgagtagctgggattacaggcacgcgccacgacatccggctaattttcgtatttttatttttaacagagacgggatttcaccatgttgggtcaggctggtctcgaacttctgacctcgtgatccgcccagctcagcctcccaaagtgctggattacaggcgtgagctaccatggctggccttttttcttttttgcaactgttgatactcagtacctagattgatttaactcattgggagttgcagaatggtgatactttaaattctgttattttgtttttacttatgaaatggaatacatttacaaagagacgttatctatatcttgtgacctagtggtacagctcatatagaaaaaagaatgcttgacctttttccttttttggcctgttttgttatttatttatttatttatttattttgagatggagtctcgctctgttgcccaggctggagtgcgatggcgtgatctcggctcactgcagcctccacctcccggattcaagtgattctcctgcctcagcctcccgagtagctgggattacaggcacgtgccaccatgcccagctaatttttgtatttttagtagagatggcgtttcaccatgttggtcaggctggtctcgaactcctaaccttgtgatccgcccgcctcagcctcccaaagtgctgggattacaggcgtgagccaccgtgcctggcctttggcgtgttttaaaaaataataacttggttccttatcttccaaaggtgtaaactactagttttatttctcaataacttatataaactcatgatttaaacatacttgatgtttataaatattgccctattgaagctctagttgtataatcctctgtaacaaattaccacaaacttagcaacctaaaataacaaatttatgtcttaggatttttgtgatttagaagtccaggtggaggttagctgggtcctatgctcagggacttaccaggttaaaatcaatccaaggttgcagtctcgtctgaagttcaggattttcttccaggctcactggtttttggcagaaatttccttgttgtgctatgactgatacccttgtttcttgtgcagtaggctgtctgttcctataggttgccctcagatccttgctgagtggcccctttctctcagtttgcgttgtcttcaaggccaggaggagaccatcactctgacattcatcttcttttaaagagcttacctggtttgatcaattccagttaggataacctcccttttgattaactaaaaaaatcaactgattagtaacctgatcacaggagtggtatcctatcatattcactggactcacccacactcaagaggattatacacatgtgtacaccatgggatagtaatattgagggctatcttagaattctgcctaccacatttgtattgactcttatgaaaggacatgggggccctaggatttttctttttttaagctgtattgagagatatatatatatatatattcgccataaaaattcacccattttaagtgtgcttaaaatttttagtaaatttagagttgtacaactatcaccactaattccagaacattttcattactccagaaatttttaaaaatgctgtaccattagcagtcattctccatttcccctccttccagtctctgacaacccctgatctctgtttctatgaatttgcctattctggacatttcatataaatggaattatacaatgtgtggtcttttcctattttgtttctttcacttagtataatgtatttgagattcatcaatattgtagcatttgttattagtatatcattgttttttattgatgaatagtattccattttatggctataccacattcttgtttatgcattcaccagttggtgggtatttgggatgtttctacttttttgctgttgtgactaatgctgatgtgaacatttgtgtagcagttttgtgtggacctatattttcctttctcttgagcatgtacctgggagtggaattgctgccttatgttaaatatgtttaagtttttaataaactgccaaagaccttaggagtttttggtggctttcttgctaactggtatgacaagatgtttaagggtcttttgtgtttctgcttcatacctgcactcagccgtatctttcaaggccatagttgcatgcaaagattgctcattgctacagtgttggacattatttctaggctgctcagtggatagatggggagagtttttaaatatagatttaataaatttatttttatttgtgtatattgtttaagataaaatacttcaggaatcatattgtcatttccaattcaatttgaaaattagaagtttttacttaacctcttatgttacatgtatatctcctttcttctgcatcaagaatactgattttcagagtcaaaggaagatgtaattagcatatcccataatttactcaatatctttaccccacattatatacataatagtctcagaataacaatactaacattaccactatcaatatgattatgaagttagttaaaaaaaatttagcatttgctatttgttttactcacatttcttaaatgtaccatagtaagtacattgtcagagtgtatagtaattatatactttatgtgcttcctttcgccctcacttagtcttggttttataaataactgttcatatagtgtgcaccaccagtccttatatctttgtctctttatttgtttcattgtctgaagcttattctctagttactagagtctaatagattcctcaggaaatgctcatgggaacaataaggcctaagtttttgcatattggtaatggcttttttgtgtcctttacacttaaaagttagtttttctgaataatcttggcttacatttttttgagttattttatttattttctatttatttattatttttgagatggagtcttgctctgtcacccaggctggagtgcggtggcataatctcggctcactgcaacctctgcctcctaggttcaagcgattctcctgcctcagcctcccaagtagctgggactacaggtgcccaccaccatgtctggctagtttttaaatttttagtagagatggggtttcaccatattggccaggctggtctcaaactcctgaccttgtgatccgcctgccttggcctcccaaagtgctgggattacagatatgatccatcgtgcccggccttcttgagtgttttaaatctattattactgcattgtcttctggcatagggtattgttaacagttttttcatttgaggaaagttttcttgaattacagccattattaattagtatttattccattcctttgctttggttttcttcttgatatcagtatttttgagtcttgtttgagtgtggttttttgctcttgtattccttctgcttatcctttatttctaaaatgatttttacttctatttctaattcttttctgatttttctcaccctagcttaagattttctttcatgtattgtatcattttcttaatatcgtatagcctgttttgaaataaattacagttttgatctatcttgtctgtagaaatgccattctgttccttctctttttttcttaaaataactttgtatgggatttgaccttgatatatttatgttgctaatttttatgtgaaattagttttccccaatgttttttttttttgagataagatcttgctctgttgcccaggctggaatgcagtggcatgactatggctcactgcagccttgacctccaaggcccaagcgatcctcctacctcagccttccgagtagctgggaccacaggcatgtgccactgtgcctagctaattaaaaaatatatattttttgtagagacagggtcttgctatgttgctcaggctggtctcaaactcctgagctcaagtgatcctcccatcctggcctcccaaagtgctgagatgtgagccactgcacccgaccttctcctgaactttttgtcttttcgtgatagagtctcactctgtcacccatgttggagtgcagtggcacgatttcagctcactgcaacctccgtctcccaggctaaagcgatcttcccatctctgcctcctgagcagctaggaccacagggcacactaccacgcccaattattattattattatttttggtattttggggtagatacggggtttcaccgtgttgcccaggctggtttcgagctcctgagctcaggcgatccacctgtctcagcctcccaaagtgctgggattacaggtgtgaaccaccgtgcctggcccttcctgaacttttgatggtttggtttaggatagtttttctaaccacctatcctagacagcaggcctgactggtcagttttgagtgttctaatattattggattgtgcaaaactccttccagcgttagctcttattctcagattgacaccatgctttccagtgaatatatatgagtaatttgggagttcttaggtccatcagacactccattgcattctttgattcctcctgcacaaccctagtatcatgcaggttttgtggctattaacctggtttgtccctacgcattatgttttgggattgtgggaatactttatctttttctgtggtaaattggatccttagatttttttggttttgctgtctagttggtccatctgtttttatgtgacgatctggggagattcaaagactatgttgccatcttcccagaaattgatctgagattctaaaaggccatgtgtaaccattctggcagtttagcaatatgtatcaaaatcttcaaaagtggatatcatttatagtagccagaatagtctggattattactatgtaagagacaaccccaaaactcagtgacttaaaaacaacagtggcagtggcttctttcttgcccaggcaacatgttccttgtgagttagctgagggccttattctgtgccatgctcagtgatggagcagccaggaacatcacactcatcatggctgagggagagaaatctctgcagagtctttcacaagccattaaaatgccccatcctagaagtaacaaagagcatttctgatcaaatttattgtctctagaaacagtcttgttcgtacctcacccagccacaagagggtagggaatacaatcataccatgcactcagaatgtatgcagctggaaatatttgagcagtgcctgtattgattaatattattttgatccacagattcttctgatcagattttatcctaaaataatcaactttgttcatttcactgtttataatattcaaaaattgaaagccacttaaatgtccagacattaaaaaacctaattatggtaataaccattaagtgcttagggccattattaatgtgattatattgatctgtattcattcacatgaaaagaggtttgctataataacaatatttactgagtactcaccatgacccaggtattccttctgaagttcttcataatgatacaatgattcctcttttttttttgagatgcagtcttgctctgttgccagcctggagtgccgtggcgcgatcttggctcactgcaacctctgcctcccgggttcaagtgattctcctgcctcagcctcccgagtagctgggattacaggcgcatgccaccacgcccggctaattttttgtatttttagtagagacggggtttcaccatgttggccaggatggtctcaatctcttgacctcatgatctgcctgcctcagcctcccaaagtgctgggattataggcgtgagccaccataccaggcctttttttttttttttttttttgaggtggggtctcactgtgttgcccaggctgagtgtagtgtcatgattacggctcactgcagcctcatccccctgggggcccaagtaatcctcctacctcagcctcccaagtagctgggaccgcagacatatgaaccaccctgcctggctaattaaaaaaattttttttttttatagatagggtcttgttgtgttgcccagtctggtctcaaactcctggactcaagtgattccccaaccttgacctcccaaagtgctgggattataggcatgagccactgtgcctggccaaggattatttgaaagattatcttgtgttcagtaaaattaggataactaaagaaaatgaaaaaagtggtatagatttgtaataacctcagaaagactatcttgacaacgagcttgaggcttttaaagctaagaaagacattttaaacctcatatttagaataagatgaataagaaaataatatgctcatttggcacacttattttaatataacaaatgcaaaagaaagctttccccccactattcaaaaaaaaaaaagatttaaattgggaaaggtaggatcattaaaaattaaaacagaatgaaagctttgttatggttaagaagattaaaaataaactaactagttttcaaacatcctggtgaccataccagacaaatgctatgcgataatactgaaagaattttgcagaactggtcaccaaatctctgctaggagtcctttagtaattgtggaaaatgagagaggttctagaatataagaaaagcccttatttataaaatggggtagaaagtttgtttcaggtaaacttaatattggttcctgacatatctttagattattaaataggtgatcagtgaacatgctgaaaagaaagcttaaaggaaaaagaggaggaaacaacgggttgtttacgaccaagcatgtgtcactaagaacaaatcttgccacaccaatctagggtttgtgaaatgtcctggtgtaataaaaagatcactgggctagcactggaagatctagccttaactttactgctgtcttggtaggtaactctggacagtcatttaatttcctggatctcacctataagtttaggaggttagactgcctcattggtttccaaacttggctttgcactgtaggatgctctgcatgaaaatctttcatatattagatattatgttggatcttggaggtctgacatctcgcccacagcaagaataaattcctttttaatattcctgacgtgagtttctgtatgcctacttttcagagtgtggggattctgctgttctgttaacagtatccactctgctttttagagatacgcaaaataaatctaatccttttctaagtaagagttctctctaagcattttccacatcactgtcttgtttatcctgtcttctctaagctaaatatgctatttcctttagttattgttcaagaaccctgggttttgagtctttatcacccagattgctttcttttagttttcaaattaaatttaatttttttgagacagggtcttgctgtgtcacccaggctggagtgtagtgatgtggtcatggctcattgtagccttgacctctcaagctcaggcgatcctctcacctcagcctcccaagtagctcagacaacaggcacacaccaccatgctcagctaatattttactatttttgtagagttggggtctccccatgtttcccaggctaatctcaaacttctgggctcaagtgatcctcctgcctctgccttccaaagtgctggaatgacaggtgtgaggcactgtgtccagcctcagattcttacataactatatagaaaactggtttgcattatctgtatccagcagttccactcctagatacatactcaagagctcttttaagagcaattctagattttcagaaaaattgagcagaaagtagagttctgtgtactcccttcttcctcaccccagccccacatggattcactgttactaatcttgcattagagtgatacatttgttaaaattgttgaaccattattaccacattattattaactaaagtccatagtttacattagggtttactctgttgtacattttctgggttttgataaatgcataatgtcatgtatccatcattgtgatatcatatagaatagtttaaccaccctaaaaattccctgtgtttcattcacctagtcatgccgctctggcacctgcgctaccaccaccatccacacagtcttcggcaactactcatctttttactgtctataattttgtcttttctagaatgtcatgtagttggaatcatatagaatgtagcctttttagattggtttatttcatttagcaatattcttttaaggtttctccatatatctttgtgacttgattgctcatttatttttagtgccaaatcatattccattgtatggatgtaccaatgtttgtttatccgtttacctactatcttggttggttccaagttttgctcatttttctatctagttgactctttttctcttattgatgtgtaggattttttgtatgttcttgataaaggtgttttatatatctagatatggagtcctttgtctatgtatgtatcataaatatcttctcctaatttctggcttgactttgtagtctcttaatggtgtcttatgataaacagttcttaattttaatacactagatacataatgtttcctttttgtttatgcttttcatatctagtttaaaaaatctttgcctaccccttgggcacaaagatattctcctgttttttttcctcctataaatgttatttaatttaattaattaattaatttatttttgagacagagtttcgctcttgttgcccaggctggagtgcagtggcgccatcttggctcactgaaacctccgcgtcccgggttcaagcttttctcctgcctcagcctcctgagtagctgggattacaggcacccacgaccacacctgactaatttttatatttttagtagaaactgggtttcaccatattggccaggctggtcacgaactcatgacctcaggtgatccacacaccttggcttcccaaagtgcagggattacaggtgtgagccaccacacccggcctaaattttatttttatacttcacatttagatccttgttttgcttggaattggttttcagtttgtctgtggtggtaacataggagtcaagtttatttttcttcttctgtatggatactaatgaacccaggatgtatactgaaaaagccatccttttccactgcactgtcataccacctttgtcataaatcagtctgtggtgtgacacaggagtcaaatgtatttttcttctgtatggatagctaatgaacccaggatgtatattgaagaagccatcctttctcctgctgcactgtaatataccacctttgtcataaatcagaggttgtgtgaacctgttcagaattttattctgttctgttggcctatttgtggcatgtacttttttcttttctttttttttttttaaatagcctaattgagttataattcacatgccataaaattcacctattagagtgtatagtgatttttactatatttgcagagttgagccaccattatcaaaatgtaattccagaacattttcaccaccccaaaaagaaatcccatattattagcagtcactacatgagaaccactaatttacaaatcttctttctttcttgctgaatttattgattctggacatttcatataaatggcatatactgtgtggccttttgtgtctggctccttttacctagcataatgttttcaaggttcatcgtgttgtagtatgtacccatacttcattcctttttatttttattcaatcacttattcattcattcattcattcgagatggagtctcgctctgtcacccacgctggagtacagtggtgtgatacgggctcactgcaacctctgcctcctgggttcaagcaattctcttgcctcagccttccgagtagctgggattacaggtgcctgccaccgcgcccagctaatttttagtacagacggggtttcaccatgttggccaggctggtctcaaacttctgaccttatgatctgcccacctcggtttcccaaagtgctggaattataggcgtgagccaccgtgcctggtcaacacttaattcttttttaaaaaaattgtggtcaaatatatattacataaaatttgccattttaacagttttaaagtatataattcagtggaattaattccattgataatgttttgcaagcatagctactatatttccaaaattttttcatcacctcaaatagaaactttgtacccattaagcggtaactccccatcttccagcccctggtaacctctaatctactgtccgtttctatgaatttgcctattttagatattttgtataagtggtcatataatatttgtccttttgtgcctgacttatttcatttagcatgttttcagggttcatccatgttattgcatgtatgagaacatcattcttcttttgtttgtttttggtgccagataatattctaatatatccgtgtggtataaggatataccacattttgtttattcatcagttgaggacatttgggttggtactatttgaccattatgaataatactgctgtgaacattcatgtacaggtttttgtgtgaacatatgttttaacttctgttggatcttagcagtagaattgctgggtcatatgttaacttcctgtttaatttttagaagaaccgccaaatttttccaaagcagctgcaccctttcagattgcctccagcaatatataagggttttggtttttccatgttcttggcaacacttactaatatgtctattttttattataggtattttagtgggtataaagtggtatctcattttgattttcagttccccaatgagtaataatattgaacatcttttcatgtgcttattgccatatgtctgtgtttcttggagaaaactctattcaaaatttgactatttttttaattgggttatttttctttttatggttgagttgtaagagttctttatatattctggttacaagtccagatatgtgttttgcaaatattttctcccattctgagttctctttccactttcttggtgtcttttgcagtgcaaaagttttacattttgatgaggtccaatttatcaatttttttttcttttgttgcttgtgcttttggcattatttctgagaaatcattgcctaatccaaaggtcatgaagatttgcacccatgttttcttctaagagttttttaattgtagcttttacatgtaggtgttttatccaaatgagttaatatttgtgatggcgtgaggcagcagtccaactttattcttttgcatgtcagtatccagttgtttcagcactatttgctgaaaagaatattccttccccattgaattgttttggcacctctgtggcattttattttttattttttatttttattttttgacagagtcctgctctgtcgccaggctggagtgcagtggcacaatctcggctcactgcaacctccaccttctgggctcaagtgatcctcccacctcaccttcctgagtagcttggaccacaggcatgtgccaccatgcccacctaatttttatatttttttgtagagacaggatttcgccattgtgccccagctgatctcgaactactggactcgagattagcatgcctcggcctcccacagtgctgggattacaggcatgagccaccgtgcccagcccctgtattgtgttttcatatgaaaactttgtcaaactctttaggtattgctgagaattttttttttataaatatgaaatagctactgtcacaacaggcagagaataaaagaacctcttattgtatctatttaaggtaaagagatatttagtaattaagatagttggtaattatttcaaagtgagatattattttagaagtcaattttcactgttctctactttcatttgtaagacatttttatttcttttttagaaattgaatctgtggcaagtaaaatggcttgaggtggtactactattgacaagccacttagagtgaactctggatctattccctgttgcaaaagtcaacacaggggttgacttttgtttagtccaagattatagtagtttatagtttagttctttaagcaaggaatatttttgtggcatctttcatcaatatgcatatggactatgacagcagttgcaaactaatcttggatttccactggcagcagttggaaactaattttggataatcacaatatccagcaacaataatatacagataatttggtgtctgattttaaaatgagtgtataaatggtgtgtggtacattgatagtatatgtttgtcttaaacagtgtagaataatgtaactccttaaataaattctgaagatagcattattcgagacatctctagaatattgtatactgaggcatgagctttgagactcatttgttggagcagagagtatttttttttttttttttttgagacggagtctcactctgttgcctacgctggagtgcagtggcacgatctcagctcactgcaagctctgcctcccaggttcactccattctcctgcctcagcctcccgagtagctgggactacaggtgcccgccaccacgcccagctaattgttttgtatttttagtagagatggggtttcaccgtgttagccaggatggtctccatctcctgacctcttgatctgcctgcctcagcctcccaaagtgctgggattaccagtgtgagccaccgcgcccagccaagagtatgttttgtatgtagatctgtttttttttacgttcattttaaacctatgtagtctcaagtatctgcacacaaattattcattaatagcaaaggggagaataataactttaaattagagaaacttggtagattaaccaagtgaccaaaattaacatcaatcagtattgggacaaactggcattgtatgcttcctaatatgatgcattgaaatagatacaactacacttttgtggtcttttttccaaaagtgtgtaagctgagtctaactgtgatgaaacatcagacacaccaaattgaggtacagtctataaactgtcctgtatttttaaataagtcagggtcaagaaagatgatgattgaggaatgttctagattaaaaaggatactaaagagatatgtaatcctggactggagaggaaaagactataaagtacattattggaacacatttaaaatttttttttaagacagtgtctcctgtcgcccagcatggagtgcagtggtgtgataatggctcactgtagccacaaactactgagctcaagtgatcctcacacctcagcctcccaaagtgccaggagtacaggtctgagccactgtgcctgtccctattggaacaattgatagaatttgaatatagaccatgggaatgttaactttcttggtgttttttgttttttttttttttttttttttttttttttgagatggagtcttcgtctgtcacccaggctggagtgcagtggcatgatctcagctcactgcagcctctgcctcccaggttgaagtgattctctagcctcagcttcctgagtagctggaacaggcgcgtgccatcacgccctactaatttttgtatttttagtagaaatagggtttcaccatgtgggccaggctggtctcttaactcctgacctcaagtgatccacctgccttggcctcccaaagtgctgggattacaggcgtgagctactgcacctggccctcatttattttattttatttttatttattttttatttgagactgagtcttactctgtcatccaggctggagtgcagtggctctctgcaaactgtgcctcccgggttctagtgatactcccacctcagcctcccaatttgctgggactagaggcatgcaccatcacacctggctaatttttgtatttttttgtagaaaacggggtttcaccatgttggtcaggctggtcttgaactcctgacctgaagcggtccgctcacctcagcctcccaaagtgctgggattacaggcgtgggccactgcgcccggcccaactttcctgattttgataattgcactgtgattatgtaagagaatgcgaattttcttttcttttttgagatggagtgtccctcaggctggagtgcagtagcacgatctcggctcactgcaagctccacctcctgggtttcacaccattctcctgcctcggcctcctgagtagctgggactacaggcgcctgccaccacacccggctaattttttgtatttttagtagagacggggtttcaccatgttacccaggatggtctagatctcctgacctcatgatctgcctgccctggcctcccaaagtgctgggattacaggcgtgagccaccgcgcccggcagagaatgtctgttttcttaggaaatacatatgaaatgtttaggggtaatggagcatcatgtctccaacttactctttgttgtggaaaaaagtatatatatgcatgcccatatatatgtagagagatgatgataaagcagatggggcagaatataaaacttgtgctgaatctgggtaaaggttatgtgagatttcccttgtgctattcttgcaagttttttgcaagtttttgaattataataagaagttagaaaagtataactgaattggtattaagactcttgacataggttgggcgtggtggcacacacctgtaatcccagcactttgggaggccgaggcaggcagatcaagaggtcaggagatggagaccattctggctaacatggtgaaaccccgtctctactaaaaatacaaaaaattatccgggcatggtggtgggcacttgtagtcccagctactcgggaggctgagtcaggagaacggtgtgaacccaggaggcagagcttgcagtgagctgagatcaggccactgcactccagcctgggcaacagagtgagactccatgtcaaaaaaaaaaaaaaaaaaaaaaacacacacacacacaattagccgggtgtgtggtggcagttgcctgtaatcccagctactcaggaggctgaggcaggagaatcacttgaactggggaggcagaggttgcagtgagccgagaccacaccaatgcattccagcctgggctacagggcgagactccgtctcaaaaaaaaaaaaaaaaaaaaaaattcttgacccagctcaccagcatagttagtttacttttctgtgcttccttgcagaatagcttttaaaccaaaatgcttaattatgccttcaaattctgggattcttcatattgcagaagagcctacaataaggcttaaaagcaactgtgttttaacatcagtgggagatcaaggaaaatttcagagtttgcagtttggtaggaagactgaaaaactttgcatttgtactttaatagtgtggtttcatgatggtttttgaagaactgtaagttttaaaaatatcagacaaagccatgttcaaataaaatcattcttaaaaactgctgccatataggtattttcaaaaatataatttttttctatatgctttgttggtagagattatagttcaaattactgcatggcttttgaaatagctgggattatgcttgttttattatttgtggttcaaatataaaatttttaatgttaagcctgtttaagtactacttttctttcttaaatatttttctgactttaatagtattttttgcctttttttttaaagaggcctgggcaacatagtaagaccctgtataaaaaaaattagccaggcatggtggcatgtgcctgtaatttcagctatttgggaggctgaggtgggagaatcacttgagcctggcagattgaggctgcagtgagtcatgatggtgccactgcgctccagcctgggtgacacagcaagaccctgtctacaaaaaacaaaacaaaaacttaaaaaccagagaaggaaacaattacccataatcaataatcattcatttcagaagtaactgctgttaagagtattctctttctgtagtttcaaaaaatataatcggcatatacttgtatacaatttaaccatgctttattcacgtaacacatcatgcatatctacccacatcattaaaaattctttatcattattgtttttaaacttttaataatattccatcatatggtgtatcacaatttacttttttctgagttattttgaaggcaagtaactaacttatattggttataagatagggaagatacagaagatgaatattttaatctatgcagtttacaaacagaagtaattggacctctttttcttgttccttgatttctgttatcttttgagaaacattatttgtaagaaaagcttttaaaagttacattaccagcatttgttatagtaaaaaacggcggggcacagtggctcatgcctgtaatcccagcactttgggaggccgaggcgggtggatcacgaggtcaggagatcaagaccatcctggctaacatggtgaaaccccgtctgtactaaaaatacaaaaaaattagccgggcatggtggcgggcgcctgtagtcccagccacccaggaggctgaggcaggagaatggcatgaacctggaaggcagagcttgcagtgagccaagatcgtgccactgcactccagcctgggcgacagagcgaggctctgtctcaaaaaaaaaaaagaaacctggaagtatgcttttttgtatgaaaaaggatcctacctaattcttaaatgttaagttgtttttttttttttcggttggcgggtacagggggagatagagtcttgctctgttgcccaggctggagtgcagtggttcactgcaacctccgccccccgggttcaagtgattctcttgccttagcctcccaagtagctgggattacaggcatgtgccaccacgtccagctaattttcgtatttttagtagagacgaggtttcaccatgttggccaggctggtctggaactcctcatctcaagtaatccactgtcctcggcctcccaaagtgctaagattacaggcatgagccactgtgccctgccttttttttgtttgagacaaggtcttgccctgttgtccaggctggagtgcagtggtgtaatcttagctcattgcaccttcgacctcctagggtcaaaggctcctcctgccacagtctccctagtagctgggactacaggcacacacgccccaatacccagctaatttttttttttttttttagtagagacggagccttgctatattgtccaagctcgtcttgaactcctgaccttaattaagcagccttcctgcctctgcctcccaaagtgctgaaattataggcatgagccaccacgcctagcttggaattttatttctaacatacatagttcacagatatctttctcaaattaaaaagttataaatttggctgggtatggtcacttgaggcaggaggattgcttgaggccaggtgttcgagaccagcctgggcaatatattgagactccacctgattctctgctttctctttcctttttctgatttctctgttctttgagggtaagatgatattctcagactacatacatctttcaatagtagccagcacagggctgggtacattcagtgaacaagtgaataaatgaatatacaaaatacaatcagaatcttagagaaggggaacccggtaggattgtaaacacatgcagagaaacacccatcataggagcaggctggcttcaagtctagaccctggtcatctcacagtgaactaatggtacttgaacggagccctgactcccatgccaagcaatgtgaagttgtatccttgactgtctcaggtaatacttagagaagaagagtgttatcaagaaagacaattgagaaacaacctatatgaccatacaggggattcagcaggtaaatggtggtgtagccaaacaatagaattctttgtagatctggctgggcgtgatgactcatgcctgtaatcccagcactttgggaggccgaggtgggtggatcacctgaggtcaggagtttgagaccagcctgagcaacataatgaaaccccatctccaccaaaaatacaaaattagctgggcgtggtggcacatgcctgtaatcccagctacttgggaggctgaggcaggagaattgcttgaacttgggagatggaggttgaagtgagccaagatcttgccactgcactctagcctgggcaacaagagcgaaactccgtctaaaacaaaaaaaaggaattctatatagatcttaaagatgagtttgtggccagtacagtggctcatgcctgtaagcccagcactttgggagtccaatgtggcagaactgcttgaggccaggagtttgagaccagcttgggcaatatagtgagacctcatctctacaaaaaaaatttttttaattagcttggtgtagttatgcatccctatagtcccagctatttggaggctgaggcaggaggatcacttaaccctaggggttcaaagctgtagtgagcaataatcatgcactgtactccagcctgggtgacagagtgagactctgtctcttaaaatatgtgtgtgtgtgcgcgcacgcgcacgtgcgtgcacatatatatatattttttttaagatttccacttggcagatatatgagtttagggattttgagattatatattttactccaaaagtatgtaagataatggccaggtgcagtagctcatgcctgtacttctagcactttgggaggctgagggaggaggatcatttgagcccaagaggttgaggctgcagtaagctatgattgtgccactgcactccagcctaagcaacagagtcctttctggaaaaaaaaaaaagtatgtaagataaatcatacttgaatttaaatctttaggcattctgtttttatggtgggtagcagacttaggacaaaaggcactgcttttaaggttaggaattataataatatattggttacagaaaactgaaagtgatacctcaattacaataagtatgaagctatgatttgaccgacaaatttctgagcattgtccataatatagtcctagttgtgtggatgttagtcttgcttgatttaaatgtcctggaattgcatctgtttttaggtcagttcttgaaattagtaattacctcacattaaaatgcttttattagtcatagaattaactgtttgaccagaaaacaaatatggatagttgaaggctgttcctttctttgagtctttttatagttctccacctattaaggattccttcttaacaaagcagactttatgttgatgtaaataagaggttcacccatgattgtgtataactaaattacaccttctctggtgctataacatcatcctgatttaggtatgtggtggtgtctcaaacttcataaatgaatacctgaaatatttatatattgcattcatctgaaaggaagctactagtaggcccactcataggattgttaacatctcttataatttcatgttttggcaggtaaacctagcctttaagcaacctggaaagaggctagaacaccaaggaattagaattgaatttgtaggtcaaattggtgagttttaaaatagtattatttctttttctttgataactgaatttgaagagggttggattttgcaccaaaataattgaattagagcttagctttgtagaaggaaggaattgattttgcataataaaagagaggatttactttataactatattaaattgtgtttctttgacttgtatgaaatgatatttgatatatcatttcatgatatatatgaaactaccagccttgaaaactaattcaagtaaattagttgacctactgaaattttcatctgcctgcatttttcaccatccttcttataattagcagcctcaccttcattcttcattttctaattacccatgccatttgtcttcctgatctagtgtgtgcctgtagccagactcacttgtgtcaacacacaattccatgtgagaaggaaaggtgtagtttcttcttgacttagatcaacttatgtacatttccatacatgattccagatgaatgcttgatttagtagggagttaaactatataaatctttctatactgaagattcagaagagaaaagaaaatatgtctttataatactgtctacataactaggcttaaaatctagctttctaagtttcagtgtacatttttaaagtatcagaattggaatgggtagatatttatatatctgttctgactgagagtgtacttacatgtctattctgactgagaggcaagttgtagtaattgatagttggttttagtctttttgtgttttgtaattttatgaaggtaatatatttgcctaactaaagcaaaatagaatttttgccttgtctaggggaagttcaaataattgctggtaatgtgtcaaatggcttcatattgggagagccccaactacatcaaaggaatgaactcatttttaaagaaattttcattgtgctatgccacttgaaatcttttatgcctacatgaagtataattataaaaaggataatggaattcagagcataggtctagtttattagagacaaactcaataattcttttggtaaaaatcgtttgtgtttgaagtagatgtctgggttttattgaaatggctattaaataattggtctttttgccttttaaaatttctcagaacttttcaatgacaagagtaatactcatgaatttgtaaacctagtgaaagaactagccttacctggagaactgactcagagcagaagttatgattttgaatttatgcaagttgaaaagccatatgaatcttacatcggtgccaatgtccgcttgaggtatgaatgtgtattataaactgtaaacagaatcaaaaccagaaagtaatgactactgttgatatcttatttgaacctctaattataattctgtattggaagatttaagatttttaaaaattctgtcacatactttggctaatgctgatttgaggtaatagagcgttctaacattatagagttagacaacattgttatgagacatttcagttatacacttccctggtatgaattgtcccttacgtacttcatttgtcatgtaaactgaatgaccttctaaatccactagtttcccagaaaatctcctttagtatatggttcagaagtaatctggagtaccagagaggctctgatacatctaaaatgacacaaatagtggatggcagaaaaggagtacgaacctagttttctaaactctcaattcagtgtcctttcccttcactaagtctgtatgcaggaagccagggatgcctcagagtccagggcatttcaggatattaatctgaatgcatcaggtccgagatcttgctttctctgtttaacttggcattatctatctggaactgggtttgacaacccaaatttcaaatagcagttccttaaagaagtgatctggagaggtttcttcaagtaggcttgatgacagccctccaaactcatctgtaaagtatttacactattcttaaaattgaactttgtattttttttcatgttgggggcattaaagaaaattggaactccttcgtgaagtaatgaagtaagttgatcccaaaggagttccagcaaggaggagaagcctgagttgcagttaatgtttgctgatttaaaacatgaaaatttatcacaggtgatttaactcatcgactctcttttaactttgtaggtattttcttaaagtgacaatagtgagaagactgacagatttggtaaaagagtatgatcttattgttcaccagcttgccacctatcctgatgttaacaactctattaagatggaagtgggcattgaagattgtctacatatagaatttgaatataataaatcaaagtaagtatcattcacagataagttgttcagagaaaattcaaaaattaacttttcaggtgtttgtcagttggtcaaagtaaggatagaattgacattaatctgatgttaacaaatcaacaggatctctgagctaaaagaaattttaggagtttggtctggtttccactcagtaaaggtgtcttttatgttctattcctgataaatctctgcttggccactttgtgtagaggatgtcaccatctcagaaggcagccagtccttctgaggatacaatttatcttactggcttgatattacctcatcctagccatctcttttcacatattttcacctttaccacttaatcactgttaatgtctccttgtatatcatttcttggggggagggggaaggtatatatgtttatatatgttgtatttttacaaaactggctcatattttgcttgtgtttaatgcctttttaaattttattatgggaaatttcaagcatatactaaaatatttgaacagtatactgaataatataatgaatcctcatgtacccattgcccagctccaacagttatcaacacacaatccagtttatctgtattcagctctcatactccccataggttatattgaagcaaattccagacatttaatttaacccataaaattatgtatcattttatcaattaaattatatatgtggaatttgcttcgatataatctgtgggaagctgtatcaatatcattttatacatggactaagatgttctcagaaacattacttacatgaacaaaagattgccatttaaatgcccactggtattataacagttaaataaattatggtccagccatactgtggaatgctaaagaagggttaaaaagattgaggccgggtgcggtggctcacacctgtaatcccagcactttgggaggccaaggtgggcagagtttgatcacctgaggtcaggagtttgagaccagcatggtcaacatggagaaactccgtctccactgaaaatacaaaaattagatgggtgtggcggtgcatgcctgtaatcccagctacttgggaggctgagggaggagaattgcttgaacctgggaggtaaaggttgcagtgtgctgagatcacgccactgcagtccagcctgggtgacagagggagactccatctcaaaaaaaaaaacaaaaaaaaaagattgagacatatgtatttagttctccagaagcgtgtccatgatatattaagtgaaaaatttagccataaaaacagcatgcatagtactgtttcatttctgtaaaatactcatgtatttggatatgaatagaaaagagtctgcaatgatattctgttgttaacagtggttatctgtaaaggatgaaattatgtattgactttacatatctcttatttaaatgttatatgacaagcttgttttctgtgtctattcagaaaaaagttttaaaaagttatatatcattctaaatataactacaatactcttatatctaaaaatattagtaattccttaatatcttcatacacccagacagtattcacatttccctaattggctcacagatatctttcttttttcacatactttgttcaaatcaatatttaaactagggccacacattgcatttggttgtttgagccttaaattttttaatttataggtttcccttctattttttttattaaagtttgtttgttgaagaaatggatgtgccctgtattatccctttcataccccagtcttttgttacattatttttattggttgtcactcccaggtttatatcactgaatatgtaatacatatggacttcagaatcttaaaattatattgttgatgaaattatcaaatagtttaggacctgaaaccactgaagcttcccttcagactgacataatttttacacacacacacacacacacacacacacacacagtgttttgtttgtttgagtctcactttgtcgcccaggctggagtgcaatggcgtgatctcggctcactgcaacctctgcctcctgggttcaagggattctcctgcctcagcctcctgagtagctgggattacaggtgcctgccactatgcctggctaatttttgtatttttagtggagacggggtttcaccatgttggtcaggctggtctcaaactcctgacctcatgatccacccgccttggcctcccaaagtgctgggattataggcatgagccaccgcgcccaacatatttttttttttttggagtcggaatctctgtcgtcccgtctggagtgcagtggcatgatctcggctcactgcaacctctacctcctgagttcaagcaattctcctgcctcagcctcctgagtagctgggatgacaggcatgtgccaccacgcccggctaatttttgtagttttagtagagatggggtttcaccatgttggctaggctggtcttgaactcctgacctcaggtgatctgcccgccttggtctcccaaagtgctgggattacaggcgtgcccggcctgacataatttatattaaccaactcttgagatacaattttgagagccaaacctgggaggatgctaaaaagtcctctggatattatagggattcctaagtttattaccacatcattacaaggtacgtgggagcgacctttggttattagctatcacaacagcagactcaacctatgtaggtaggtttcttttactttgtctttgtgggcagatgatttatgttagctgcactcttgtagaacttgagtaataatgacactaaactcttgtgtcttttaatgttgaaaatatcttcatacaccaaatatttcaagtattttttgtgtgtgtttgttttgagaaagagtctggctctgtcacccaggctggagtgcagtggcacaatcatgagtcactgcagcctcaatctcccaggctcaaattatcatctcacctcagcctcctgagtagctaggatcacaggcatgtgccactaattttgcaccacccagctaatttttagaagagattacatccccctatgttgcctaggctggtcttagactcctgggttcaagcaatcctgtcgccttgggcctcccaaagtactgggattataggtgtgagccactgagcccagccagaacagttaaccagggtaattattccctctgaggtagtcaagtaaaagtttgattccttatttgcatagtgaaatgatgaatacttttttgaaaaaaagaacactaaacaatatgaataatcaaaatggttgttgttggtttttgtttttggtgagccaaagttttatttattcatttgaagtattctctgatgacatcctggcctgagactccttgccatagttcttaattactgcacaactgcaaacaaccactttacggggtttcccccatctgtcagttttatagaggcttacccattccccagtttcttcttgtcatcaaccggggttcagcacaaagggcctccaccaacttaacatacatgggctcatcacaattagatgcaagcacacaaagatgagcttggtgcctgtctaaggctttggcagctttgtgaattccacatgctaggccatcatggatgagggtggtcttcagcacctcttgtaaagcagtagtaacgtcccttatacctccagcagcaatgccttcctcagccatggtggtgagtgaaactgaatcttgaatacacccaggccgccacctccatgcaactcagcagcggcaaggaaagagctcaaaatagtactttttttttttttttttgagatggagtcttgctgtcacccaagctggagtgcagtggtgtgatttgcctcactgcagccttcacctgctgggttcaggcagtcctcccgcttcagcctcccaagtagcagggatcacaagcatgtgccaccatgcccagctaatttttgtatttttagtagagacagtttcgccatgttggccaggatggtcttgaactcctgacctcaagtgatccgcccaccccggccttccagagtgctaggattacaggcaagagccactgtgcccagcctcaaaatggcttaagtaattatactaaagatgtctatcaaagtcttttaggacatagttcactgtttttgcttgtttttaaactgatatttagtgagatatgttcttccccaataggtatcatttaaaggatgtgattgttggaaaaatttacttcttattagtaagaataaaaatacaacatatggagttacagctgatcaaaaaagagatcacaggaattggtaagttgaaaagagtatgtaaattaaaattctttgttttagttgacatttttaaaatcttaaaatattgtttaaacataatttgatatccacattgagtactaattttgctagttaatattgctggcagtaagttatttaatgtttttttaaattactttttgattgtccagaatttattttttataaaaaattaatttttgaataggtaataaattcacatggttcaaaaataaaatgtaaaagagtatacagtaaaaagtatcttatttctgtactctagctactcataggtaatatgtttattataagtttaaaaatcctcagtggagcaggtcaaaactcctgtgctgatcagtagtgggattgtgcctgtgaatagccactgcacttcagcttggacaacagagtgagaccattccaaaaaaaagaaaaacaaaaaccaaaactttccaattagttattatgtatacaagcaagtacctatgtataagacacacccctttttacttaaatggtggtgtataatgcatacttcgctttgccacttagtagtgcatcttagagaactttccataacaatgtgtagaatactttatctttttaatagttttccattttattgatatactaaaattgaaccagtctgctgtttgtggacatactggttgtttccggtcttttgctattacagataatgtcattttgcacgtgtgcaagataaaatcttagaagtggaattcatgggttaaacagcatatttgtttataattcttctgccctttttgtggcgaacagggtctcactatgttgcccaggctagtctcgaactcctgggctcaagctatcctcccacctctgcctcccaaagtgttatgattacaggcataagccattgcacctggccatttacaattttgatgcatgttatcagtaagtcctctttagggattatcccagtttgcattgctatcagcagtgaatgtaggagagtgcctcttttcccccatattctcatgagcacaatgctgtaaaaacttttagctcatttgatgggtaagggggagatactactacattgtagttctgggatttttcttatggattctttttcccccactgctttattgaggtataattggcaaataaaaattgtatatattcaagatgtatgatggaatgtttacattatgaaatgattaccacagtcaagctaattaatatattccattatagttttaattttcagttttctttttttttttttttttgagacggagtctcgctctgtggcccaggcgggagtgcagtggcgcaatctcggctcactgcaagctccgcctccagggttcacgccattctcctgcctcagcctcccgagtagctgggactacaggcgcccaccatcacgcccggctaattttttttgtatttttagtagagacggggtttcaccgtgttagccaggatggtctcgatctcctgacctcgtgatccgcccgcctcagcctcccaaagtgctgggattacaagcgtgagccaccgcgcccggcctaattttcagttttcttattgaggatgaacatctcttcatatgaataaaaacaatttttattttctgtaagccattcatattctttgccccattatctattctttttcttacttatgtgtagaaactatatattagagaaatcaatccccctccaccttttttttttttgagacagggtctcacactgtcacccaggctggagtgcaatggtacaattatagctcactgcagccttgaactcctggacttgagcaatcctccaacctcagcgttgtgggtagctggggccacaggcacatgccaccacacccagctaattttttatttttttgtagagacagggtgtcactacgttgcccaggctggtttcaaactcctggactcagcgatcctcctgcctcagcatcccaaattgctgggtttacaggtgtgagccactgtgccctgaattcctttttctaatattaagggtagcaaaaatttccctcgtttgtcttgtttgtggtggttcatgccatgtagaagttattgatgtttatgtagtcagatttatcagtttttcattttatggcctctgggttttatgccatggttagaaaggtctttttcacactgaagttctaaaaataatttcctgtgcttgattctactgaagtaatacattgtggtttagggattttgtttcatttttaaaatattaattcatttgaaatgtgttgtgatgtaagaggtgaggtatgtatcacctttacttttttccagatggctgaccagttgtcctgatatcttttattgtttcatccctgctttttgattttaatatataaatatataaacttactttctcctctaatattgttgggtgtttttttttttttgcagacggcgtctccctctgtttccaggctggagtgcagtggcgtgatctcggctcactgcaacctctgcctccagggttcaagcaattctcctgcctcagcctcctgagtagctgggattataggcacacgccaacatgcctggctaatttttgtatttttagtagagacggggtttcaccgtgttgcctaggctggtctcgaactcctgagctcaggcagtctgcctgccttggcctctcaaagtgctgggattacaggcgtgagccactgtgcctggcctcatcgtcgggttttttgctgaaagtaattctaggcaacactttataagaatttatagtcagtattcataatttaaaacatctgtgatttcttttattattattattttatttttaaataaaattctcacccaaggcatgatctcaaggcaagaggtcctgagaacatgtacccccatatgtgatttcttaatctccatgtttctacttgctagtaaatttaagtgattttaaaatcacttcaaattctcctttgttgtttcaaacaacttcaaattctcctttgttgtttaaaatgtggccaggtgcggtcgctcacctgtaatcccactactttgggaggctgaagcgggcagatcacttgaacccaaggaattcaagaccagcctgggcatcatggtgaaaccccatctctatcccaaaaaatacaaaacttagccaggcatgatagtgcacgcctgtagtcccaactactctggaggcttaggtgggaagattgcttgagttcaggagtttgagaccagcctgggcaatatattgagaacccatctctacaaaaattgaaaataaaaaaacaggcatggtggtgcacacgtgtaatctcagctacttgggaggctgaggcagaaggattgcttaagcccaggaggttgaggctgcggcaagccatgattggaccactgcactctagcttgggtgatggagcgagacaccgtctctaaaaaaaaataatgtagtggaaaaataagaaggcataaggctagtaattatattctggaatatttaaattaatgttatttacattattgcactaggacccagtaccacaacagaaacagaaacaatcgccaaatatgaaataatggatggtgcaccagtaaaaggtaacacacttttcagttacttcttttgtatagtgcaaacatcagtgttcatggcagttttgtttgtatttatttagtgtgaaagtatctttgaattcttaaaccattcttacaatgatagcttttaaggtcatctttgtacagctgcaaagaagactgtaattatatttcctagtctgaaataaggtttaatttttcagtttcaatttaggatttactagagacagttatatgtatctattctctagttttgaatttgtaatattttcattgtcttctattatacaatagttcgtctttgtaaatgttttttctcctgaccacaaaatggagtatggctgagcattaattcctgtaggtttttggagtcattatagctctcaagaaaataagcagttccattactagattaatcttcagtatctgagacaatgaagccagtatttatcattttaaaatttatgtctgggttttcttcactatttgtgcttacatcacaaagccagtaccatttattaagtgccaagtgtagatgaggcaatgtaatcttaggtgctctaaaactctttgagctaggtggttgtgtcccttatgatgcatgtatgtgtactcttgtgttatgcaacattactttgtaaaattccagcagccaccagtttttatgtaaaattatgagttttatatctttcagcaaattggtgtgcatgagaaaattattatgtaaaaaatattcaggccgggtgtggtggctcatgcctgtaatcccaacattttgggaggctgaggtgggcagatcacttgaggtcaggagttcaagaccagcctggccaatatggtgaaaccccgtctctactgaaaatataaaaattagctgggtatggtggtgcacgtctgtcatcccagctacttgggaagctgaggcaggagaatcgcttgaacctgggaggcggaggttgcagtgagctgagatcatgccactgcactccagcctgggagacagagtgaaactccgtctcaaaaaaaaaaaaaaattcaggggccgggcgtggtggctcacgcctgtaatcccaccattttgggaggccaaagtgggtggattgcttgagcccaggagtttgagaccagtctgggcaacatggcaaaacccccatttctataaaaaatacaaaaattagccaggcatggtggcatgcacctatgatcccagctacctgggaggtgggaagctcacttgagcccaggaggcaaggttgcattgagccaagatggcactactgcattccagcctgaatgacagagggagatcctgcctcaaaaaaaagaaaaagaaaaagaaaaaaaaaagccaggcgcggtggctcacgcctgtaatcccagcactttgggaggccaaggtgggtggatcacctgaggtcaggagttcgagactggtcagcctggccaacatggtgaaacccagtctctactaaaaatacaaaaaaaatttgcagggcatggtggcaggtgcctgtaatcccagctactcgggaggctgaggcaggagaattggatgaacccaggaggtggaggttgcactgacccgagatcgcaccattgcactccggcctgggcgacagaccaagactccatctcaaaaaaaaaaaaaaaaaaaaaagaatatgcaaagaattacccttaggaaaatagaagcaatgagaatctgaataacagtctttttggtaataaaagaatgtcatcattctgtccgtttttagctttgaatatatgagtaacaagtattcaataatttatacacatgattagaaattatggtaaacttcatgaaagaagataacaaaacaacttatagagcacttatctgttggcactgtttgagttttttaggtatattaacccatatagtccttacacattccttgtgaatactattgttattccccatttcacagatgaagaacttaaacaatgagtaagtgatttttccaaggtcacacaaccagtaagtggttgagatctgaagccaggtattctgactctagaacagtagttctcgtctaggggcaacttcacctcacaatgaatgtttggtgttgtctggagatatttttggctgttacatttggagagtactactggtatctagtgggtagaggccagggttgctgctaaacatcctacaaaggataggaccctccccacaacaaagaattattcagcccaaaatatcagtactactgaggatgaaccctggtctttgttattttgcatctcatgaggatgtgaagcattagtgtcaactctatagtgcttagtcctacctgttatgtgactatatttaatcatctttagaattaagtagaaattccttttctttcaggtgaatcaattccaataaggctatttttagcaggatatgacccaactccaacaatgagagatgtgaacaaaaaattttcagtaaggtactttttgaatttagtgcttgttgatgaggaagaccggaggtacttcaaacagcaggtatggtgccacttgggctggtattatgttctgcggcagatctaaaaatacctcgaaagcactcttctaagcttcactgtactgagcgagtgggagtttctaaataaataaaaacactgtgggtatgatagataaagaagtagaggagaatagaatcctatgatagatccctccccaatcattctgcagtactccagaatgagctataatttttcagggcttttagttttctcttacaagttcttttgtttttgttttttaataaaaacaatacctgctgcttatttagaaaaaaataaggcaataaagaacaaagaatgaagtaaaggtcagcagaatttccaccaccattgcaactaatgtgtgtatgtgtgtttacatcatattatggatattgcttttttttttttcttactgtttttaattttttgtagagacagagtctcactgtgttgcccgggctggtcttgaactcttgggcttaagcaatcctcctgccttggcctcccaaagtgctggaattataggcatgagccaccgtgcccagctgtattctttaatttgcatttttactcagtagtgtcttgaatatctttctcttaacaaatatacattattattattattattattactatttttattttttaagatggggatcttccaagcaatcctccagtcacagcctcttgagtagctgggaggtacaggcacgtaccactgtgccctgctgatttatcccttttaaacaattctgtcataatgtccatgagatgactgaattctaataatttttttatttgagacagagtctcgctacaggttaatttttgtattttcttttttgtagagacagggttttgccatgttggccaggctggtttcaaactcctggcctaaagtgatctgcctgccttggcctcccaaagtgctgggattacaggcgtgagccaccatgcccagcctctaatcctttttttttaagttttttttttgagacagagtctcgctctgttgcccaggctggagtgcagtggtgcgatctcagctcactgcaaccttcacctcccgggttcaagcagttcttccgcctcagcctcccgagtagctgggattataggtatgcaccaccacacccggctaatttttctatttttagtagagactgggtttcaccatgttgaccaggctggtctcgaactcctgacctcaggtgatccgcctgcctcagcctcccaaaatgctgggattacaggaatgagccaccgcgcccaaccgcctctaattctttgtttaatataaagtgttcattacaaacttgttctcatttgaaaatcaattaaaagcttttggtgaattttgaatgaagatagtaattagaatggtcttttgtattctgaatcagattaataaacatgtagttaaatgtcagttgagtgttcaaagctaagttagaaattaccctgtcctaagtactgtgaaaaatacaaaaactaccttttataaacatgatctgtcctccatgttctcacattgtagatatctgggaaaaagaaaaataatataaactaacagaatacttaaataatagcttgacagtaatttagaagagacaaaacctattccagtattgccatcctaatgttgtataattaaacatacatgatttataactttgaaataaattacatgatttttacaatttcaaaatcaattgcatatcatggcactattggaggtaagtctgttatttcccatgtgcactcatttggatgtttaaattctgatatgttggggaaaaaaaaaagcctataatgacttcatgaagcaaataattttaggaatttagaagagggaagttctcaggatggattggttagggtaagagttaggtagagaaatcgagatttgaagactggggaagatgtagggcgagtttatttggattgcattggaggcagagagtaactccatttggccgatgggggaaaatggtcaagggagggaagagaataatgttggtaaattggataaaggttatagaggggcatgaatacctgtttggagatttatcctggaggcactgagaactactaaagagcaatccaagcaatgtgctggaggattaacctgctagtgataataaaggattagatagaaagggctctgcctctcttgcctctgaggaagctgttttaatatctaagtgacaagaacttgaatttggatgagggcaatgaacaattaaaggatggatttggggaattctttaaagtaacaataggacttcttgacagattggattggtggtggtggaatgcatgggtgctggtgataggagcactagaggtagaaggggcagtcaagattagagctggaagaaagtggaaaagaagttggaaaagaggagggcttttgtagggaagaatttaattttattatggttaaaattgaagtggcaatcaatagagataaggcatcatatcaaacattaatttgttaatatcttgcatttgtttactaggagataattttatggagaaaagctcctgaaaaactgaggaaacagagaacaaactttcaccagcgatttgaatctccagaatcacaggcatctgccgaacagcctgaaatgtgaactgaacaggagaaaaaaagaaaagcaaaaaactcctgtaacccttgagattaagttcagcaggttaaagatggttgcagctggagggggcggaaaaaggccaaaactccatatatgttagtcttcctttatcttacagcgcagcatttattttatgatataatgaaatgttcgttcatgtatatacatttttaaaagtgctttctttgaaacactggaactttgttaagctgcctttttttttttaacttcctactttgatgataagcactcagatatatatcagcgtaaacatgaaaaattttcatgtgagtaggctggtatttgtaattttgctttctttctgcataatgttgattataaatcctctcttttcaggctaatgattacctcttattctctacatgcaaaaaattaaatattttgtgttcaaataaaattagaaaacctgagtggcctcttgtgtcctgcagagatttaaaacatggcatctcaatatttttgagaactacatttgtttttaacatatgtgtttgagaaaagcatatggagtgtttcaccgcaggcacttctgagtaccattccatggcttccagaattttatcctctttgaggtcttctgtgctatgaatattagatttctttccccaagggattatgtggcaggtcattatggccttcttttttttggccatattaagtaacagttttgctatattccagtagtaccgttgtgtgttttctgcaatgtggagttgacttagcttggcattttagatttgttaaaactattttttccataaatactttgaaacatatttatatatttcaatttaaggaatctttttgccatgtgtatgcaaatattattttcttcatacattcattttcttttcaggggaaaattttgggatgggggactcaggaggacctgtgaagcatgtagttatctagatctgggtaatttcatgtttattaaactcgaactttggctagttaaactcatattgaaacttcatctagtctcttaattttttaacactaaattcaagtcatttgttttaagtctctaaaaaagaagattgcagtcatccattcatatgcatggggtctgatcgcaaatacactaaatgtggagtgtaggaaccaaaatgaaacctgctgtatggaaactactttcacttatggttcattggtttttgtaccaatattttttatgcacttcagtgcaagtcttgtcagttaaccttactttatgagtaagctaaataacccaaattacatttctttaaacctgttttactactatggcactttgataaaatggtcaggaaccaactttactggcaaaagggtccatgtaccaccatgtgctggagcatctgttctacatgtggatatctatgaatggtaatgttttccttcatgtaagtgcctattcagagtttcagaattttaaaatgccaaatattttcatggtcatttgcatgtagtaagccagaaaatattcaaagagattttgaaaaccaattgtatttaaccagcctcaaattgtgcaaccatgatgtataataaagaatttgaaacagaaactgagcttgctgtttgcatgattaaaatagctctgttctcaaatctcttctcattgttagatttattgtcgaggataggattgttcaatagtttaggaagctgtaactgtgataatgaatttttataaatattactggtttcaattttaaatagatatataatgcttttaataggctggcttaaaactgtcatatacaggatgcctatccgttttgctcaagactttttgtagcataaccaatttgaaaaaaattcaaatttaatatttggtgatttcagtcaaaagtcagccagctaattagaagtcataaactgaaaaagaaatttgtgtctttaatgaagagttacaatgtctaatctattggttctcaaccctggctgcatatcagaatcaccttagaagcttttaaaataaccaggcccgggtcctactctgaccaataaaataagaatctcagagactgggccataagcattaaaaacaaaacaacctcaaaaaaatacctgtcatctcagccacttcaggagtctgaggcggaaggatcacctggaattcgagaccagcctggccaacaaaaatgagaccctatctctacaaaaaaattaacaatgagctgggcatggtggcatgcacctgtatttccagctatttaggaagctgagacaggaagatccctttgagaggtgaagccagctggacttctgagttgcgtggggacttggagaacttttctgtcttacaaggggattgtagaatgcaccaatcaacactctagctaggattgtaaaacgcactctggctagctggaggtttgtaaaatgtaccaatcagtgcttgtgaaaacgcaccaatcaggctgggcacagtggctcacgcctgtaatcccagcactttgggaggctgaggcgggcagatcacctgagttccaggagttcgagaccagcctgaccaacgtggagaaactccatctctaccaaaaatgcattagtcgggcgtggtggcacatgcctgtaatcccagctactagggaggctgaggcagaattgcttgaacccgggaggcagaggttgcagtgagccgagatcacaccaatgcactccagcctggctagaagtttgtaaaatggaccaaccagtgttctgtagaatggaccaatcagcaggacgtgggcggggacaaataagagaataaaagctggccaccccccagccagcagcggcaaccggctcgggtccccctccatactgtggaagctctgttctttcactcttcacgatacatcttgctgctgctcactctgggcctgtgccacatttaagagctgtaacactcaaggcgaaggtccacggctccgttctttaagtcagcgagaccgcaaacccactggaaggaaccaactctggacacaccttgagtacacgaatttgaaattacactgaggtgatcatgccactgcactgtagcttgggtgacagagacaccatgtctcaaaaatctacccagagttgggaaccactgatctaaaccattaaaatttttatttctgtcactaatgaagaattttctcattgttttgatattgctggggaagaaaaacttttaccctcttaggatgagttcttgggggcctgcaaattaaataaacaagagacgtggccaggtgcctaactcttttgagaggccagggtggaaagatcgcttgagcccaggagtttgagaccagcttgggcaacataaacgggaccccaatctctacggaaaaaaaaaaaaaaaacaaaacataggggaagtggtggggcatgagtacttacgggaaaacaaatgacttagaagatatgaaatgagctcttatgaaaatagatggaagataaaattttgttacaatgtctgttcacgtgtggtacccatttattgtctcaggataaaagtcagtctttcctggttgctcccgggaaggggattttttagctcttttgagagcccaggcttttagac

SEQ ID NO: 12434 - DNA, 10193 bp, Human
tcagtctccatcttcagaccccaccaccatttctacagtagccactgtggatctccctactccaggttctgcctcttccatgtaatgagccaaacttggccaaggcagtcaacaagcagcatgcatgttagagccaggaacagctgggtccatatccttcctctgctacccacttcattcaggttgctaagccactcaagcctctgatacttcatctatgaaatgggggtgacggtctctagtttatggagttgttgggaggtgttagtgagataccctatgaaaaatgcctgacatggcataggggctccccacatattaggcaacctttacctccaaccccactgacagccacacacctgcccatcagggagtgaggttgagaatatcaaaatatatatttgcaacagaaaatgatagagataaatagtaattgcattggggttacaagggtaggaatgatggattctgcctgggagagggaactagtctgagaacataactattgaccagggtatttcaagtattcactatgtgtcaggctttaacactatacacacagcctcatctgatcctcagaggagtcccatagggtaggtacctacagcaaacaggcttcaggggggcccaggagaccaggggtccccatgatccctgcctcctggtattcataaccttgagtaaggataggacctacccctgaccaatggaatatggcaaaggtgacacacgtacgtgattccatgtatggatcacattatatgagactgtgatgtcccttgtcttcctggcccactccactcccaccccaagtgttggttccttggaaaaacactggggatggaggtggaattgctgtgaaaacaagactcagtcctccacagaagctgcccagggagttcttcagaagtggttatcctacctgccatttacactggatcaggactgtccagaaatcattttcacatctccccagaagaatggcatcatctcaatactaatcttcacttgaactagaagaatcatgcttgtggttttcaaaaggaaaaggttcctattcatggtgcatttagaagcagcccagggtgcttatagaacggacctgcttcttgctatgttcttgagcttctgaggcctcttgacaaagtcgagcaagtaagacgaccaggccaagtgggcactctgggccccatggccaaggatgggctggccaggtggccacgtggcctccggtggccttgtttctgtgggctttatctgatcctgagctcagatgctgatagtgcactggcttattttctaaggagagggagcttgatttgtgcaggatgcgccttcaccagatacctccaggggcaagagtccactgaggttacagcgccccccgccccccatgcctctaagctctaagctcagagaagggtccctgacacagagtcctgttaaaggaatggccacagggataggagagaccagggtcgtgcatgccagctcaggatctggggcaggatggttggcagggggtcgtggggagcaaaggaggggaatcacctgccagaaaattgggcaggggtgctcagggaggaggctgcggagggactgggaccagtggaagggaggtggaataggtcttaggagccaaattccttgcagaggcctggggtgaagcctgggcagctctatccccgggagccgcccttttgcctccagcagctcccggtctagccacagcccctccaggagacccaggccgggttcctaactccgctgctctttggcctcgtccctgcctagcccctgctgcgggttgcttttttcccccctcctcctcctccctcctccctcctccctcctcccccttcctcctcctccccctcctcccccgactggccccgcccccactgccggccccgcccccactgccggcccgggccccacccacgccggagctgctccatttaaggagattgcgcagctggaaagctacacgtgtgagcctagaggcgggtcccggttgcagacttgccatggcctccgaagcttctgtgcgtctaggggtgccccctggccgtctgtggatccagaggcctggcatctacgaagatgaggaggggagaacctgggtgactgtggtcgtgcggttcaatccctcgcgtagggaatgggccagggcctcccagggcagcagagtgagtcctgggcacgaggggaggctgtggggagggctgcgcactgacccctgcccgtgtgggaccgcggtgggggtcagagggggccgttctcacccgcactggaaaactcacttctgtgcaggtctaggagcgcagcaatgtccatgcccagccctggccccaggaacaccccccgtaaagggaccacaggcacaagcttatccacatgagataatgtggtcctgcgtggtgaagccgaggctaaggtagctcagggcttagtgccattcccagtgcctgctgggaaggcccacaaatggggcagctattgagctgggctttgtgggatgagtaggagttctccaggtctagaaaggaggcaggagtagtataagcaaaagcattgcagcctggaggcaccaggtgggccaacaggatgaacatgacattggtgtcagattactgatctgcaaaatgagaataatatacctctgtggcaagctagtcacagacatgctcacatacatggctcaccgcctgaatggcctggggaagcatttgactgataacagattctggaaattaattcaggaggcttgggtggagtcctagattctttacttttcaaaagctccccaggtgataatgataatgactcaggaaacggctgtagatgagggctttagatcacagccagtctttgagggatgaagtaaatacagtagcgtctctggtgtgggtggcggtggggaattgattccaggaccgactgtggatgctcaagtccctgatagaaaatgacctgggtagtaattacatataacctcagcgcatcctctactatatttgaaatcagattactaataacacctaatgctacacctacacatcacttcaagctctgcttttgggaactttgtggaatttctttttttccccaaatatttttaatctgaggttagtcgaattcatgggtgcagtatccatggaaatggggggctggctgtaccttagtgtaatgtggtaaaagcatatccggatatttaaaatgccatttagggctgggcgcggtggctcacgcctgtaatcccagcactttgggaggccgagatgggcttatcacgagatcaggagatcgagaccatcctagccaacatggggaaaccccgtctctactaaaaatacaaaaaattagccgggcgtggtggcggacgcctgtagtcccagctactcgggaggctgaggcaggagaatggcgtgaacccgggaggcgaagcttgtagtgagccgagatcgcaccactgcactccagcctgggtgacagagtgagactccgtcccaaaaaaaaaaaaaaaaaaaaatgccgtttaggtcttcgtaaacaattcactgcctgtttgtttgttttttgagaaagtcttgctctgttgcggctggagtgcactggtgtgatgttggctcactgcaacctccacctcccaggctcaagtgattctcatgcctcagcctcccgagtagcttggattacaggcgatttttttttacagttaattttttttgttattttcaggagagacaaaagtttaatcatgtgggccaggctggttttgaactcctgacctcaagtgatctgcccaccttggcctcccaaagtgctgggattacaggtgagccacctcgcccagccagttcactgacactttaaacaatataacacatttcctaaaaaaagttcaaataggttatttcaaaaaatgttggtagagaacatggaaaggcttttctgtacatacactaaataaagcatgcaaaaattgtggagcaaatattttaagtttttcaaaagcctgaaaaagtgttaatggagggcactgtaaaatggtgcagccactatggaaaacaggatgaggatttctcaaaaaaagaattacggcataatccagcaatgccacttctggatatatacccacaagactctgaagccggaacttaagcatgtattcatacatccatgttcacagcagtatcattcatactagccaaaaggtggtggcagcccccgtgtccattgatagatgaatgggtaaacaacacaaaccatgaagtattcacccttaaaagtcagacacacggatgaaacttggagccattatactaaatgaaatatgccagtcacggaaggacagattctcttgtatgaggtactcagagtggtctcattcataaagtggaatggtagctgccaggggctggagggagtcgaggatgggaagttaatgttagtaacaggtacggagtctcagtttgggaagataaaaagttctggaggtggatagtgccgacggttccacatgtcaatgcacttaatgccaccaaactgtactcttaaaaacagttggccgggcgcggtggctcacgcctgtaatcccagcactttggggggccgaggcgggcggatcacaaggtcaggagatcgagaccatcctggctaacacggtgaaaccccgtctctactaaaaatacaaaaaaattagccgggtgcggtggcgggcgtctgtagtcccagctactcggggggctgaggcaggagaatggcttgaacctgggaggcagagcttgcagtgagctgagatccagccactgcactccagcctgggcgacagagcaagactccgtctcaaacaaaacaaagcaaaacaaaaaaaacagttaagattttttttttttttaaatgattcagtggaaatagaatggattcttcaaataacttagccacgggtgggataagggacctacttagtaagtattttttccccttctttcttaaaaatagatcgatgtcttagggtgggaattaggcttcctgggcgacacatctaatgcaaagatcagccacctttttctgtaaaggatctgatggtaaacattttccacttggagagctatgctcttgcagctactcagctctgctattgcagtgcaaaagcagctaaaggcaacggtaaaggaatgagggaaggagccttagtttatttacaataaagctttatttgcaaaagcagatgcaagccagacttagtttgctgatctctgatctacagtcagaatacacagagaaggagagattttgccgtataatttaaaatacttctctttgcaaaagcagtccataaaaaaagtgaggacaacaaactgagaaaaattattcacaacatgtctgattgatagagcactaatattcttaattcaaaaagacattttatcacaaaagaagacaaatacttagaaaattgtgcaaaagactttccattttgttgcataacgtaggaagctttggttttacttttcctatcatctttctaacttccagtaccagcctaattttgttatttttattattatgtatttattttgagacagagtcttgctctgtctcccaggctggagtgcagtgacctgacgatagcttacaacagcctctacctcccaggttcaagaaatcttctcaccttagcttcccgagtagctgggactgtaggcacatgccaccatggccagctaattttttattttttgtagagacagagtctcattatgttgccgaggctggtcttgaactcgtggcttcaagcagtcctcctgccttggcctcccaaagtgttgggattacaggcataagccactgctcccagccttatttcgtatatttactataagtgtgtgaaggtcatgatcagaactgccatatattttggcgggaaaatctatcaccctcagatccaggagtccatggatatcttgtttttaaaacgaagatttaaaaaattacggcaatggcagagatggagccccaagagaatactcagctttaacccaaggtgttgacaggttggaaacagtggctaaatttggggattgcagtggggcgaggcagggtgcaggtcagagggggccagaagggccccagccatcctagatggagccacaagtaccagtgccaaggctcttggtctggaattctgaaaacatttacctctgaccctggcagcccactggccattgcttgtgtgcagcccagttggcagggaaccctatccatgatttgccgcctcttttctggtcccttcagtatgaacccagcatcacagtgcacttgtggcagatggcagtgcatacccgggagctactctcctccggccagatgcccttctcccagctgcccgccgtgtggcagctctaccccgggaggaagtaccgagcagcggattccagtttctgggaaatagcagaccatggccaggcaagtgtgtggtggttctaggtgaaagcgacaggtggcccctggtgactgccgtggccctctctcttctgtgcccctggcccccttggggttcttgtctgtcctcttcctgttgctcaagtcttccttcaaggaggcctgagtgtgtgtgggtggatcggtgcatgagttcccatgtgggatgcaggcagagtgggtgagggagggagggttgccttccctgggctagggaaatccataagctggagttcccacctgcctcacccctgcctgctgctgctgccagcctgcatgggcggccgttaaggccaactggaagagcatctcccagaggttctgatggctgctccctctcctgcagattgactctatggagcagctggtcctaacatatcagccggagaggaaagactgacactgggagtggctggtatgttggggccctgtgcgtctcggtgtagggatcagacgaaagtgagaagacctctcctcttttcagaaagacggcgtggcctcctcctccctgctgtttgctgagatttttcttacatagccacctgtcacctctgttccccagccccttggatgtgatggtacacagtgggtgggcccccataataagttcctaaagcatgggatctcatcgaataagactcatcatttaatccttgtgagaattttgtgaggtgtacgtgttaatgtcccatttcacgacgaaaagacaagactctggggatgggaatgacttcctcgagaccatacagccaggaaatagcggtgaatctagtgatctcgggtccctagatttaaccatggcactgaggtgccgtgtgacggtggccttggaggacccagcactgacccatagagggctcctctcagatgggcagcagcttggagcaggccaggcagggcctggtccattggaggggctggcactggacttgcctttgaccccagcagcttggatggggtgccgggctcccccatagttcactgactgtctcctttggtcttctcgcaggccctgctggccctgcctcttctggcctggtgtctcctcatgccccctcagtgaggatcttcatgtacctgctcttctgtttgcacacccagcatagcctccttgcaggcagaaggcagtagggcccctgcacactcagtttctctcgttttccttagttatcagtcctgtcctgtcccactcaggtctgtacttagggcagctggcctggatgggcttcactggggccctgtctgtgtgctgagccagtttcccctgctggctgcaagctgtgggttctttctcctctgtgcccctcatgctgatcttctagatgccactcccaaatccccttcatacccaccaggatgtgtgcccagccaggcctccagcacccccagtgcagctcgtgattggaaactcaccatcggcaggcagtggttcggtttaagagatggcattagagggagcccagtctggatgtggacttggatgccctgtgggtatcagttctgctgacactttggcccgaaatagatccagtgctgagcaagcaatgtacaccagagcctcagtgagcccatctgcacagtggggagcatggagggatgggtttggcctgtgcttctgcttattcagtccttcagctcacggaagggatgctagtccgtgaaggtgacctcacagtactggttaattaaactttattgctcactgtccacttttgtgctgaattggagcctctctttgacctctttctagcatagaaatggcagcttctggtaccgaaatgttaaggtaacattttaatgatccatttcatatttttccacactgggaaggaaattgtgattggtccattcagcagcaggacgtcggcgggagttaaggaaggggaggagactcgtgcgggctctgggtgaagccctgctgtgaaagggcaggaaagcccgtagtggtcacaggagaaccgggagcaagggagagctcccaaagcgagacaatgcaacagcatgtcattgcaggagatgcagaatgcaggtgcaagggaggaagggcccatgtgtgggagagtatgacatgacagaggagcagagtccttgagcagggagggatgaggcagggggccaaggcactgagcagtgccaccattgtgaccaggaagaagaggacgatacagtgcaggtcagggtgaccatgcagtggtggcaaggagaagagattccctccctcatgtcgctcacaagaaaaaaatcacccatgggctgaaatcccaaccttacaaaatgaatctgtaaaagcattcatagaaagtttggggaaatatgttcatgaacgtggggtacagaaaaacccaagtaaatcacaggtgtaagcaaaagacagtgtaagacaaactttttcaagtgaagcatttctgtatgacaaaatattaggaagcatcaatcacaatttagcatggtatataaggcacgccagtgtttgcctggagcaggcttgctcaagcccagtggtgttgcggggaggggctgtcctgtgccttgtagaatgtttagcaacatccttggccgccacccactggatgccagaagcatctcctgaccgcagcttgtgagaaccaaaaatgccaaatgcctcctgagggggcaaaattgccccgggctgagaatcactaccctagataaacacttgcacatgtggtatacacaagaggtatgaagagagagcactgtggtaagagttcagattccacagtgttggcatggttaaagggaggccccgtgagcaggagctgggtgagcactgcaggctggcattgtaccttctgctgagaagcttatgttgatctggcagcctggtctttgaggaaccctcttcccctagcctgccttccctcccactggcctgagtcgggggtatgcaggagagggtgcgtcatgcagcatgcatcccagtcaacataaggatttcatgatgacacagggtctcgctctgtcatccacgctggagtgcagtggcgcgatcgcggctcactgcaagctccgcctcctgggttcacgccattctcctgcctcagcctcccgagtagctgagactacaggtgcccgccaccactcccggctaatttttttgtaattttagtagagacggggtttcaccgtgttagccaggatggtctcaatctcctgacctcgtgatccacccaccttggcctctcaaagtactgggattacaggtgtgagccaccacgcctggcctaggaaaggtttttattgttaaatgggaaatttacaaagccagagagggaaggagacattgttttcctacccacagaaatgtgcctcccagaaaggagccggctctgctggatacccagtgggtgtctgcatccaggagagagaattcagtcccttagctgccttcttatagtgcaggctgggtgcaagtgcaatgatgaaggctgcacagacttcctgggtaccaggtgggtggggtctgggaatgccagccgtccagtgcctggacacttggggtctatatgtaactgtaatagatttgttgtcaaatgcgcacatatcccaacactgggtcgcagcagagaaagcagttgaatggtagggtcaccgaaggaggggataggaggaaacctcaaatccatctcccagagagtaggactgggccagtggagattgttgattgattgaaaagtgcaggatga

SEQ ID NO: 12435 - DNA, 25111 bp, Human
atgttgaatattggcccccactctcttctggcttgtagagtttctgctgagagatctgctgttagtctgataggcttccctttgtgggtaacccgacctttctgcctgtcattaacattgtttccctcatttcaactttggtggatatgaaaattatgtgtcttggggttgctcttctcgaggagtatctttgtggtgttctctgtatttcctcaatttaaatgttggcctgccttgctagattggggaagttctcctggataatatcctgcagagtgttttccaacttggttccattctccctgtcactttcaggtacaccagtcagacgtagatttggtcttttcacatagtcccatatttcttggaggctttgttcatttctttttattcttttttctctaaacttctcttctcgcctcatttcattcatttgatcttccatcactgataccctttcttccagttgatcaaatcggctactgaagcttgtgcattcatcacatagttctcgtgccatggttttcagctccctgaggtcctttaaggacttctctgcattggttattctagttagccattcgtgtaatcttttttcaaggtttttaacttctttgccatgggttcaaacttcctcctttagctcgaagaagtttgatcatctgaagccttcttctctcaactcatcaaagtcattctccatccagctttgttccattgctagtgaggagctgagttcctttggaggagaagaggcactcgatttttagaattttcagtttttctgctctgttttttccccatctttgttgttttatctacctttggtctttgatgatggtgacatacagatggggttttggtgtggatgtcctttctgtttgttagttttccttctaacaggaccctcagctgcaggtctgttggagtttcctggaggtccactccagaccctgtttgcctgggtatcagcagcagaggctgcagaacagcgaatattcgtgaacagcaaacgttgctgcctgatcgtttctctggaagtttcgtctcagaggggtacccagccatgtgaggtgtcagtctgcccctactggggggtgcctcccagttaggctactcggggtcagggacccacttgaagaggcagtctgcccgttctcagatctcaagctccgtgctgggagtaccactactgtcttccaagctgtcagaggtttctgctgccttttgttcagctatgccctgcccccagaggtggagtctacagaggcaggcaggcctccttgagctgcagtgggctccacccagttcgagcttcctggctgctttgtttacctactcaagcctcagcaatggcaggtgcccctcccccagcctcgctgctgccttgcagtttgatctcagactgctgtgctagcaatgagtgaggttccatgggtgtaggaccctctgagccaggcacgggatataatcttctggtgtgccatttgctgaggccattggaaaagctcagtattagggtgggagtgacccaattttccaggtgccatctgtcacccctttccttggctaggaaagggaattccctgaccccttgctcttcccaggtgaggcgatgccttgccctgcttcagctcacactcagtgcactgcacccactatccttcacccattgtccaacaatccctagtgagatgaacccagtacctcagttggaaatgcagaaatcatccatcttctgcgtcgctcacactgggagctgtagactggagctgttcctattcggccatcttggaaccacccccccaatccaatgaatattaatgcctcagctgtcttagaaagtatgataaatgtgttcagcataatccccattgctacttagcaactccaagatattttagcaatttactatacaaactttatgcaaatattttggtcttgattcaaattcctaagttaagcagatacataaatacctttggtacatttccaaaaggtttgtttaacatgcaaaaatggtgttcagtctgaaggtgattctcttcctatccttgcttctctcgcctgtattgaaaagctcactggtaactttgaataacaatggatatgatggcattgtcattgcaattaatcccagtgtaccagaagatgaaaaactcattcaaaacataaaggtaagggaaaattttattatccacatatttttatttcaatatgtattttcaactcatggtgcctaggtatacacattcattgagtgataactttccaaaatttcttcaacagtatttaccatttatatagcatttatctaaactgtcagattaatacctgctgagtttaaatgtgttttattatatgttaatactattggccattccccagtgaattattaaaaggctgaactaatattttttcaactagttaagctaacagaaagacattacagcaagtagaaaattattctcaaattttatcttcataaagttacttttataaagtttagctaactagtctacacttaagctctagcgttttatcctatacattttttcagttgttcatacttgttcaaactctggaaaagtaaaaaaatcatatgtatcttatcttaaagaaaaaattacacattttaaattgatgtaccttctttatttgcattattcagtataataaaaaacactttatatatcactttaatatatactatcttctttgatcctcccaatatccccatgaggaattcaaaaacaagaattattacccttgtataaatgaagtgatttgtcaaatctcacaataagtgccaaaactgggatctgaagccaatgagacctatgtatttctattttcatttccacttggtaaaactttgccttttatgaacacactccatatgagaagataactcaaaataaatctagcaaaatttttttttcaattgacatcaattataataatctaccagactttaaactcccaattaatctaaacaaccagaagccattctgtttgatcaaatgaacaactttaccaacagcctcccagtcttaatcaccttaatctcacccagcaccctcatttccatctccaacccatcatgctgaatgcaggtaaaaaattttaaaaggtggtttgagcatatgaaaataaggagtttacagactgaagagttgtagaaaaattcaatctatttttcaattagttttcccaaaatgtttggggaaaggaggcttagatttgcttcatctagttatatatgtactgttatgttcatttcactgtgaaattattaccacaaggtattttaaattttgtcaggaaatggtaactgaagcatctacttacctgtttcatgccaccaaacaaagagcttatttcaggaatgtaagcattttaattccaatgacctagaaatcaaaatctgagtacttaatcccaaaacaagaatcatatgaccaggtaggctatttcttctaactcctaaactgcttctttcctcctgtgcttttaaaaacttaatatctgtaattatttaataattactaatcactaatgtagtaattaaattagtaatataacttttcttaatgtatatgaaaaaaagtccttgtttctaaaatctcttgtttctattgttttcaaaatttgtttttgtttgttctttttctttttaggcagatgtcatagttgctgatctttacctgaaatacggagatgatccctatacacttcaatatggacaatgtggagataaaggacaatatatacattttactccaaacttcttgttgactaataacttggctacctatgggcctcgaggtagagatatctatgatgtacttctgttcttatttccactggtggaaaaaaataactctatgtttaatggcatttaaaaaaaaattttaaagaagccaggcacagtgactgacacttgtcatcccaacaacttaggaggctgaggtgggaggatcacttgagcccaggagatagagaccagcctggacaacagagtgagcccccagtctctaaaaaactaaaagtaaattttaaaaactagccaggcatgagagtgcatacctgtagtcccagctacttaagaggctgatgcaggaggatcgcttgaggctaggagcttgaggctgcagtgagctatgatcatgccgctgcactctaatctgagcaacagaacaagagcaagatcccatcattcaagaaaacaaaactaagaagagaaaaataggtagtaaataatacctttacgtgaaaacatgctagttatgctcctaattatatttctctgtgtgtgtgtgtgtgtgtgtgtgtgtgtgtgtgtttaataataaaatgagtcgtttattggcaccaactcatttcaacttttttggcctaataaaaggcatcaatttctggagtaccttgactcaattaagttggggagaggtttaagagaaatataggaaactaccttaaaatattgtaactataaatttataagtggcagtattctctcacaggtagagtatttgtccatgagtgggcccatctccggtggggagtatttgatgagtataatgtggaccagccattctatatttccagaagaaacactactgaagcaacaaggtatcattgtattgagcaaatctgttttcaaaatttttcacttatgactctttaattttctatgctaggcaaacaaaggctatctcaggtaactacctgggaaagttcaaacagttcattgcaatatccaacctgccccatcatgtatgccaccaattaattctagagattccaccttggcatcaagatgaatcaaaaacaggaaataatttcagtattcacagggactgtgctataacatgttatgggcagaggggaaggaaaaagctgtagcctaaatcccaagatatctgagaataggtggttcaaccctacccactcttttgtttgacttgattcatcactttttaaggtaaatctgtttcactgaaatcagttaagctgctagagctcctttgtaaatatcatattatacttttcatttaatcttgatcttaaagaaagtacttttcgtaacagtaaggtagtaagttgattttttaaaaatataattctaggtgctgcaggcactattatgaatagatgagatgtttacacttagttaaaaatatcaagcacatggagtatttaaacaatattgaagaacagtggaagttaatgtaataggaaataagtctttgcgatgaaaatgtatttgaggaaagaggggtaatggaaaaatgcctctcatcatctccattgtgttgttcgtttgatctccgcggagctgcctgcagtttttcacacagactgggctcctctcagtgcaggacactcatttctcttaacttcacctacacaactcctcccttactcagataatgcctgttcatcctttaagactcagtttaaatatttcttacttaaatgtctttcctctccctccatttggggttaaattcccttaagagtactcccacagcatgtgtgggcttctctcacacgtatgtcactgggcagtaattgtctatacaattttattttccccattagactttaaaattcttaagaactgcacatttttttaatcctctggtgttggacctggcataaagtaaaagctaaacaaagaatgtatcaaacaacaaatttttgataaattcatgaaaaataaatgagtttccttataatcagtcataaaaatagatatattagtaaaaacaagtatctaaaacatttattgagctcctactgtgtgtcaggcactttcaagcagtgaagtctcatcatatgtaagtttaattttcaagcttactcaagaactaaccctctggaaaatatgactcctcatgtccctaaatccttgcaatacaaacttattaaaatggattaatgttatgaagtttaatattaacacagaatgggaggatatcctgcatataaacagaaactttagaatcctgtccctgtaccctgaccctcattccctgccaaggacttgacaattatttttaccataaggaccaaatggtttgaatgcacaagccttttcatgcggggtttagttttatttcttccaccagtttagtgaagtggtgctcaagatataaattacaaaatgctataaacacaaaaccatgaataccacatacagaaattgaagaggattttaagcataatattgtctttccctttcctattaataagcaattccgctgtaccttttaactcatctaatctttacaacatctctctggttaggaattaccatctttagctcaaagtcacaaggataatagatttattgattgcaatgaccaattaatgtttaataaatatgaactgacaacattgtatcaattgaaatcgattacaaattgaggtagaatattgtgcctatttctgtcaaaatgtaatgtttggtacatgatctatggcagttgtcactgaaggaaaaattttaggatgttggtcttcattcatgatttgccaattcttcgtatatatataatctaattctttcatcatagatgttccactcgtattactgtttacatggttttgaacgaatgcaagggggccagctgtatagcacgaccattcagacgtgactcaaagacagggctgtatgaagcaaaatgtacatttatcccaaagagatcccagactgccaaggaatccattgtgtttatgcaaaatcttgattctgtaagtaccttttttccagtttctcaaaggaatccttggggaaaaattaattagagaagctggattttctgctgtgaaattatgcgtaccaatagaaaggcagaaaattactaaggcaattaattagaggtcattttctctggcatgtatcagggtgtctctggaaattaccctgtcttttcttattaacctatttcttttattcaaatgtagcactgtagccttctcattagagtcacacaataaattcttagaacacatctcttccctcactgacttctgtggacttctgtatagagttacaatcttacttttaattccttttctaagtgttagccatattacttttctaaagaaatttataatgtagctttgaaaaggattgacattttagattttccattaccttcacactaaagcataccaagctattgcaaagtgatattgtgaaaacacatagggctctttctccactgaaaagacttaagaaaaaaaaaaattcacaattaccaatgtgtctaaccaattaaataataacacaccacaaaaaagttgaaaactaatgtttgacctgaaatatctgctttaaatatataaagcttagtgcataagaataggtaccttggagtcagatagacctgatattgaaacccagtctgtcattttaaagctgtgtccactgtgggaaaactgctaaatctgagattgagttctcttatcttttatatgggaattataatacctacttcacatagtcattcgtgttgggtttaaaagagctaatataaagtattagcatagtgtttagcacaagttgaatgcgctataaactttaagtttttaatttttaaaatttattaaatatttgaaaaataaccagttgtttcttcccatggataagtctaatcttaattaatacaaacatattgtatttacctaatgaacatttctaaacatataaaaatattttaaaatatgaaatatatgaaagttatcaaaaacaacaaatcaaaacaaagtacactacctctaaatagtgggactaacttacttcaaggaagcaaattttcacataccaaattttcaaaggtatatgacatatacctttacaaacctctgctatagaagtatttgttggtagtgattggtattttcatataccaatatcaaaatacttctatagaccgaggtttgtaaaggcccagtatctctgataaaatttaaaattctcttgggcattaatgataaaaggcttgactacatttgacacacgagtcaggaatgttccctttaatctgctaaatctggagcaacaaaggctagccaaagagttatgcgtacaaatagatatcaaatcatgtgacacaagaggataactagaatactgtatgtactgcctgatccgtaccataaattctaaaagcatttgaccatcaggagataactcacgctgcctctgggacataaataataatgaagaagattatggagctgaaatatggaggtcaactaattatataagacatggcccagagataaaatgattccatttccagaataacactaacttctaattatcataacataaatatattgcatagcatctgtactgagggcatgaattcagagctacgaaagatatgatctaatatgctgaatagtcaactccatgattttgtttccttattatttattattccttacgcctagtatttactgcattaagagctgggaacacacatataattaaagatgactgttcttgaggaactcagtttacggagaaagagatatgataaaataagtacatattattaagtgggaagacatatatagatatgaaccaagttttatgaagcagtaaccattgccaactggaagtcagaaaacagtttctgaacagtgagttttgagtggggatttgagaaaagtgagtatgtatttgccaaagtgagaaggggaagagtattctatacaaagaaacagatttacaaaagcaaagagtggagtaaggcagggatgctgtgcatgattctggaagttcagcattgcctaaattatttgcatcatggtcattcaagattttaacacttattagaacaactttctggcagataacagtaaaataacttgagaaactggtgcttttttctgatttgcacaaaattaccatttgggttagcaaagaccctaatgaaagtttctggcatattctaaggatataaagaaatccagtatggtagaagcaaataatacatggtgagtaagaggcaggaaattaggttgaaacaaaaaatggggacatacagagctaaggtgtttgagttttatcctctcagttttagactggtgatgtgataagtttaattatttcaggaaagtaatcctactaattgtgaaggatgagatagagagagttgatagtggaggcaagggagaccagttggaaggccatagcaacaggtaggtaagaggcccaaataaaggcagtggcagtggtaggggaaagaggaaccaggtttgataggcatttcataccagcaagacttggttatgaatcactgctttgattgcaaactacatttttctcccatccaatataaccccatttgggaaatgtatcatcagaaacaaagcaaactcataaaacttagataaaaggtattcaaatgtaataatttagttcttctaattctgagcttacatttggatattttactttgggagggcattaaaataatgaaatgactaaaaatatttcttgtaagctgaggctcatcttgcagtagcaagatgaattccttcttggagaccaccctagtttatgagaacatttttccaagttactacgttttcaatatttaaaaaattttcacagattctatagtaatgaaatattcattggcagaattactggatacaattcaccacttgcctctaacagacaaataattatatttcctcattttctccctatactttcattcctttttcaggagtattactgtatgtcaaaatttgccagagccaatagcaatccaggttgtagaatagctgtcctcaagtttttgatcaactatgaagatatggaacatacctagataattaaagaaggccattttctctataccatttttaggaggtagctagaaattaccacaagccctgcccctttttcctcaaacttaattcaaggcttgagctcccccaaagtttagaagggaaagtaaaaagttaacataagcagtcgtgccagctgccacaatccaccactgatgtaactatctataaccaaaagaatcaccaaaaatctttaccagtacatattgatagctttaccttgcttccgttccattctgatatgcaaatggatgtcagaatgttagattataaagtagtttttaactatcaggagataaaatctgtggatgatatgtatgacagataactacatatttgatgcctcacaagttattgtaatcttgtcttctaattgatttttttccaggtgactgaattttgtactgaaaaaacacacaataaagaagctccaaacctatagaacaaaatgtgcaatcacagaagcacatgggatgtaatcatgagctctgaagattttcagcatttatctcccatgacagaaataaatttacctcgtcctacattttcattgctcaagtccaaacagcgtgtagtctgtttggtacttgataaatctggaagcatgaatgcagtaagatagtttttggttaactgtcttaaattatttaagtatttaagctactagaaatataagtattaagtatttaggctgatggaaatataatcttaggtttagttttggtaacaaacatacatatgtatttatgttctaataaattttagcacataatcttatatagataagtactagaagacaatatgccaacagaaaaatgttgtaggctgggtgcagtggctcacacctgtaatcccagcactttaggaggccaaggctggtggatcacctgaggtcaggagtttgagaccagcctggccaacatggtgaaaccctgtctctactaaaaatacaaaaattagctgggagtggtgatgcacatctgtaatctcagctacttgggaggctgaggcaggagaattgcttgaacccaggaggtggaggttgcagtgagccaagactgcaccactgcactccagcctgggtgacagagattggattatgagtcatttttattccttaacttttagttctaactagaaaaattatagccaagcaagaaaatgaaaatcatccataattctgtcattgaaaatatgatactttagtcttttctttgctaatgtatttgttttccctcctcaaaaatatgattatattttatataatgttttataatctgatgatttttacttaatatatctttaatattccccatgaaaaaaatgattccatgacataatttttaatggctgtataacatgcccatactataatttcatcaagcaatctcctgttgttggacagttgggagattttcacttgttattttttaaatgagcatctttgtatgcatttataaaattatttctttaggagaaattcctcaatatacaattaaataaaaaggtatagatttttaaggctttttcaagtataactgaatttttaagattttctttaaattttttaaataaaatgaagaagctaaattttaaaatacaaccaatcaattattatcatgacctatggtccataaatggtttgccgttcattaatccatcaagatttggagagtcttgtgagttattcacaaatctttttcttacaggaagaccgtctctttcgaatgaatcaagcagcagaattgtacttgattcaaattattgaaaagggatccttggttgggttggtcacatttgacagttttgctaaaatccaaagtaagctcataaaaataattgatgataacacttaccaaaagatcactgcaaacctgcctcaagaagctgatggtggcacttcaatttgcaggggactcaaagcaggatttcaggtaaaataaaaatatttttaaaatatcatttgccatttactattgcttttaattttctccagttacctttgaacaaagggcatgagttcatgggcccctcaattaataatattatgacctgatcaaggtaaatcatttatgggaagaaaaaaatagcctttcctactgtttacaactagaccctctctgagtatggctattccaatgacatactcctgaggtgctaagttgcactggggagtggttaagtaagtggggaaaatttcagcctgcacacaatcatgattttattggggagctccccatttttctaacactcccacagtctgagtttcaaggatcagaaaataatgccaatgaggggattatggaaaagggaaattagtaacatttccatatgatggataaggaaagccccagtttatcaagttaaattgacatttaaaaatcacaaagaggctggatgcggtggttcacgcctgtaatcccagcattttaggaggccaaggcaggtggatcacctaaggtcaggagttcaagaccagcctgaccaacatggtgaagcctcatatctactaaaaaacaaaaattagccgggcatggtggtgcaagcttgtaatcccagctactctggaggctgaggcaggagaatcgcttgaacccaggaggtggaggttgcagtgagctgagatcgcaccattgcactccagcctgggcagcaaagcaaaactctgtctcaaaaataaataaataaataaataaataaataaataaataaataaataaataaattacaaattttaaaaattaaaaaaaattaaaagtcataaaaataagccaggtacggtgggtcatgcctgaatcccagcactttgggagtctgaggcaggcagatcgcttgagctcaggagtaggagaccaacttggccaacatggggaaatcttgcccctacaaaaaataaaatcagccaggcatggtggtgtgtgcctgtagcccccgctacttagggggctgagatgggaggatggcttgagctctagaggcagagattgcaatgagccacgatcatgtcactgtactccagcctgggcaacagagtgagaccctgtctaaaaaaaaagaaagaaaaaataatcataaagatagaggtagctccatacgcaatatagtaccaaacctaacaaacatagattgaagtttaatgtaattaaaattgtgaactcaaaaaattgggagcacctttggagcactatacccaattgcctccagtactcatttgaattccttccaacctaactttcatttaagcctatttactgtcatgttttaagccacaaaaacagaaaactacttccttcactgacctctctttgcctcaaaatggagattgctagtcttatccaggccattgattaatactacatctcaactttcctcatagtgtctatttgtgatgaaatgtgttagtttaagaaggcaggaaatcctgagtaagaagaacaggtttattcttattttaaatatattaagatatgggccaggcatggtggctcacgcctaatcccagcactttgggaagcagaggcaggcagatcacctgaggtcaagagttcaagaccagcctggccaacatggtgaaaccccatatctactaaaatataaaaattagccaggcatggtggtgggcgcctgtaatcccagctacttgggaggctgaggcaagagaatcactagaagctgggaagtggaggttgcagtgagccaagactgtgtcattgcactccagcatgggcaacaagagcaaaactccatctcaaaaaaaaaaaaatatatatatatatatgtataaagatatgacattctataattaataacctggctttttcattatcaggcaattccccagagtaatcagagtactttcggttctgaaatcatattactaacagatggggaagattatcaaataagcttatgctttggagaggtaaaacaaagtggcacagtcatccacaccattgctctggggccgtctgctgacgaagaactggagaccctgtcaaatatgacaggtaaacctttggcatatagtttgaataaaaaataaatttctagtctctcccattccaggggttctttctctataaatctgctcaaaattttcatatcctaaaaattaatctttgtcccttcttcatccttcagattaagttcttttccctttcttccacttcatacaccagtttttttctaatgttatttaacatttgctgtcttcattccccgcccagtttctgccaatgctactaaacagaaacttatttctctatggttactcaactggaagtcaaaaattattgcttaattccaaaatactacccaatcacacagtagagattttgacaatcttcttttatagatgaggaaatggaaacctagagagtgcaaatgatttgccaaaggccatagagtcctgattctcaattcagagctcttccaccgtactaccctattcttgcttcaccaaatcttgctaaatcttcgtttggaacatttctgtatttcacctttctatacaatccttctaccactgccattataatccagcccttacaattccctgactgggatacttcaataaccttccagcttatttttctgccatttatcagttcaataaatatgtattgactgttgtatttgtggcagtcacttgcgttaattcttgccctctgcaatctatcctttcctaactccttacacctaagtaatctctctcttcattaatttctacgttatttatttcctgcacttaatttttaatttattgtagactgtaattctctaattgttttggtgtaccttagacccaactagaagataaacagctggttcagaactatcttaaatttcatttttataacattgtttagtgcttagaccagctttaccaatgcggcaggcacttacatttgatgactgattgatgtaaaaacaatacaatttggcctgttctttaaagtttcttttattcttacttatctttcttattttgagcaaggttttaattattattgtaggattacataagggacactgatatactgaaagttcataaagtgctgggaagttcatcttttgtaagtttaaaacaaaattttaaaatagattttaaagtgtattgatgagagcaaaataacaaatatgacttttccacttaaaattcgattttaggaggacatcgtttttatgcccataaaaacataaatggccttattgatgctttcagcagaatttcatctagaagtggcagcatctctcagcaggctcttcaggtcagtgtaaaaaaaaactattttctttctcacagttgtaataaatttatattatcctaattattaactcctatctctcaaataattcttttgcctgaaaatatttcagatatgcagaagaaaaacttccttactgaatttgattttccataacacttaaagccacatcttctcccgaattcttctattctttagaattaggtatccttttcatttggaaaattctttaaaataactcttagttattttaattgaaatcttaaaaacaaacaaaattactctaaactgactaaactcggaaattttattaactatgataacaaatggatttcatgtgtttgttgtttttatttaccgaacagttggaaagtaaaactttgaatatcccagcgaagaaatggataaatggtacagtgcctgtggatagtacagttagaaatgatacttcctttgttgtcacatggacgatacaaaagccagcaataattcttcaagatccaaaagaaaaaaatatactacctcagattttcaagaaggtgaactaaatattcggtctgcccgtcttcgaataccaggtattgcagaggtaggtctattattttatgttctctaagttttcttaatcaatttctatttttaaaagataaaaataacatagataacatcttatacattgccaatattaaaatgatgacagatcatctgtaataaagaaatcaaatggaataattagggattcatattcatactatttactagtttgtgaaattcaatattaaaaatcatgattattattctgcttaaatttgtaaataattttgtattccaaacaaaaagtaggaaaatattaccaaagctctcagacagatttttttttaatgtttcagacaggcacttggacttacagcgttcgaaacaatcataccaaatctcaattgctaactgtgacaatgaccactcgagcaagaagccctaccacactcccagtaattgcaactgctcacatgagtcaaaatacagctcattaccctagcccagtgattgtttatgcatgagtcagtcaagggtttcttcctgttctgggaatcaatgtaacagccattatagaaaatgaagagggacatcaagtaacattggagctctgggacaatggcgcaggtaataagaatctacatcaacttccactaaacttaaaatcctcctacagttctatgacctagaagtcaatatttcctgtatttgctaatgaatcatatttttaagtaaatgaaatttaatcctaatgttttaaaaacttttttctcagttatcttgacaactcatagacatagcacttatgccatttttaaattttatgaacaattttgctttttccatggaacttaagagcacaatttttctctattttcattaatgtcagtgtttcatatatgctttcttcagttgctttttcttattttgataagtattttttatgaaataatagtaacagctaatattaattgaatcccttccatgaattagacttttccaaaaacacagagttagcaagtggcccaagctttcaaccaaaatagtctgattccagaattcatgtacttaaaacgctgtgctacatactatctcccaaattactaacattatcagtgttcataaacagatatgactgtcatttttactttattgtatgactaatttttacatttcattatcaaggtgctgattctgtcaagaatgatggcatctactcaaggtattttacagattaccatggaaatggtagatacagtttaaaagtgcttacccaggcaagaaaaaacacagctaggctaagtcaacaacagaataaagctctgtatgtaccgcgctatgctgaaaatggtaagtagcactaaaatagaaatgtgtcacttgtttagataaattccatacggcaaacattgaaaatataatgtactacagaaagcccaagtatataaccttgtaatcatctgtatgtttcaaaaccatgttgatattagtagacctagcatagacctatgtttccacatattttgttcacatctccctgagttcatttcatttacattgaaaaaaaaattactgagcacctactatgttgcaagcactgtgcttaggtgctagagctacaaagacaaaacataatcctgttcctcaaagaatttgcagtcaagtagtagagacagagaagttaaaagatagttttaacatagcataatgtttcctcatcaattttaaaatatgaataaacaagtgttttctcagtaaaaactgttactttttcaatgtctgccaatcaatattaagcctctacagctgcaagatcagcttgcaagatgaataggcaccgctgccgggcgcggtggctcacacctgtaatcccagcgctttgggaggccgatgagggtggatcacctgaggtcaggagttccagaccagcctggcctacatggctaaaccccgtctctaccaaaatacaaaaattagctgggcgttgtggcgggcgactgtagttccagcgactcgggaggctgaggcaggaaaatcgcttaaacccaggaggcggaggttgcagtgagccgagatcacgccactgcacttcagccagcctgggcgacagagcgagactccatctcaaaaaacaaaacaaaaaaaataaaaaataaaataaaagagtagacatggcaatatgaaatattacaaaattttttcttggtaggaaaaattatactgaacccatccaaacctgaagtcacagatgatgtggaaggagctcaaacagacgacttcagcagactcacctctggagggtcgtttactgtatcaggagtgcctcctaatggtaatcattctcaggtgttctcacctggtaaaattgtagacctcgaggctaagtttcaaggagatcatattcaactttcatggactgcccctggcaaggtcctcgataaaggaagaggtaagtttgacattacgttttaaaatatactaaaagaaatcccattggctttcatttgctaagaattttctaatggcccatttataaataacatttatgaagtgtctactataggccatttttaaattattttcagatgtgaaaactaaagctataagagttgattggaccaagttatttctatatttagtaacttacaattctaacccagtcatgtcagattctgttatgccaaactatctgtcagaaattgaagcagcttagaaattactttgagaggacagttaacagctttctgttgcattatcttctccccaaattttaagtatttctgtacttgcacagtttcattcatttatcaaccttctgttgagctttcacactattagaatcctaagaaatgatccatactctcaacagtcaattaagtacagaagacacacaagtaaacagataattacataaagtataataagacataagcttttataaacagagaattatgtggcaacccatagatgggccacaaacccctagttagaggttaaaatcagagtatattgtaaagccttcccagagaagactatcactgagtattgaagaatgagagtagttacccaagataagtgaaggtgtccacagagagagatgttcatgtgcacagaaattcactagtttgaaagatttgttcatggagtttgaataaagttcaaggtcaaaagatctcatttattcaaagttcctaatgataaatgaccctcactccaaaaagtttaaattacttctgtcattgcttgaaatttaactgaattcaatcagtatttattgaatgcctaccatattccagtattacataggttagtagatttttatgggataacgccagtcttgctattttccctttaagattgggaaaatgaaagcaatatgcaatttagatatacataatagctcagagattgccagtgctaaaacaccagtgttccagtactctttctcctggattacaataaaccccattgtacactctcaaaagaaaagatgcttcttaatctttcactcactatatagcattttaaaagctgcatttcttattatcattattatacaaggagaatatcattctaaagtcagaggaaacagaatatgcacaaacagagcttttgtatttcaatgttgaaaatcttatcatgacagctttttgcataccttattttctcatgctatgacccttaaacatatggcagaatcaaaaaaagtgaaaaataccattgccactgaaaaagccacaaatgaaatttcttaaccaaatatttagttctatagtgaattcagtaaaaaccaagctttcagttcaagattgggttcataataaatatccctcatgctgattataagaactaaaagtaggagtaatgtataaccacaaatgcctaaaataggtggcatctaatctttgtctttccttaggaaaaataggaagaggtattggtacctgttaaatgttacctgtagatattccaaaggtaagatagtagcagtatcttaaagaataaatgaacgtctatataatctcaaatgaagcacttaaattacctgggacacaatttcctcacctgtcaaatatacaaattagattagattacctaaaattactaaaacaagtagatataattcaaattttttatgattttctaattttatcattttgggtgtcaacttaacaactgtattgttggccaagtaattaaggagatcaaatacatgtcaacacaggaccaggtaccctgagtgatacaaagagtaaaaaacatagtctttaccctcaaaaataataagatctaatcagaatgaaaagttgaacctctactaaactatctgaaaaactccactccatgaaacagaagttcatgaaagagagtcatcagggtgaatgaaatacttggacggaacttcatgcagttgggcttggttggaccttaaagaatgagtacaatttgcatatatagggagaaggaggtacattttggagagagaaagaacaaaattatatgatcaaggtcaagaaagcaaaatttcacaatggaatattctaattaaaataagaaataggtggagagaagagagacagagagacctacgtaagtggaacacaaggtttttgtgaagagtagtagaacggattgataaggcctatttaaaaggaaactaaatgttaagcagaggatctgaattatttttaaaaatacactaaaagttattcaccacacacttgaaataccttcaatatttcatggaaaagttaaaaataaagtccttactccaaaaaaaatctggtgttttatttttcatcacatttcagaatgtgagaatatatttctacatgaatggtagatatcaaaaagcagtgtagaaagaaacatttatgttggcatcttcttttcctttcttgataaaataacagccaatatttcaaacatttattaatttaccatttattaaattgtagtgaacatgtttcatgcattatcatctatgattcttaccactagaatagtaggcactcaataaatatttgttgaatgatttgaataactgaatccctattttaacagataaaaaactagagataaggaaacttaagtcggggtgcggtggctcatgcctgtaatcccagcactttgggaggccgaggtgggcgggtcacaaggtcaggagatcgagaccatcctggccaaaatggtgaaaccccttctctactgaaaaaaaaaaaaaaattaactgggcatggtggcgcatgcctgtaatcccagctactcgagaggctgaggcaggagaatcacttgaaccagggagtcagaggttgcagtgagctgagatggcaccactgcactccagcctggcgacagagcaagactctgtctcaaaaaagaaaagaaaagaaaaaaaaaagaaaagatatcttaaataaatttctttttatgacacagctagcaagtagtaaaattagggtgctactcaaggtttgtctaggtccttaacacatatttacttttattttttattttcatatttttaaatttttaatttttgtgggtacatagtaggtgtatatatttatagggtacatgagattttgatccaggcatgcaatgtgaaataatcacatcatggagaatggggtatccatcccctcaagcatttatcctttatgttacaaacaacccaactacactcctttagttatttttaaatgtataattaagttatttttgactattgactatagtcactctgttgtgctgtcaaatagtaggtcttattcattctttctaactgtttttttgtgcccattaaccatccccaccttctcctacccagtcccccactacccttcccagcctctaggaaccattcttctactctgtatgtccatgagtttaattgttttgatttttagatcccacaaataagtgagaacttgcgatgtttgtctttctgcttagcacgtgtttaattagtacacattccagtctctctgcctccttttgctggttatccttatccctgtttcccactccatttatcatctctctttctcccctgtcctattacttcctattttaacttaataagaaatgacacagatatagggtactgaatatcttcgctatactacaatactattatgttccttgttctaaattaaaaagtagatccagctccttatatttctctccctaaaaaggaaaacaccagagtctgactttttagtaccatatgattttgaattaaaatttcctgggattagagaactctacattttaagaaaaactgttcacacatttgtccttacaataaagatggaataaccagacaaaaactaatgggatttccataactaaaacctagtgtgcatttctgataggtttctaaatgtaaagcagtgtggtggtagcaaggcatcctagtgattttaatatatctgaagtatctatttgttttccagctgagagctacattataagaataagtaaacatttcctggacctccaagaagattttgataaagctgctttaataaatacttctggtctgatacctaaggagcctggttcagtagaaagttttgaatttaaaccagaaccttctaaaatagagaatggtacgacattctatattgcaattcaagccatccatgaagccaatgtcacctcagaggtttcaaacattgcacaagcaactaactttattcctccacaggaacccagcattcctgatctgggtaccaatatttctgcaatcagtttggcaatttttggattagctgtaattttatctatattttaaactagaaattatattagaactcaaattcaatgttatacatacttggtaaacatttatttaaaatttaatttactatacttattgtctattataaagctcattataatataaaagtgaagtacaaaagttgtaagtttcctaattacttgattaattaatactatttgagttattaaatgttaatcaaaatgagtatatcatttcctgtctttgaataatccactcattaatttttaatatgaaaagatatatatttgtacttgtaagcattttaagaaacatttttaaagtgtgctacaaattcatttggtgtactaacatcaaaatgtatccaagccatttaaaaaatatttatatatacatagtagcaaatagttttatagatttatttgtatcgcattttttattacaaatgaatatttcatgtttatataagctgtaatcaaaaaggactagtagtagtagtaaggaagtcaaatttgtttttttatcattgattataagtggtatatttgttttttgtcattgattaaaagtgattttagccctaggcccgaaatgactagcaaatatcattttctgtatgaattgtggaacatcacaataaaattatttctgtgctgatgctatcattaggtcctaagactattaccaagaagcttgattgagacagggatttttctttttcctattgctgtatcctcagcatttagaataataattgacacatagaagatattcaataaatattttttaaataacttagtgaatacttttataacttcaaaaaaatccaaatttgacctcattacattaaaaaaataccacaaactatcatgtgcacttggtattatgaggacttcatataatgaaaactaaatcccttaataacatagttcaaaaccaacacataaagtttcagaaagttaactattaatagaatttagaaggtaataaaaggtaaattgagctattaatatagcaatggagtgatttttcttagagagaaagacagagaaggacatattggtagaaaatcctttgtttacagacaagaaggttatttaaatctctttaaatatctgaaaggaagatgctgtatatatctggaagagtcaagaaaaaaattataaatcattagcaaaccaaatccagaaaaatatatgaaaaataataatatatcatgaccaagttgaatctatctcaggaacccaaatgtgatttaatactagaaaattaaagtaatttactacattaacagtttttgtttagttatatgattatctcaatacatgcagaaaagtgtaattcaaccatcattcttcagtcaaaatgaaacctatgaaaactattaacctgatattttaatcttaaagtcaaaaccctcaccttttaaaaataaacaaaaagggcactaaatcttcaagtagagatgaaaaattatacatcagagggtgagaattctaagttctaggaaaataaatcacttaagagtcaacaaataataaaaaaattattgattatgaaagcctcaaagagtcaagagatagttaactgattgttaatacatggtcactatactgaataatttatagagctttagaagttaatgagggaagattcctatgcaataaaaaaagaatagaagatacaataatttgaaagaaagatacgaaattgtaattttgtacaggtgagatggaaatccaataaaatcaacaaataattaaaatgagagaattatgaaaaattcccagatacaagatcaatttactaaaaatcaatagcactagtctgatatatacagagctttgaagttgtcactccccacctcacaacaagaaaaaaaaagctgaactgaaaaataaagaattcttcgtagtttcatcagaaagttgaagtcacactgcaacctgctacaaaaatattggagaggcagaaaaatacagaatcacagcttaccaggagcagaaacctatcagtgaagctaataccagtaggaacacaaaccgtaaacgaagacatgccagaggctgagtgtgaataaggctgagagttaaaaactctcagaggccttagagagacctccatacttccctgagtttttcttccaagaaccccatgaagttttcagagtgggattaaagaaaaatcccctcagactctcaacatcagagacgtaaaagtaaccattttgaaatataccaaaagtgtcctgttcttagcaaaagcctgtcctcaagggaaactgttttaccagagcctgactaacttaggttttacaagggcctaaccaacttaggggaagagaaatacccaactccaatctcccctagccttccttgtggcagaggaagatactcaactccggagccctctaacattcctatctgatcaaagagggggaaaaaacagacactaggaagggaacaacagacactggggcctacttaaggtttgagggatggagaacggtgaggatcggaaaaccacctaacaggtactgtggtactaggtttgttacctggatgatgaaataatctgtacaccaagcccctgtggcacacaatttacctatataacaaatatgcacatgtatccctgaacctaaaataaaagttaaaaaaaa

SEQ ID NO: 12436 - DNA, 10065 bp, Human
gtcactgcaacttccgcctcctgggttcaagtgattctcctgcctcagcctcccgaacagctgagattacaggcacccgccatcacgcccggctaatttttggtatttttagtagagacagggtttcaccatgttggtcagtgtggtcttgaactcctgacctcaggtgatctgcccgcctcggcctcccaaagtgctgggattataggcgtgagccaccacgcccagccgggggcccttatttctcatattcgtccctcaagggacaagtcctcagggtcattagcccacctggattaagtccctctggaaaatgatttctttgatctcctctggcaatgctgccatagaagctcagcctaagggcatgttgtttgctcccaggccaccagatgtttccttgttattaaaagcagcatagagggcaaggttgcacttcgggaggccgaggtgggaggatcgtttaaagccaggagtttgagactaacctgggcaacatagcaagacctcatttttacaacagatttttaaaaattagctgagtgtcatggtggcacatagtccctatagtcccatccattctggaggctgaggtgggaggatcacttgggcccaggagttcgaggctacagtgagctgtgattgcaccacagcctgggtgatggagcaagaccctactctttaaaaagagagagagggcaaggttgtcccatgatccccctcagatagggctgactcccccataattaagtttgcttaaagaggcagacttgctgggctcagtggctcacgcctgtaatcccagcactttgggaggctgaggcgggtggataacttgtggtcaggagttcgaaatcagcctggtcaacatggtgaatccccatctccactaaaaaaacaaaaattagctgggcatggtggtgtgcacctgtaatcccagctaatcgggaggctgaagcaggagaatcacttgaacctgggaggtggaggttgcagggagccgagatcacgccattgcactccacctaggcgacagagagagactccgtctaaaaaaaaaaaagagacagactcttccttggctgggggtaagtcagatgggagaggagagggttaaaaacagctgggactcagcctgctggcaaacatgtggcatgtggcatgtcggggcaactgcagctcagcctctggagccatgtgagcaatgcacgcaggtacacgtgtgacaagctaggtcacctagccatgttcaacaggcatgtgcacagccacgaggaatgcccagccgtacaattaggcacacaggacatccgccatgtgtagacacagctgtggacatagctggccaggacatgcgacacacgacgtgctcatagcacagggagaagggcccatgaagtctggttggaactcagcacgtgtgtctgtgtgcccacctgagtctggactgctgcccctctgacactagctgtccccttgaagggtcggtgccttatctgtcctgacagaagagacagtgttgcttctcacttggggctcgcagcctcctcctcctgcctcgaactgaggatctgttgggtccagtcatcctggagagatgcggccagtttctttctgacaggtctcctcctgcccgcaaggaagtggggtgatcacagggcgcaggtggtctctatgacagctgcatcctctccagccatggccctgaaccctgcctataatcccaccattggctctcagatctgcctaagcctctcagcccccttgacgtcccctcccttaagcgccctccgaaggccacccgtccctcaaagctcctcacactccatgcccgcagctccctccacccggcgtccgcaccagcctcccagccgaggtggggcgggggcgagggggcgcgcactcctcggcgctccgggactgcagggcggggctgcagggcgggcggggcccgtgtctccagcgctcctataaagggagccaccagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtggtgagtggagggagccggggaagcccttctctctccagcccttgcactccccaaactctcacttccccgaaggggctgtgttttccaaggtagcctggacccacctccccagctctgacccccacgcttaaccgcggaggatcaagctgacttccaaagtcctcttccccacggttctaaccccctctctgacagctccgactcttgccagaatgacagctgttactccccagtgatagtgccgatcgtttaccctcccacaagtgactcagccaacaggctgggggcagcggtcacgcttgcagtctgggacagccagccacttcccctgcctcccacacccctccagattcccagaatcccagcccccagatgtaggggagggggcggaggcaaatgagccattattaggttatttgggtcctgggtgtctggcctctaatgaataattaagcctcaaaaagtccaaaggttgaagtgagtgaggacagtttgcacgagtgggggcagagggtgcaggccacatgggctgcgaacagcgaagtgggaagggaggcagattctgacggtagaagggtgggaggaagctaggcccaggcacagaggacgcgtgtctaaagttgctcacctggtgctcagcgactcccaggccctgtctgttatccagacagatgctgtcagcgtctgtgcagaagacgacaagcattctggttactccctggcctcttggttactctgtgggttctctgagtgagcatttccctgcctgagttactcctcagtcctagttactccttggtcacaccagtttcaccctggttttgttctgagtgactctgtttgcacttcttaggtctggcagacccaccagttatgttctatttcctgtcccagttactctgatttttcagccgctcatgtggttacacctgttttcctctgtgttcagttgctacattgcagtgagtgggttactccgttcctgccccagccctgggtagtacagaccagctggcccactgtggactaggaagcctaactaagggcaagtagggatccccaaatggttgaggatcaggatctatgggcagaggagggctgaaacccacttctggcttccaagaataggaagtggggaagccacagggggcattttatccacagcctcccataagattagtcgtcctatcagccagccctagcccctctctcctgtgccaagaaggcaataggaggtggcctttatcactctcctgcctcggagccctcactcctatcggagtcctgagtccagccacctgttttagagcagccaggctaggggaggatgatgtcttctattttcctagaggggcctcctcattccctcccaagtctcagttcactctctcacaaaggagccgttagtcctcccactgagccccaggatcatcaggcttatcccagaccacaaaagaagagtgttaaattttaggggaagggttgcagactcagatggatgtgaggtattggatatcagtgagaagcagaacttcaaggactgcatgaactggaggggcaggcctggggatccctttgtagtgggtgagtgcctgcctgcctacctgcgtgttgggagcctaggcctgcagtggcagaatcagggttggctttggggtgaggaaagcccctttctctgagatacctggtgtgagggcagggggcggtgctggccgagaactcagggcaggggttgggggaggaagaggaagattagccccaaggtggtggaactggctctgacagctcctccctccaaggcgtcctgggatggagccaggtctgagcctttggcaggcaaggagctgctgccagggcctcccaagcagggcagggcgcctcagaccctcacgtgcctgtctcccaccacccctcctcacacatacacctgcaatctctgatctttgctctcacctgcctgcacacctttgccccatgtcattgccgctggcttctccgttatctcttggtctttctgggatgataatcaaaatgcttaactatccagtacaacaggcactgacccgtcagaataaacaaggtctgtagcacaggtcctggaaactgcctgctctgtgggcataaaacctttagttatgggcaggtgggagaggagaccagggcaaggcattggagcagctttgagggacactcagggggctcagggcaacaatgctttacagctgctgcagaagtattttcaggcttgaacaaggggaacagacatagtacgttctttttcttttttaaatagagacaaagtctcactatgttgcccaggctgttctcaaactcctgggttcaagatcctcccatctcagcctccaaagtgctgggattacaggtgtgagccaccacagctggctccagtatgttctatatttgtagaacaccagggctcttagtctcttttagttcccccatttttggcagaaagtttagaaccgatctccccatttctacagccctgggtcccgggctggggatagtgagaggagccacacagatccctgtctgtaggacctccaaatctgagtggggaatctggacccctgagagcagagaggtcatgggtggagagaggagacgctgggacagggacaggtaaaggaaggggaggttgttgagggggacatggtgaaggctggggctctggcatcctggactcaggagaagtggattcaacctcacttctggtctcctccctatttatttatgccgcccattgccaccactaccaccaccacatgagcttttcttttcaactctttttttttttttttttgagatggagtcccgctctgtcgcccaggctgaagtgcagtggcgcaatcttggctcactgcaacatctgcctcccattttcaagtgattctcctgcctcagcctcccgagtagctgggattacaggcacctgccaccacgcctggctaatttttgtacttttagtagagatggggtttcactatgttggccaggctggtctcaaactcctgacctcaggtgatccacccacctcggcctaccaaagtgctgggattacagtgtgagccactgcaccgggcctacatgagcttttctttggggcagctgggggatgagtgagaggcttcccacctttatggtccaggcctgaagggctgtggagaaacttgtgctaaggtgaaagctgttcccctacacctacgcctgctgaaattcaaggaaaatcagtgaagatggttcagtcatcttctaggatcccagtcgcagaccctgcttccagccctttccatagggccctctcatattagagttgggacagtggggtgggaaggcatgtgtcctttttctggaaagtgcaattacagcagaaggggtttgggctgggttccaggaagcgcctctagtcctcccagtggtggcgagtgggcatgttgctggcttcaccccttccttctggagtgagagttgctggtcctcaccctccctgcctgttcttcttcctgacagatgtttggctgtggctccgtggcccaggttgtgctcagccggggcacccacggtggtttcctcaccatcaacctggcctttggctttgctgtcactctgggcatcctcatcgctggccaggtctctggtaaggccttaaccctgcccccagcccttggccctcaatagcattcccactaggtgtcctggcattcctaagggcaggtcacagctgtggcctctgctttggccccttgggaaaggagggtggagaagaaacttgacacttagaactttcgactctcaccttggaatcagagattatcagctgacctgttacatagaccaaccgccatcctgtgcaagaaacccctctctgcaccccttctcaggggaccctagcctgccgactgtggcaggctgcagctaataggtcccttgtcccctctgcccaggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaaggtagggggcacgaagggaaagaaacaagttgggcaataacagagtctcaggccctccaccccaccccacgccaccccctctgcctgctgcaatacagcagtattgctacttacccataactcatgggagggtggggagggcacacctgagagggaagtctgggctcaggcctctcccccgactcactgtgggtctaatctgtcaccagatgcaatctggcactttgccgacaaccagctttttgtttcgggccccaatggcacagccggcatctttgctacctacccctctggacacttggatatgatcaatggcttctttgaccaggtatgggctggggacgtgtgaggggaacgcagggaggggaccgagttgccttggtagctcatgggctggttgggggacaggactcctcgactgtagcagggtttctccaatctgtggggtaacccgcatcagaacatggtggcaagtacttacaaaacatgcggctctccagcgggttcttgtcacgcagacattctagcaccattgctttcaggagaagagcatgggcgggcgctgacaagagtttaagagctagagggaagacgggggatggaaggaggggtcagagaaagggagggagctgcagctcaccctgttctccccactccccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgtgagtacagcccccacccagctcaccccagcctgcctctcctctgccctgccccccatgtccctgactatgagtgtctgtccccccaggaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctccagttgtgcaaatatctttctgcttgctctgctgcttttctggggccagttaaggagcttccgcatgcccacactgacccagggtgcccggctgagtgtctgatctggtcaggttaccctgggggtcatacagagaggttagagagcctcttcaccaaggctctcagtttgaactcagtggtcccaaactttcccccaagtttccgtcctcatgggtacccccagcataatgaatggaatcttcttcccaatccctgtacccacacatcaccccagaaaggcttgagccctatgcagggaagatcttgctgcagagctacccaatggggagaactgctgcccaggaggtggtgagttccctgttcctggaggagacccatcagactgggaacctgtattgtcctccacaacctgcagctattcaggctccataacctccacccagaccttggccacagcccccctggcagcctccctgcctccaggcctgccccagtcagtccacaaagcaaccagagggatctcttcaaaacctctgctgaaagtgcccatctggagaccatccacaatgctccatctggcgttcaggacctccaggtagggtcaggagcctacccctcctctcacatggctccatccacctcagcctactttatgtgtttctgtgtttttgtgtcttcagactttgctccaaagtcccaactcacatctttgctcattaaagtcctcatgatctgctttaacgcctcttcctccgggaagccatccctgctctgcctcactcttccagcaacttctagtcagctgtcttaagtgccaagacccgcagttgcgttcacgctcatctccccttctgcttcatttcttcagtcatttcttcacttctacagaggcacctctgtgcccagtaaggcagggggttggaagactgactctggcgctctgacttgcccagaaaagcaacgggctcggcacacctgagaacaggaagcttttctcatttgcttcttccttaccataccctcctcaagtttcatcaagggaaacttcatgcaatacaagggaaggcatcccctacccaatccctcctctgagcgaaccccatgggagccagaggatccctgggtgtggcaggcgaattgtggtttttagaagctaagccagcttttgctctccagccttcacagatgagatcatggtccagagagggcgggtggcaaacacagggtcacacagccaagaatctgcctacggaggtgagggcaggagaaggcaataccattttaggtttctatcccttctttgtccccagctcccaagaggcgtgtctggaatgctggagggacctgagccagagggagtgtccccttcccaggccctggggggaggaagggcaaaccttgggaggggaatacggctgcagagggtcattccagccacaccagtcccacctgggctgccctcaccttgctgtcctccccagcatgccccatgtccttctgtcacccatttctctcaaatcctgctgctgaccctgaccagtcagcctagggggtgttggcagcacttttggtgctgccacctggcccagcaaggattctctagctgggtgaccttggggtagt

SEQ ID NO: 12437 - DNA, 28823 bp, Human
cccaaccaaactaatcttgaaagcttctatgtagatacaaagtgctcctgaaatccctatcctcagaaatgcttctgagccaaatgggctctgaaccctaaacaaccgtgtccatgtatgtggcaagagcttgtgaaaaacaaagctgggccaggcgcagtgactcacaactgtaatcctagcactttgggaggctgaagtgggcagatcacttgaggtcaggagttcaagaccagtctggcgaacatggcgaaaccctgtctctactaaaaatacaaaaagtagccgggcgcggtggctcacacctgtagtcccagctactcgggaggctgaagcaggagaatcacttgaatccagttggcggaggttgcagtgagcccagatcacgccactgtactccagcctgggcaacagagcgagacttggtaagaaagagaaagaaaggaaagaatgaaggaaggaagaaaggaaggaaggaaggaaggaaggaaggaaggaaggaaggaaggaaggaaggaaggaagggaaggaagggaaggagtctcgctctgtcacccaggctggagtgcaacggagcgatctcgactcactgcaagctccgcctcccgggttcgcgccattctcctgcctcagcctcccgagtagctgggactacaggcgcccgccaccacgccccgctaattttttgtatttttagtacagacggggtttcaccgtgttagccaggatggtctcgatctcctgacctcgtgatccgcccgcctcggcctcccaaagcgctgggattacaggcgtgagccaccgcgcccggctgaccaaaggtttcttggtccgcattctgcttctgtggaatgagccaggagccagttaggcctgatttgacatctgatttccggaggaaaacccagactctgccctgggcaacaaactgaatcctgaacttgaggtcacagggcaggtgtgaggagcggagagcagcaagagtgaaagggaggcctgtggtcattccatacacacaagagatcagttcctccaaggtcaggggacagagagcacagggatccagcgccaagcgcaaggcccccagaagaagccagagagtcggggagggggcgggggggaatcggtccgagcaggtgggaaggattctgggaccagacctaagggatcatgagcacagctgctgcaggcagacgggcccctggagaagctggggacaagctggaatagagacttcattgcgggaagggctgtcagggaggcctcctggggtggaaaagggtggtcaggaggctcctggaggcggcgcggccccgggggtccaactcacctggggcccggccaccgcgctctcgaccgccgcctctgcccgcgcagcacgggcacagctcgccagcactgcgaacccggatgggtcgtcgggcgcggccctcagcagagctgccttcacagatgtggtgcccaggtcaatgccgagggtgatcggccgcgcagccattatctccctgacccgcgcagctccagtctgcagccagcggccccacaagtccgcgctcttcgcccaggggggcggggcaggggcggggagtcgcctgccaatctttcagccacacccaacatggaggcttctcgtcttcccactggccggggaaggcgagcttccacgcaacctctcggcgggccccggctataggcggagaggcggcggaaggcgggacctaaagggggccccgccccacgggctctgatttccgcccaatggagggcggtctgagcttcgctcacgaaaggagccgggaggcgctggcggctccaagagtctctgtgtccctggcagcggacctcatcttccctcacgccggagccccgatctctgcgccccggcccgacccagctgcgctctgtccgtctaagacgcgcggaaactacaactcccagagctcatctcgccgagatccggccccacgagtcaggtggcggaggtcaggtgacagcggacccgcctctcccaaagtctagccgggcaggggaacgcggtgcattcctgaccggcacctggcgaggctcatgcgtcccgtgagggcggttcctcgagcctgggggcgctcaggtgagagcggacgcggcctcccctgtttcccaggcggaccccttgaggcacagcaggtcagcggggcagcctgccgggggtccagcgccctcagccgcggcgggctcctttccccgccaccagtgctggcctcgcgacacgggacaacccccgggtggaagggcccgagcggtggtcagccgaggcaggggcagcgggctgccggggtgggtgccgttcccagccccttaccttctgctcagttgccgcctgggtctcggttggggaatttgcagattgctttggagacgctgagagaacctttgcgagagcgccggttgacgtgcggagtgcggggctccgggggactgagcagcacgagaccccatcctcccctccgggttttcacactgggcgaagggaggactcctgagctctgcctcttccagtaacattgaggattactgtgttttgtgagagctcgctaggcgccctaagcaacagaggtaaccactttatatccttgtttctcaacctcgttattcctacctaccccctcccataaaatttaataccactagtacgctgtgtatttgtttctgtggccacaaaccattgtaatagctagatttcttcactaccaccccaagccaattttttttttttttgagatggagtctgcagcctctgtcacccaggctggagtgcagtggcgcgatctcggctcactgcaacctccgcctccggggttcaagcgattctcctacctcagccttccgagtagctgggactacaggcctgagccaccatgcccagctaatttttgtatttttagtagagatggggattcaccatgttggccaggctggtctcgaactcctgacctcaggtgatgcgctcacctcggcctcccaaagtgctgggatgacaggcgtgagccaccgcgcccagcctacccccagccaattttagtcccacttgacaatgcgtgctttacatctcctcatttaagtcctgtgaggtagttaccacctccttgtttggcaccacaaggtcgcataagtaataaataggtcaagcctgtctccagtgcacacagcccttgccactatttgtgtaccctctccaaaagcaggagacccagggagttccaggtcgtagaacagaggacaggaccaactcatacctggcagacaggagctgccacactagacccctagccccaggttgctcctgggaagggactgaatgggtgaggagccttcttgaaacatgtgacatctgaatgaggcctggacaatagttagaacttacataggaagggcacgccagacagagcccattgtcaggagatacttcatttctatcttgtagctttcacaagccactagttgtatgtaattatcaatctggtttttttttttttttttttttttaatttgagacggagtttcactcttatcactcaggctggagtgcaatggtgcaatctcggctcactgcaacctccacctcccgggttcaagcgattctcctgcctcagcctcctgagtagctgggactacaggcacatgccaccacgcctggctaatttttgtatttttagtagagacggggattcaccatgttggccaggctggtctcgaactcctgacttcgagtgatccaactgcctcggcctcccaaagtgctggaattacacacacgagccactgcgctcagcctaatctgatgttttttaacattttaattgacttacctctcaatgtcgttttgtctctgctggcatcgttcctccaggggtctcagcctttgaggcttgggaatgtttgctgaccaagtctgtgagtttgagaagctggttaggcctgattctgcatctaatttctggagaaaaaccagactctgtcctgggcaacaaactgaatcctgaacttgaggccacagggcaggtgtgaggagcggagggcagcaagagtgagagggaggcctgtggtcattccatacacgcaggagggcaattcctcccaggtcaggggacagagcacagggatccagcgccaagagcaaggcccccagaggaggccagagagtaggtacggggtcattcccggccggtgagaagggtctcagatgaggcagacctgcagcaggcaaagagagaaccctggaggagacgggccaacagaggtcagacagctggagcagccagggagacttcttgaggagtgtgtaagggagatgtccggagatgctggaggccttggggaaactgaaatcagagtgggaacagggatgtctccacacagaccttacccagagctccccacagtctgcaggaggcccgtgagactgtgtactgaggcagcacggagaccaagctacagaaatccatgccggcctggctgctcttgacccactgttcacctgctgtgtcttgggtttacaggaatgcagctccccatcttccacactaaaccaaggacttgctctggggctcatccctccccgagtcctccttgtgaatgaccccagccagtcctggaatggtgacacttgtcaaataaagtcttgacaggcgcggtggctcctacctgtaaccccagcactttgggaggctgaggcgggcggatcactcgaggtcaggagtttgagaccaggctggccaacatggtgaaaccccatctctactaaaaatacaaaagttagccgggcatggtggggggcacctgtaatcccagctactcaggaggctgaggcacaagaattgcttgaacccagggggtggaggtttcagtgaacagagttcgcaccactgcactccagcctgggcaacagagcaagactctgtctcaaaaaaaaaaaaatttaaatatgtatattaaaaaaaaatgtttttttaagtcttaagggtcagttggtgtcatcagcccttagactcttatcccaggacaggaaaggaaattaatttccttgaggtttataggttcacaatgtcaaatatctgaccacagttttaacaacttttggagaaaaagaatctcaagccagtaaaattgcattctttctttctgctaactaagtttttacaaaaagcaattgaagagggaaaaattctggtctttgttcacttcctcaggggggcactttacacaacccatttatctgctcggagcccgtttcccctgtatatcaaagaaagataagtcctctctagggtgtccctctgaggccgtgatgcaaagccctgaggtcacagctgtcaggtggcagtcctttatgagccatccatgctccagagggcagattgtctacagggagctgagctgattcaacattcccctgaacttctctcttgctgtttttcttcctagttctgagaaatcgagaaacatgataaggaattggctgactatttttatcctttttcccctgaagctcgtagagaaatgtggtaagtttagaaatgacacgtcaactttgtaaagagggaaatggtggctagaggaaggagtaatctgatctgtttgttgccaagggtttagaatcattcagaccacatgtctctgtctgcctcttggccatgtggccactggggtggtggagcagacccaggtctgggatccaggtgttctgcaaagagccagatagttccacatataattggccttctgccctggtatctctgtacctttctgtaccaaagtgaacagctggttcttaaggtcagactatgcagctgattctcaaagtcaaacggtagagctccaacaacctgggataatatcttaaagactggctcaggctggagcagtggctcacgcctataattccagagctttgggaggccaaggcaggaagatctcttgaggccaggagtttgagaccaacctgggcaacgtagtgaaaccccatgtctactaaaaaataatttttaaaaattagccatatgcagtggctcgtgcctatagtcctagctacttgggaggctgaggcaggaagattgcctgagcccaggaagtcaaggctacagtgagttatgatcacactactgcactccggcctgggcaacagagttgagaccctgactttaaaagaaaaaaaagaagaatggcttatgcctctgccctgtggacctcacagagagagtcttgggtcctgggaaacactggggaagcagaagaggtagccaccctgttgtacccggttctgccaggcacagatcacctgaggagtctgcccagcatccccttgtaagatgagaaaacctgtcccttagagaggggctgaggaacagggtgcaacagcccagcagggctaggggtcagttggaacacaggctgggatggagtttacacgtccttgtaggaggaatgaccttcagtgcaggcctctttgaggcccgtgcccttctagcaattctcccactgcccaaaacatctctggaattccttccataaagagccatgtttagcacttcaaaggtgccaggcccattcatttgatcctcagcttgcctcttgggtcaaatacaaaaatcagatacatatatatatatatatatatatatattttttttttttttttttttttttttgagacagagtctcactctgtcgctgaggctggtgtgcagtggcacgatctcagcccactgcaacctccacctcccgggttcaagcaattctcctgcctcagcctccctagtagctgggattacaggcacccgcaactacgcccagctagttttttgtatttttagtagagatggggtttcaccatgttggccaggctggttttgagctcctgacctcgtggctcgcctgccttggcctcccaaagtgctgggattacaggcatgagccaccgtgcctggcccagataccttaaattcccatttcaagtgaaccttgacaaacaatacaaatcctgcagaggtttccccagagcctagcaccattgccgttatctggcctcttgcatctctgaggaaacatggtcacgtgatcatctcttccaggtttgttaaacaatcagtaatgtttgtagtcacactttgtggataagcaatttccgggaaaggcaggtctttcagaccctggaacctggtgtttcttaatacagacgtcagaaccctgtccccaccctgtaggatcagactttgtaagactgaggctggagcatgtgcgtgtgcctgggagtgtgcgcgcgcgtgtatttgcctgggcctgtgtgtgtgtgtgtacccgggcgtgtgtgtgtgtgtgtgtgcctgggcgtgtgtgtgtgtgcctgggtgtgtgtctgcgcgcatgtatgtgtgcccgggcgtgtgtgtgtgtgtgtgtgtgtgcccagtcgctcatacatactctttaaagccccattagtaatgctaacacgctcccctaggagaaaaacaaaaaatccagctaccaccactccagttacctggaggggaagcaggcccagagagggtagaaggcttccccaaagtcacacagctagaaagtaacaaagctgggacctgcataggatccctgctgcatgagatcactttgcctcctttcctgaatgccattagaaaagaatgggccaggtgctgtagttcacgcctgtaatcccagcactttgggaggccaaggtgggtggatctcttgaggtcaggagttcgagaccagcctggccaacatggtgaaaccccgtctctactaaaaatacaaaattagctgggcatggtggcgggcgcctgtaagcccagctacttaggaggctgaggtaggagaatcgcttgaacccgggaggcaggaggttgcagtgagctgagatcacgccactgcactccagcctgggtgacagagcaattccccatctcaaaaagaaaaaaggaaagaagaatggaagccaccataaaatcaagtcactggaattgaatctccaacctcattctgcccttgctgtttctttcttctctttgctttgggtagtaattatgaaggaccacagatgagatgattggccttcagacttgtctgtctctgacttctctgggtggaatcttgaggcagtgcagcctcatggcaagaacctgggctttggactagacaggcctaagtttgaatctcgccctcaccattttcaagctgtgtgggcaagaaacctttcctcttagaatgctcagtttcctgaaatgtaaaataggaataataatgcctacctcggcctggcgcgttggctcacacctgtaatcccagccctttgggaggccaaggagggtggatcacaaggtcaggagatcgagactatcctggctaacatggtgaaatcccgtctctaccaaaaatacaaaaaattagtcgggcgtggtggcgggcgcctatagtcccagctactcgggaggctgagacaggagaattgcttgaacccgggaggcagaggttgcagtgagtcgagatcgtgccactgcactccagcctgggcgacagagcaagactctgtctcaaaaacaaaaaaaaatgcctacctctcacttctgtaataattagaaaatgggagctcggtgtatagcagagtagctggtattgggtaggtgcagagtgggagagaggcctataagaattaattttaaaaacctggccaagcatggtggctcatacctgtaatcccaacactttgggaggccaaagagggaggatcacttgggcacaggaatttgacaccagcgtgagcgacatagtgagaccccatctctacaaaaaaaaatttttttttaaacggattctcactcagttgcacaggctggagtgcaatgtggcgtgatctcagttcactgcaacctctgcctcccgggttcaagcgattctagtgcctcagcctcccaagtagctgggtttgtagacgtgcgccaccacatccggctaatttttgtattttcagtggagacagagtttcaccatgttggccaggttggtctcaaactcctgacctcaagtgatctgaccgcctcagcctcccaaagtgctgggattacaggcgtgagccaccgcacccggccaaaaatttttttttaattagctgggtgtggtggtgcatgcctgtgttcgtagctactgaggtgagaggcggcagtggtgggaggatggcttgagcctggcggggtcaaagctgcagtgagccatgatcactctctttaggaggaactcaggatggtgttgtgactcattttgtaaatctgatacaatgtaaagattttagacttggggggccagcttcctaactgcctcccaccttgggctaaaaatatcctgcagttatcatgtgatgataataatagtaacaattatttagcatctgggctttgtggaaaacatgttacaaacattgctacattgtatcttcaccatgactcattcagataggtcttggtattctccccactgtacagataaggaaatggaggctcagagagggtaagtaccttacccatggtcacacagctaggaagtgtcagagccaggatggaactgcgtgactttggagcccaatatctcagttgctgagcacctcagttttctgtggtgctaaagaaggagggaataaacattctctggtctggttcttggagtgttcacaaactcctattttatttttttattttattctattttgttgagacggagtctcactctgtcacccaggctggagagcagtggcgcaatctcagctcactgcagcccccgcttcctgggttcaagtgattctcttgcctcagcctcccgagtagctgggattacaggcgcctgccatcacgcccagctaattttttgtatttttagtagagacagggtttcactatgttagccaggatggtctctatctcctgacctcgtgatccacctgcctcggcctcccaaaatgctgggattacaggcctgagccaccgcgcccggcctaattttttgtctttttggtagagatggggtttcgccatattggctagtctggtctccaaatcctgacctcaggtgatccacctacctcggcctcccaaagtgttaggattacaggtgtgagccgctgtgcccggccctcaacctcctatatgcaaagattgtaggagctctgtagccatgtagatctcccactcaccttgacctccactacctctggcagagccctagggatccagagtctggctggccgcccagcatcactttcagcatcctgtcctgagcagtggctggttgtgggacttgcttatctggcatggtcctcagctctaggcagaattgaactggtggtacaggaagtcccagctatgcaagcccagaagaaatcctcagaatgacctcagaacagtgagcctgaaaaagaagggcagactcgccacagcggcttccaggctctgaggctccacataaggaagggactgccttttgccgctctgagcaccttggcctctgcaagggccaggggacatcctgttctgaggagcccagccagccagcaggggactggagattgtggactgtggggacctacggacttgggacagagcttccatctgtattcacatgtgctgagcatggagaaggcagctctcagggtctgagaggctctgggtagcagagcctggcctggcagggcaagcttcaggctgtgatctccttagaggagacgaggttacagaggaagagaaactaccaggtaggagtattgaggcggagaatcagaggtcaaattgggtaactttaagtttccttccgggccaggtatggtggctcacacctgtagtcccagcgctttggaaggccaaggcaggcagatcacctgatgtcaggagttcaagaccagcctggccaacatggtgaaacctcatctctactaaaaatacaaaaattagccagacgtggtgctgcatgcctataattccagctacttggaaggctgagacaggagaatcacttgaacccaggaggcagaggttgcagtgagcaaagatcatgccactgcactccagcctgggcaacaaagcgagactctgtctcaaaaaaaaaaaaaaaaaaaagtttccttccaacccaagcgtctaaaatttcagatctcaattcatctgcctttgaggggtctgagtgacagggtctgggtggggggaactgggcctggggggtctgagtgacggggtctgggtcggggaaccgggcatgctggcagcctctgccgttgcaaagacgctcctcatcacagtcatgcacctgcttccccgcccggcctagagtcatgaccataaccccaggctgtgtgtaaccctgaaggcaatcaggcaggggaagtgagatggcaggtgtggcatgagccttccagcacccctgggagcagaggctgggacggggctgcacaaagaatacaggaagcacacaaagagaggcttactcagtccggtgctctgggctagttggccttgcaagagggttttctttcttttttttttttttttgagatggagtctcgctctgttgcccaggctggaatgcagtagcgatctcagctcactgcaacctctgccttccaggttcaagcagttctctgcctcagcctccaaagtagccgggactacaggtgcatgccaccaaacccagctaattttttgtatttttagtagagacagggtttcaccatgttggccaggacggtcttgatcctctgacctcgtgatccacctgcctcggcctcccaaaaggctgggattacaggcatgagccaccacgcctgcccagttttctttctttttttaagaaaatattctgtagaaacagagtctttctgtgttgcccaggctgatctccagctcctgggctcaagcagtcctcccgccttggcctcccaaagcgccaggtttctaagcgtgagccaccacgcccagccccacgatggttttctaagaccctaagacccagatctgcttcttccctcatctggggggcctgtttgtcaacttgattctgagttaacagcttaatgccaagaagaaatctcagagtgaaacaactattcacccttcctcctccagtaccccgcagatagtcagccccaggaaggggaccagtgccagggtgagctgggttgggaagggaccccaaagggctccttagaaactcattagctgggcccatgtgtctctctgagagtgcaggaaaggggctggcccagttcttcaggaccattttgacttcatgaacagaggagacccctgtgctttcatctgaagaggtggttcacggctgccttttacgctcccaggtcgcgctggaattcccctgtaatgatttttgggctccatggttctctaacaatctctggttaactcagccgcagactctcagagcctgtcatcgcagcgggaggaggacgctccggcgtttcctgctcaggcctgttttcctccatctctgtctctggcagcaggtggggaaggaagctaaccagggcctgtgtttgcagtcccatcacagaatagggctcgtcagagagtcagagctcaggagttcagatgtcaggggtttcggcccagttttctgtcacaggcctgaactctgacccagtgcctcatgtcattgatttgggtccttccagagtcaagcgtcagcctcactgttcctcctgtcgtaaagctggagaacggcagctcgaccaacgtcagcctcaccctgcggtaagttcctgggcctggcgctgtgctcagctccgctcaggccccgcagctgggtcagggctgacccctggctcagtctgttcagatttcagatgcgctattcttgcctcttacctgtaagacaagccctagaaaaagggatggtgctagccccgggctgcaggatgggatcgcaaaggctgacccccaccctgagtcctcactttccctggcaggagaaggaaggggtgcttctcccagagacgtgcgtcttttccccgcatgggaagagtcctgtgtgaccggtgttgaggccagatttcaaagcgattctttctaagactaagtatttgaagagagccctgaaggtcaaggggcagggggctgagctgctggttggcacttctgaggttgctttcagaagcaggagtggccacgtcgggtgaatgccgctcatgctgggccttgtctgggagtctcacttgctgccacctgctggcttaggcacaaacgtcgcgacctagtccagtccgtgccagggaggctgcctctgccttctctgctcttagctgctttgtccttcccttgcctcccagccgtgaggattccctgatgaagaagacctagaaccctctccttctctctttatgcctttcccccttcctcgcctctcctgcgagatctggcctgaaagcaaagctttggttccgaggcccctagcaggcctgccattccgctcccagctccttctgtctctgcacaccctccccctgcaaatcttacaagtcatctcttaccacaactgtccaggcccctggagcggcctcccactgcctttcagattaactccaggcctctaaacccagggccagggcccagaagacggcttccagccagcacatctgccttctcccgtcagatgcctctcccagctttccaagtccggactgctccctcctcattccctgcctgagccctctcctccttcagtcaaatgctggccctcacacaaggccccactcagacccgactctctgggaagcctttcccaccggagcagggagccacggtcctgggcctccagatgcctcatttgtcattcacacccaccttgctttcttctctgttctcaccctaccctgaagggacagacacctggtctcctgattaagacaggaaggcctacgggagcacgatttccacctggctacccatcagggtggagcacctagcatttcctaagcctaactgcttgagagttgaaggccagatgtgaaatccagagggttggttgagatctcactgtccagcttctcagcagtaattagactcttgtcctccacaggccaccattaaatgcaaccctggtgatcacttttgaaatcacatttcgttccaaaaatattactatccttgagctccccgatgaagtaagtaaccaatcttaacggatgggtagggaaatgctaggtaacagaacacatttgaattaagagctggtggaaacaggtctcctaggcggcccctgttccatcaacctagaaatctgtgattttggctttgttggtgtcttttggggatgagtatcacatgccattagatggaattaagaaggtgatagtgaggaacctgaggcaaaaatggttctgggaatgtaaacgttcttaccgggagtggtggctcacgcctgtaatcccagcactctgggaggccaaggtgagcgggtcacctgaggtaggaagttcgagaccagcctgatcaacatggtgaaaccccatctctactaaagtaaatacaaaaattagccagtcgtggtggcatgcacctgtaatccaagccacttgggaggctgaggcaggaggatcacttgaacccaggaggcggaggttggggtgagcctagatggccccactacactccagcctgggtgacagagtgagactccttctcaaaaaaaaaaaaaaaaaaagttcttacaattttcaaggcctggctgctcaaagggcattcaaggaccagagaattgggcttccttaggaacacagcatctcaggccccatcccaaacctactgattcaaagtcagcacactagcaagatccccaaatggtttgagtccacattaaggtttgtgaagcctcattctgagacaccactggttgggtgtcgtttccaaaaaccagtgccagaggccgtgtgatctaatagcgatcattacccatagctttatgcatgtatctatttgtgtgtaccctgctcccaccttactgagcatttgagccagttgctattcaattagataaaaagcatccacagaggaggtggcaaataagggtttaaataacaagatgaacgcaagtcactcagggcgcataacttctggagagctattgtacaacctggcgatatagttaacaatcatgtattactgcatgcctaaaaactgctaagagatagatcctaaatgttcccaccacagctgggtgcagtggcttgcacctatagtcctagctactcacgttcgtaacaacaacaaaaaaaagataagtatctgagatgatggatattaattagcttgatttagtcatttcacaatgtatgcatacatcaaagcatcacgttatatactgcaaatatatacactttttatttgtcaatgataccttaataaagctggtggaagcaggaggagaagaatgcagggatgagatcagtagccatgaggcacatcgagatgggctgcaaatcagctctgagccccctaggaagcaaacaggagtgaaacacgatcagtctccagcatgtgggaacctgtgatctgaaaaatatagcatcgctggctgcagagatgtgcacctgtaatcccagctacttgggaggctgaggcaggagaatcacttgagcccaggaactcaaggctgcagtgagccatgactgtaccactgccctccagcctgagtgttggagcaagactctgtctctaaaaaattaaaaataaaaataaaatgtttaaaaataacagcattgctgagaggggatctcggagtgtccagctaagaggaccccgcatgagagggagctctccccgctggtgagcaccttgttagtgccatttcccacacctcccctcttgcccagggtgtgaggccagcatgcagagccggtgggttcccacagcacagccctctgatccacagattaaattctgactctgggaggaacagatgctgattgcttcgtttagggccaaacatcgaagtcaaaatgtcatctttttatttttatgtattcatttattttttattttatttatttgtttagagacagagcttcactctgtcgcccaggttggagtaaagtggcgcaatctcagctccctgcaacctctgcctcctgggttcaagcgattctcctgcctcagcctcccaagtagctgggattataggcgcccaccaccaggcccagctaatttttgtatttttagtagagatggggtttcaccatgttgactaggctggtcttgaactcctgacctgaggtgatccacccgccacggcctcctaaagtgctgggattacaggtgtgagccactggcccggccattgattgattgagacagagtctcactttgtagcccaggctggagtgcaatggcgcaatctcagctcaccgcaacctccacctcccaagtttaatcaattatcctgccccagcctcccgagtagctgggattacaggcacacaccaccacacccggctaatttttgtgtttttagtagagatggggtttcaccatgtttgccaggctggtcttgaactcctggcctcaggcgatccgcccacctcggcctcccaaagtgctgggattacaggaaccaccacgcctggccaaagtgtcctctttttaaaatcaaaaaagataccaaacaagccttggctgtaggagtccttgaacctgaagcacaaacagatccagcaaatccatggtgtcagtcagggtagcagtgaccctcggggccagcggaggctggaggaagcaagcaggggttccgaggacttgggaatgtttcatttcttcatctgggagctggatgcattcagtctgtagacatttcatcaagctgtgatgtgtgtacttctctacctatatgtcatagttcagtttttaaaaaagtcttcaacagtgagaggctgggcacggtgggattacatctgtaatcccagcactttgggaggccgaggtgggcggatcacctgaggtcaggagttcaagaccagcctggccaacatggtgaaaccccgtctctactaaaaatacaaaaattagccaggtggtagtggtgtgcgcctataatcccagctactcaggaggctgaggcaggagaatcacttgaacccgggaggcagaggtggcagtgagctgagatcacgccactgcactccagcctgggtgacagaatgagaccctgtctcaaaaaaaaaaaaaaaaaaagaaaagaaaagtctttaacaatgagagtcaaaccattggtgtgagatggcattgatgggcaccaacctaccttttcaggctcctgcctcactggcccttccccacccaactctcaccactcccctctactacccgtgatgctggaagcctctggttagaacatgggagttgagtggtctaggagccaggcctgtgagccttgggtaaggcacttcaccccaatatagcaccgtctccttattcgtagctgtacagtgaataatgtttacttgacagccttgtgaagattaaaagcacaaacaagtataaaatgtctaggattgactgggcacggtggctcatgcctgtaatcccagcacttcgggaggccgaggcaggcagatcacctgaggttgggagctcaagaccagcctggccaacatgatgaaacccagtctctactaaaaatacaaaaattagccaagcgtggtggcaagtacctgtaatcccagctacttaggaggctgaggcaggaaaatcacttgaacccgggaggtagaggttgcagcgagccgaaatcatgccattgcactccagcctgggtgacatgagcaaaactccatctaaaaaaataaaaaatgtctaggattgtccctggcacatagaaagcactcagtgaaaggtagcgattatcacttcattctgtcttgtatcggtcaatcgaccgattttctccctgcctagttccagaagggatttagtggccacttaacaaatatgcaagcaacgttgcaaggaatatctgttaaaaataagaaaaagtgagtggcaggaaaataaaagagccaggagtggcacatgttatgaagatgtaccttgtgagacgtggacgtaagttggactccaggctttgctgcagccgctataccatttcagttgtcctgccaaagcccctgatttctgatgctaagaacaagaaggcagtgcttcaagggtcctcattaagaagccactgaaggatgtggtagagcgcctgtagtcccagctactcaggaggctgaggcgggaggatcgcttgagcccaggagttggagtgatcagtgagctatagttgcaccactgcactacagcctgagctacagagcaagacctgcctctcggaaggccgggcgtggtggctcacgcctgtaatcccaccactttgggaggccgaagcgggtggatcacctgaggtcagaagatcgagaccagcctggccaacatggcgaaaccccatctctacgaaaaatacaaaaaattagccgggtatggttgtgggcacctgtaatcccaactactcaggaggctgaggcaggagaatcacttgaaccctgggggcggagattgcagtgagccaagatcatgccactgcattccagactggcaacagagtgagattccatctcaaaacatatataataataggaaaccactgcagtctaatgagccagatcctcacggtacctgcaatatgggtggagtattatccagggagcacagaagctggggaccaggggagacagctgggttcagtaaggatatcatcctgctccccatcactgcagcaggatttaagagtctcaggaagcactgggtgcggtggctcacacctgtaatcccagcactttgggaggccaaggtgggtggatcacttgaggctgggagtttgagaccaggctgaccaacatggtgaaaccccgtctctactaaaaatacaaaaattagccagacgtggtggcacacgcctataattccagctactcgggaggctgaggcgggagaatcgcttgaacccaggaggaggagtttgcagtgagctgagatcgcgccattgcactccagcctgggcaacaagagcaaaactccatctcgggggaaaaaaaaaagtctcagcaggcatgcttgggagatcagatgttgtaggcaggcctccgggtactttccttgaagcagagcatttgccaaatattgcagagcagcaagggtgaaaatgccctctttgccaagtgcctcatgtatgtgcctcctctgctttgtcacttggcagccaggctggcacagggcacacatggttttgtggacatggaggagcccagtgatgatggaagtggaagtgatggtattgtagtatagcagtggccccgtttgccatgcaccaggctctgtgctgtcagctttctgaacatcctgtcattcatggcagccctgaagggtagacacttttgttaactcgttttatagatgagcaaactgagatcagagcttgaataacttgcccaaggtgacatgtccagtgagaggacgagagccatccctccttccctcagagataagccaggggagggcatgaggacaagtccatagctctgctcagaaagtctcacccaggccaggtatggtggctcatgcctgtaatcccagcactttgggaggccgaggtgggcggatcacctgaggtcaggagttcgagaccagcctggccaacatagtgaaagtccatctctactaaaaattcaaaaattagctgggcatggtggcgcacacctgtaatcccaggtactcgggactcaggagcctaaggcaggagaaccgcttgaactcgggaggcagaggttgcagtgagccgagatcactccactacactccagcctgggtgacagagcgagactccgtctcaaaaaaaaaaaaaaaaaggaaagtctcactcaggccaggcgcggtggctcacatctataatcccagcactttgggaggctgaggcgggtagattgcttgagctcaggagttcgagaccagcctgggcagcatggcgaacaggaggttcaagttggctggtgggcgcagcgtctctccttttgcttagtaagctcttggaaggtgaggctgcgggtggtgcgtccctccgttccctagcgtgttgcatagagctagatgccagcggggtcctcggtaactgtacgtggcatcggattgaacctcagtcttcctaacaggttgtggtgcctcctggagtgacaaactcctcttttcaagtgacatctcaaaatgttggacaacttactgtttatctacatggaaatcactccaatcagaccgggtaggctggcctcagggtgtgggggcctcacgtgacaagaagggggccgtgctgggcacgtgggagtctccttcagaagcccagcctcagctcatcccggtccccaaactcctttccagcccgaggatacgctttcttgtgatccgcagcagcgccattagcatcataaaccaggtgattggctggatctactttgtggcctggtccatctccttctaccctcaggtgatcatgaattggaggcggaaaaggtaaccccctgggccgtatgtgcaggctctctcggggcccctaggagcaggacgttccagcaaggctgccgatagcgcagcctccaacgtcccctctacccttctgtctgcctaccctttccagaaagttgtcccagtgcgaaggctcggagagcctgggtcggattcccgtgctgggcgtttcatcccttgcccagctcagcccctccctgggaaagcaggaaaacagggaaaaggggctccttagtttagtggagaatgggcgggggagggagggcagtccatcgtgaatctcctctgcgctgggtccatccgaccctggaggattgcggcgtcaagtcctgtagtctcggtctttgggacgaagctgtcccaccttgacttgcaaagacacaagctgtcctgcagtcaccctggccacgtcggcctcctgggtgatggcaagcagagagccgggagggagacgctttcttccgggggcctcctgactcccctctggagccaggacttgaggggcagggagatcttgggcaggggaggaagggaggagggaagtagctcttcaagagggcagggattaggtggcatccgtggtggtagcaggagggacctaaggacagtaccctgcttgagaagggccgagtcctccttccccgtggcctgggagccctgtccctcccattccccacagtggtgccagtcctcacccctggccctgccatgcccttccacccccgccagccctcaccccctgccctgcccctccacccctcgccagtcctcgcccctggccctgccatgcccttccacccccgccagccctcaccccctgccatgcccctccacccccgccagccctcaccccctgccatgcccctccacccccgccagtccttacccactgccctgcccctccaccccccaccagtcctcaccccctggggtcctcacccctgccctgcccctccacccctgccagtcctcaccccctgccctgccccaccacccctcgccagtccttaccccccaccctgccctgcccctccacccccgccagtcctcaccctctgccctgtccctccacccctgccagtcttcaccccctgccctgtcttgtccctccaccccctgcagtgtcattggtctgagcttcgacttcgtggctctgaacctgacaggcttcgtggcctacagtgtattcaacatcggcctcctctgggtgccctacatcaaggtacggccttgcctgccctacatctctgcccacatggcgtggtggcccggctgcccctcaccacccagcttctcccacccaccaaacaggagcagtttctcctcaaataccccaacggagtgaaccccgtgaacagcaacgacgtcttcttcagcctgcacgcggttgtcctcacgctgatcatcatcgtgcagtgctgcctgtatgaggtgagaccagccctggccccccacaggccaccccagccaacacccgccaccccacctcacctttgacagaagacacggcagagcctgggaaaggaagggtgtgtgttcattcatccaggtcctgtgctgggcatagaagacacccatgagtccaggccctcagagccccccaagtctggggtgagggactcagggagaggcagtgcctggactcaggctgagagccgtgcacagaggagcacagacagctcatggaggagtgcaaggccctgaaccctgccagggaggagggaggagggcacagaagggaggagggaggagggcacagaagggaggagggcagaggaagacgcttggttgggctccaaggatgagtgaagttcctatggaggaggggaggggccagggtgggctcctggaggggtcaggtcacagaggccaaggggcatttgagagggaccctgagcaggcgggtgcagctgggcttcagggtgccaggagggggcccgcgtgcaggcggagacacctgtattcagctttgttgctggaagccatgggtgtcggcagggcagggccccaccaaggctgggtccggggacccctgatatgacagctttgctttcccttctctcagggagttcccttcacactgtaaggccagccgggggctgtctggccccacccgtatgaaccttctaggctttcttagcttttggtgtgaagcgagagtgaaggtggcccacattgggcccgtgttcagggaaaggcaaggcgaggggacagattcctgagatcctcaggctgctgccgggtcgtgggacgagtcagtacctggctgggagaggcaccaggccaccagagttccgaccccacgtctccaagtgagtgctgagaggcgcccagttctgccaagtaggaacaaagcagacagagcttgagagtccaagcagcctgaacaggaggccctggcgatgagaaggtgtggttggtgctggggatgtccagcaccagcccaggtgtgatgctttctgtggtccacatgttcccctgccacaaccccagtgcagcccccaccttgcaggggctccttcaaggccagggtccagcctccgtgcccctctctaagcccgccctatccggggccgtccttgctcagccccggcgtggcctctgtgtgggtccacatctctgccctcctctcgcccccagcgcggtggccagcgcgtgtcctggcctgccatcggcttcctggtgctcgcgtggctcttcgcatttgtcaccatgatcgtggctgcagtgggagtgatcacgtggctgcagtttctcttctgcttctcctacatcaagctcgcagtcacgctggtcaagtattttccacaggtacctccagggccctgttcacatggccggtggcaggagaggtgagagctacatggcccaggccctgctccggtggggcagctcctgccggcgtgaggaaacaggacggaaagccacagggagcccgggagcccagcgggagcggggcggtggggaggccagcctgccgctcttcccccggggctggaatcacaggagatcgctagcggaggccccttggaccccacgctcccctaagcatcaggtgtgcgggtggttccccttctccacaccccagcctttcctgatgcctttggctctgccctcaccactgcctccatttccacagcaggacactctggagaggtgaggtgggaggagggagccccttcctgcgcagagctcagcccgtcctatgagcatagccggtcctcttcagatccggggactcagggtccagcacatcttgccccacagcctgggacagggtcagggctgaagttgctgtacccggggacctagggcctcatttaactcaccccattcccaaagggagaagccttgttccagtgcccccagccctgggagcctcgtgttctgtgagctcaggagggccagcgttctgactgggaggcaggactggactcttaggctgagcaggactaagttctgtggccaaggagcccgggcgttccgggccaggccagcctgcacagaggctggggcgggacacagggcggcagtgaggggatgtggctggttgaacagtgttgagcatgttgaagctgggaagctggggtcaggtcccgggagctggggggggcttccgaggaggggaaggtttggggaagtgggccccagtccctgagggtgggagggattggggccaagaaaccggggatggaggagcccaggttggagacgtttggaactgctggaggggcagcagcaagtacggaagagggtgagccgggacacagacagggactgactagaggctcactgggaggccaccagagaggccaggacctgcctcacgggggggaaggaaaggtcacagcagtcagaggacccacagggctctgcagcatgggaggacgtggggcacaggcagtcagactggggcgcatccccgcagacccgcccccccaaccagacccaggaagccccggccaggcctgtggggggcgttaaccccgctctacagacggggaaaccaaggctaggagaactgtcacttgcccaagacagcaggctccggtgatggagccaggattccaaaccagaagtcccactcccaccagtccctaagcacatgaagtccaggctgagtttggggacagccttgcctggaggtgagaagaagaatcatagctacagggaaactagcacagggccttggccccagggatgtggaggagacggggaaggccgcatcggccccgcctctgctggagctgtgaggtgtggggggtgcggggcctttgcttgctgtacatgcagatgagacgcctacccccaggaccacccaaactgttccttggctgaggcctgtcatagcccaaaggtcaccgtgtccttggagccaaggccccagtgggaggaatgagaaccgcttttgtttggaggggcagtcacgaggcgcatgaggcagccgcccagccctcaccgccctccgtctgtctgtccgtctgtctggcccaggcctacatgaacttttactacaaaagcactgagggctggagcattggcaacgtgctcctggacttcaccgggggcagcttcagcctcctgcagatgttcctccagtcctacaacaacggtgagtcagccagcgggctgctggccaccctgcggctggggcatcgggcggggccagccttcccgggaccttccagccagggctccacccccacctgggatccaagccaatccagcccccaaggagagacccacctaggggccttcgtagctggaggctttgtggttttctgggacccccaccgcccaccaccccacaagctccagctgcctcaggagctgccaacctaacaccagcttctgtcccccggctgctaacagaccagtggacgctgatcttcggagacccaaccaagtttggactcggggtcttctccatcgtcttcgacgtcgtcttcttcatccagcacttctgtttgtacagaaagagaccggggtatgaccagctgaactagcacccagggacccagtgtacccagcctctggcctcgtgccctgctggggaaggcctcacccagcgaaggccggagaagcggttgggccctggcacacagggctggctcagtgtgcggacagaggagaccactctgctcctggggccagaggccattcaatagcctgccttcgtccgggcccctcctgggcctccccggccaggcacgtggcaccgtcgccttgacaccgccatctcttttctttaaggcttcaggcagcgcgcacaggctctggcagccgtctcaggcaggactgggcaccaagcttgcagccgaaggccttgccccaaactaccagcgtttctgcaagcagcttgaagggctgaccttgcagccgggtgagccaagggcactttgctgccaccactgcgttcccagagaccaagcagcccggtgccgtggccagtgaactcagaggtgctggtggacgggctaggactttggggttaggccatggggctctttctctgaaggccactttcctgacgtactctctgtacataactcagcgtccgcgactgcagtaacagccggccctacccagagtatttctgagccatgaggggcccaccagattggttctgaatcggactcatgcccagcgcattagcatagtaactcctttcagattttttggagggacgtttggaagtggcttactctcttctgccctctttcctacctccaccttctcagatgagccccatctgagcacatccagctgctccttacccagcatctggagtacaggacatagctctctcctgctaccagtctgtgccttagaggtctgttaggcctgccaaacggcgaccagctcccctggagcgagggcaggccccttccctctctttccccagacacctacttgagactcaccaatttctggcctgttcaggagcctcagataagtatttgtacttgagaccacctcacacaatctgtatgggcccaaccctgatctcaaacctccttccctctgcccaaagctgtccttcctatggcaggaggggtgggggtcccaggacgtgcctcatacatgacttgagcttgtcagtccactgagtttccttctacgagatcaacgcgaggggcctgtatcttgaattaaaacctactcgcttcctttctgcactctgtgtgctcgatacagaaggcaggtgtgctggccttcagagccaggtgccctgctcccctcgtgtaaggaagcgcataaggttgtgaaggtcactgacccgagagcgctgcgtgctgaccccacacttcactggggagccctcttgggtagcgcgagacgcctacccgcccagggccaggtcagtctcccaggctccgtgtcttcacggttaccagggcacgccactcaatctggatgtgagccggggtggatgaggttctgaagggcacaccagcactgggagcgggggcagtgggggtcttattctccagacgcttcctctatctagttgtaacaaacgtcaaagaatgtcaggtcttgtttctgcagagcagactttggcctgacggggtccacagacctgtttcacttgcaacacccagtaaatgtgttactgggtgccctactttaaaaatcagagatttcaaatgattgacttttccggctgagtgcggtggctcacgcctgtaatcccagcactttgggaggccaaggcagatggatcacctgacatcaggagttcgagaccagcctagccaacattgcaaaaccccatctctactaaagatacaaaaattagctgggcatggtggcgggcacctgtaatcccagctacttggttggctgaggcaggagaattacttgaacccaggaggcggaggttgcagtgagcgaagatcacgccattgcactccagcctgggcaacaagaacgaaactccatctcaaaaaaaaaaaaaattattgacttttctttaaaatctgatttggcagtgctaggtaggtccaggagtgctaacaccttcccagaggtggtacgcaggtagtcaggtgctctctgactcacccccatctggccagatcacggcccccagcaacacgtggggttgtgtccctcgctgggatacacggagtgcccttataggcagggagtcttataggcaggggtctctcccaggcacctctgggtgtccctacggcccctcccaggtgggagctgaggctaggttgcaaaaaggaggttgggagcaagtaggggcttcacagtaacacccaagaaagcacacgcaccccagggtcccaccccagcgctcccagacactcccacagatgtggttctggtcaggcgcagtgcagctgctgcggctccaccagccccgggctttccaggcaggtgggcctgggagtagttgagctttgtcccagaacagtgggggatggggccatcattaaaaccacagctctggccccaatatcccaccgccacccccaccccgatatcccagcccatgcctcagcaaagccccctgtgaattccagcatttttattgagcgcaccacatcggggaggggtggcagtggtttccacggtaaccaaagtaaggcttgtgcacttgctgagcttccagatgcgaattagtaaaagctaaattcaaaagtagaatgggcatctccaaagagtacgataaaaacattttgtatcaaacttgtgattaaaaaaatacaaaagttaaacccacaggcaaagaggaaaatgacaatcctgagagctgccctgataggtgagcctcgaacctcgtctaaatccgtaagaaggcaaaccctggggaggccagcacccctcgggagagtgggagtgaacgcggagcccacctggcttcatctgggcaaagcttcgtagcgcctctggcaggatgtgtgtccagtcccccgaggggcagaggcactgcggtgtggacacacgagggctggggggcaggggcggagccgaaccctgcagccaggcaaaagcgggaaaggcctggttcctccagcatttcccagcttttgggggctcccaagagatagtggttcccacttgcccagccactgctgtggccaagcagcagggtcggacctgagcctgtggtcacagcagactggctactactcagctccaggcccttatttccaa

SEQ ID NO: 12438 - DNA, 24150 bp, Human
  misc_feature (1)...(24150): n = A,T,C or G
aatctacctactgttctatatttttatttgttaaatctgccaatcctaaacccaacaaacctaaataattacttataaggggtttgtggccaatttataaacattttatactttatttaatatgccctattttcttttaaaagttcttcaattgtctgaactaacaaaaaagctacttttaaaaaatactaaatcatttgaattctaataaagtaaacaaacaaaacattgatgataacctaaagtgtttataaatgttccagaactgtattcagacaaaggtttcaacgtaaagtcatgaacctgaatcaaaccctaccaagtgcacattttataagagagttacaagattttctatatagttggcccagcagctctcattaagtccatgaaataccgcatattccatcttaaaacacacaaaaagagtataccatggctctgagtctcttaaacatttctacactttaattctaaatcttttttctggttggaagatgcccattcaccaagaaagacaattaaccattccctagagctcctttttttttgtttttgtattttattgagatggaatctcactctgttgcccaggctggagtgcagtggtgcaatcttggctcactgcagcctctgcctcccaagttcaagccattctcctgcctcagcctcccaagtagctgggattataggcgcccaccaccacgcctggctaatttttgtatttttagtagagacagggtttcaccatgttggccaggctggccttgaactcctgacctcaagtgatccacccacctcagcctcccaaagtgctggggctacaggagtgagccactgcgcccggcccagagccacctttaccagagattcaaccaggcctgaggtcttaggttgcagacaacagggagattcattgcagcacgaactcaggaaaccatttccttccatgtactatttggggttatcttatagaattcctggcatgcttggccagtatgctgcctggatgtatgttggggatatatgtataattttccctgtggctgtggccacagacccatcaccataagaggggttggtccacagatcccgatgctggcttggagttattcttattccctacccttttcacagaattgtctttgccaaagtccattaatataccttgattggattttgcttttttttttaatttttttttgctttacagatcttcatagtttcctgcccatatctctaaaagtcattttgcttgagttgatatcctacagttcttacaagacctttctctcccagggtcacacaactctcgccaatattaaattaatatcagcttcaatcacgggtctctccatgggtttcacgggctatttgctcgcagagtccagggacattttcctcatccattccatcagatccccaattgctttctctggcaacacactcctagtatttgtacggtaaagctgcctaaaaaaattaagtaattcaaactactcttgaccttactttacaccaccagggcaattagagtcacagtctgggtgtgtctgaggacagcaggccgccaaatcccagtgatttagagaaaaccgagcagaatttcccatgcctcctgcctcattgtcccccagcagaaggttccgtcaccccaggtgccctctagggtggaccacttccgagttcatccactgtcaggaaaaggcacatggcatgcaaccgcaagaccgatgactagatgtcagagctggctcccggttgggatatgagtgactttgtggaggatggcgcctaaatgaggcatgccaatttctgcaccagggtgacgaacataagggctccttaaaggctagcccaatgtatctgtatttccttggggattaaaacccatgatcttcagttcctcagagaactgaaagttgcaaggagaaatccagtaattcctgttatctgcaggctttataagtcagtggagcctgcggaagtggccagaatccagcactccaagcactgctgtcttctcacagagtcttgaagccagagcagcgccaggatgtcacgggagctggccccactgctgcttctcctcctctccatccacagcgccctggccatgaggatctgctccttcaacgtcaggtcctttggggaaagcaagcaggaagacaagaatgccatggatgtcattgtgaaggtgagcccctttcctgggaggaggatcccagacacccctcacaccctctctcctgtctgcagactttaagagactcaaggaacttaaagttggcccttagggggaatgtagaagctggcttggaacaataaccacttcaactctctgtacctcctgccgtcatcttaaaacaggggtgataacaatggttccctccagggttgctggggggactacaggagttggcaaatggaaagctcttaatgtagtatctggctcattatacgttccagataagggttagccattatgatttttattgctatttattgaatgcctgtatcaggcactataagcacatggtttcacttcataatctttatgaagagggactattactccccatgtagaggtgatgaacaaagaaagatgaagtaaccttatacagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttccttccttccttctctctcccatcctcatcatccctccctctctttgtctttctttcttcttctcctccttccttcctctctccctctcctctacttccccactccttccactttcgcttacgctttccttgggtgatatacccaatgtctggggacactgcttgctttctctggagtcaattgactccctttatcctacaggttaattaatttttgatgctggcaacttaaccctttcccgggactctggaaaggtacttattaccttaggaaacctgagacaccatggtgtggtaggggggccaggagccctgggtccagattccacctaccagacttgtgagcttgggaggccctgcccctccctgaaccaccagctcccctagtaaaatggcgaccacatccaaataccacctgtagcactggctggtgaagagaactcagggtgcctgaggcacccagcagagcctgcagcaaggtgggtatccatgagccagagccgctgctgttgctgtcactgggaaggaggattggagtgaggactggcaggctctgttcttccttggacgagcctctcagacccaggtggccctgccctttgggaggtaaccaaggccttctagatggtgttgtttagccaggatagcaatgccaagcctgtgggagccatgacaagattgttcaatgggaaaccctgacatgcaaggcaatgattttccccacttcacacatggcccgtggagcctgggtagccactgagttcccatctccttcctcactgatgaaacccggctgtctttttgttccttggtgagtccatcatgggggcttgaactctgcatctcccctgagcagctgtgtcctgcagagcatgtccgaagtccttgtcaaggctgcctcaccctccccatcctaccaagaggccatccccaaaacactgcaagagctaccctacagggcactcacagtcacccgagaatgccaggcattcagaataggattatccctagcgcccattgaccaagcacctcctataggtgctaatttttgtatttttagtagaggcgggtttcaccatgttggccaggctggtctcgaactcctgacctcaggtgatctgcccatcttggcctcccaaagtgctggtattacaggcgtaagccaccgtgcccggctgggactgtattttaacagttcaacatggtgggctttgtagtcacgcagacctaagttcaaatcctgactctaccacctatcctggctgtatgactttaagctagtcactcaaccactctgagcttggtttctgcctatgtttaatgggctaataagcatagttaccccacagggttgttgtaaggctcggagtaggtttgcagtaaatgtcagcttttataattattatcattataattatacctctttatttctaatccagtctgttatctttgcttactaagggcttaataaatatttattattattattgtaattattcaagcaaagccaagaggcaggatattgtggggaggtcatgagcaaggggctctgggcttgaattacataggttcaaattctgcctccgccattttctagtagggtgattgggagtgtaatttactcaactttctctgagtctcacgctcctctttaaaatgtacataacaaaagcacctacctacctcagggagtccttcatttagttcagagaagaaattattttaataagcactcagtgcaatacttaaaaacagtaagtgtccaataaaaggttttatttatctgtggtaaatgacctcaaacccctgggaattctctttcttgcaggtcatcaaacgctgtgacatcatactcgtgatggaaatcaaggacagcaacaacaggatctgccccatactgatggagaagctgaacaggtaacatggggaagggtgggccctctagggctcaaggtcaagtgcaagggcatctgaaaacccctgggaactgaaagtaatgtgagatcccgcacttgaccaccagttcacacagccagtgttgcccaggagtccagctcccttagccacggtcctgagaactttcaaccagttgattttactgtgataaaatagaataggggaaatagatgaggggtctggacacagaaagaaatgaaaaaagcagatgaggctgagctaaaaagtacagttatgaagaaaatgttggagaaaagagaaaagattagaaaccaatagtagaagaaagataataaaattacaacatgctcacacacaggaatattatgcagctgttaaaagtcatgctggtggccaggtgtggtggcacgtgcctatagtctcacctacctgggaggctgaggtgggaggatcgcttgagcccatgaggtttaggctatagtgagccatgatcacaccactgcactccagcctgggccacagagcaagaccctatctcttaaaaaaaaaatcatgcttgctacagaataagttagagctaaatattccagcacggaataatggccacaatatattgaaaaaaagcaagttgagaattgcaggtaaaatagcccatttgagtcatcatgttacatgaataagggtgtgtttgtgtttccatgtgcatagagatgaaagactggaaggatgctctccaaactattaatagtggttacttctggtggggggggggggggtgtgatcagagagctgtggtgaaaggggttagtgaaggagtgaggggcacttgcttcttattttagtactttttaaatctgagactctgttgcccaggctggtatgcagcagcaagatctcggctcactgcaacctttgcctcctgggttcaagtgattctcctgcctcagcctcccaagtagctgggattacagtcacacacccactatgcctagctaatttttgtatttttagtggagtcggggttttgctatgttgcccaggctggccttaaattcctgacctcaagtgatctgcccctctcagcctcccaaagtgctgggattacaggtgtgagccgctgcacctggccatctcagcaagaaacacttaatagggacttttgaacaaaagccatgtctgggtcttgggcaggagcaagatgagatggtagatcctggtgccatcatcccccaggctctgggcttatccatcatagggaaggcatgtgtaggacaattgtagggacaggcaagaatccatgtcagtctgcctaagggcttcccttatagtaagggaactgagtgggggacctgcctgagtcacccagccaggaagtggccaagcctacctttgaacttgcgtcacatctgatctcatagccagtgctctattctttgtcatctcagccttccttggagtgtccccagtcaggtttatgggagactgaggggacaggtttgtgggggactgaggggacaggtaggctccagtcatctcctccacagtcagtctggggcgagtcttttcaccaccagtggtcttggcacaccccaacctatctagactgtcgcggactccaagcagagccaagcctgtttgtctctttatcccccacaagccaggatgggccttagtcactttgcaactgagtcaccacaagcagtttgctaactcaggacttggcaggctatgttcaaaatagggccagtctccccaaagtggaagcccggcagaacctactgttcacactcctggggccccaggggctaagtctgccttagcatactgcatctgaagtcccaggaatttctgtaaggtctaagttggcccctaaataccccttctgctttttttccaactgaatctgagaatatgctgcagctttagacatgccctagatctttttgtgagcagatagagtgaaattatgttaggctctgcccagagtggagttatcagcaggtttggtaaacacacagaaagagtccgctttccctggtgcaggtgaggggcaaggtcaatgggacttcatggctgtatccccagcacccaggatataaacaacagtgaattgaaatcgtggtcccaaagcttgtaaaaaaatgcctgatggctttcagaggagagaatattcctgcttatcataaatgctcaggagtggttcgtggacacggacaggtggcctgatgacatttattccaccagaaagcatgagctgcagctgcagccatgggcatgagcggggtcaggggctgattctggccaagattgtcttctagggtctcagtggcctcccacaggtacaggccaaagcatgcgggttttggggtgagttggatctaggttcaaatcccagctttgggcttgcaaaccatagaaagggggtaatgataacactctcctcataaggcaagaaataatggctgtaaagatcgtggcagatgccacattccagccaatcaatggtggctcctctcattggactcaaaggttatgatgaacagtggcccttccacatgatgccattgggcgtatggaggcagattggaaagaaaggaacatgtacagtaggggaatgtttactcttcaagatgcagtgttaaatctttgttttctagaaattcaaggagaggcataacgtacaactatgtgattagctctcggcttggaagaaacacatataaagaacaatatgcctttctctacaagtaagtatcacctatgctccctggaacatggccaccaataaatcgtgaattgaatcaaaatgcatgtcttttcttcaaaaccaaattttgatttctaaccaattctcagtgttcatcaaaataattgctgtcaaaactaggggcctatgcaaagtattgactcttcaagctgaaaacacaaggggtctccaaacacctaatttgttggttggctccatggttggcaggccaggtgttctttactcctcatagtcaagtcctggcccagggctggaaagctgaggttctcagcacagctgattcctgaacttcgtattcttttcctcttcctgctagtaatttcttaagtctgaacattaacttttgggtgccacagataactagtatggctcagatcttcagctcccagattcgcaacagctccctggctgttgagaagagttgacttagccttgttctcaggaaaacgatcctgtgcttgagcctgctctggcttctgagaaagccatgggaacctacatctctgcttcatgaaagtagtaagaaaagggctgactcagctgggaggacttccttttccttcttatagggaaaagctggtgtctgtgaagaggagttatcactaccatgactatcaggatggagacgcagatgtgttttccagggagccctttgtggtctggttccaatctccccacactggtaagacccacacaggcctttctgtctgggacctccccaacggcccatgaatgcgcagcagccttgagcatgagcccattaaggaggcattaggctggatgtgacagtgcattgcttctaatacttcaatgtagacgatgcagttcagtgtgatggcaccaggcttgcttctcagaatgccatgactcaagacttccccagcccagaacccactttctggaagcaatggtagtccactctctttggagagtttaggctcatggaaattgttttctgcaattccttggtacctgtcaagtacaactcttccttcctttttaaaaatcctggctgggtgcggtggcgcatggctgtaatcccagcactttgggaggctgaggcaggtggatcacctgaggtcaggaacttgagaccagactggccaacatggtgaaaccccgtctctactaaaaatacaaaaattagctgggcatggtggtgcgcacctgtaatcccagctactcgggaggctgaggtaggagaatcacttgaaccagggaggcagaggttgcagtgagccgagatcgtaccactgcactccagcttgggcgatagagtgagactcttgtctcaaaaaaaaaaaaaaaatcctaagcaatggcttaggtgaacccctagcctagaggctcactctccctccagtcactgcatcgcagactcctccacaggccgcagcgggtgaggaaatccaaatggattgctccctgaactctaacaacagtacttgtactggcccctgattaagtgccagcctcctgtaatccttgcaatgactacaaggtagggagtaggattatctccactttacatttcaggaaactgaggtttaaaaaggcatggagtcacccagctactgaaatggacaggccagggttgtaacccaggccaccacctcaggagctcatgttcttttttttttcttctgtttttgagatagggccttgctctgtcatccagtctggaatgcagtggcatgatcttggctcactgcaacctccacctcctgggctcaagcaatcttcgcacctcagcctcgcaagtagctcagactataggcatgcaccaccacactcagctaattttaaaatttttaaatagcgagataggtctcgctatgttgcctaggctgttcttgaacccctgagctcaagccatctgcctgccttggcttcccaaagtgctgggattacaggtgtaagccactgtgcccagccagtggttaacatgcagtgttatgcaatgctcgatggagtcaagaatcaaatattttttcagtacctactatgtaccaggctctgttgagggcactggacaagacagaggaggtgacattgggctgtgacctgaagaagtcagccatacagagggctggagaaagggcattccacatggagggcacagtgagcacaaaagctcagaagtgggaaggaagctggaatatttagggggaccaaaaagaggatggaggagtgcagtggaggcctgaggaggagagctggcaatgaggacacgtggggccctggatgcagcctgctgggctgagttctggctcctctctgtgtgacttgagcagtgaccgccccacagcccgtgtctgttgaggtaagagtgggaatccaggctgagaatgaggggaagtcccaggaggagctgctcagaaggcgacagctgctgttagcaggtgggccaggaacggcttctgaggctcgcgcacattgccacactcaggctctcagtcctccaacggtgggggaaggttttcagacacttcacaaaagtctttcgtgaagaccatgctaatttttaaatagctttttggaacttttgttcttaattacaaaggagtataaactgacaagcctcatttttttttttttagacagagttctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagccaggcatgatggtgcatgcctgtaatcccagttacttgggaggctgaggcaggagaatcgcttgaacctgggaggcagaggttgcagtgagccgaaattgtgccattgcactccagcctgggggccacaagaacgaaactccgtctcaaaaaaaaaaaaaggaaacctttaaaaaaaagaagaaaatacaaccataaatatatgcaatttttcctgtcaattaaaaaaagaaagaagagggataaaatacatcagaaacaaaagaaaatacagatttgccacacacacaaaaaggggaaaataaaagcactcacaatgccagcatggaacacagttgttataagtaaaatgtttatttagaaacagaatgcttgttccctggtactgcaaggaaaaatcaacattcagataaaaagttttctcagcaagccaattttactttctgcagaaagggtgctccttgcagatggaacaatggcgagagcacacctgaataaaggagggaagcaatttttatcctttactcagcttgtccctgctactgtgtcctgtctctctattggctggagccagaccacacaatctaagctaacccgactggctaataatttaaacctttcttaaataggtaaaggcaagggagaacaaaggaaaagaggaagttgcttatgccaaatagggaaggggcaaaggctgtgagctggaatgtgcctgcgagctggaatgtccagcacaaatatcttggttaaggtacaaggacatagaatgtactatgtgcctgtgagcatgtctaacagctacataggatagagcttaacaaagagttattagcacaaagcaaggaggcttgaaggaagttagtctttaaaggaaactattatttctaacacttatgatttattctttaataagaagggaaactttgaagaggaaacttttttactttctacaacagtctaccagctttctcttagccatgaagggcaactgggagaaatgagtctttcgtgtactaaaaataggcagcctaatgaccccaagatcattaaaatctcggccactggctggaccctctgggaactggggacccagataatgcagcctgtgccttctggaggggacagccggtttccctccagcagtgtttatgagaccttgacaggggaagtgtgtgacccccgcctctttcctgtttctcagctgtcaaagacttcgtgattatccccctgcacaccaccccagagacatccgttaaggagatcgatgagttggttgaggtctacacggacgtgaaacaccgctggaaggcggaggtgaggactgctgtgtcagacgaattcccatctagcaggggcaggctctggtccctgagtgggatgagtacctctccagggagggggaggaggaagggcatgtgcaggctaccaccacttacagcattctttaaggcctttcttcagccctaagtatcccttttgctaaatctgcctgggtaccctgcatgtgggccttgggaattgccacactttcccattaataacagatgccaacatttactgagtgaatagctagtgccaggcactgtgctgagacttgacatggacaagtttatttaatcctcccaataatcccttgaggtagctacagtacctttctcattcccactttgcaattgagaagtgtaaggcatagagcagtcaggattgtttcagttgcaagggacagaatcttaacatggctcatgaaaaaaaggagcaattgattggtttgtgtaactgaaatgtccaggagtacttcaggcatagctggatccagggctcagacaaggtaatcagagcttgatttgtctcttcctttctatctcctggttgccctttcctctgtgtggctccattctcaggttggctccatccctgggatggcaggacagccaccagcagcctccagaccaaaataaattttctttcccacaaggcaacaaatagtgtgggactgagtctcattggctctgactgggtcaggtgtccatccctgaaccaatcattgtgatcagggtgttgagctactctgattgactaaatctgtgtccaccccagctccaccccaaactcagtttgaggtggaggagggatgggtggtctcccaaaggaacttggggtgctgttttcacagaagggggcacatatttgccatccctataggctcagttctttccacttttggaagagaccacttgtggctgtgaggggctgtgaaagctcttggtaaatatggaagtgcacccaagggttcttcttctgtatttctcttttctcgtttcggaatgtgactcctgtgatcccccttcctcctcttgagttctgctgctcaaatgcaaaatgaatcaaataaagtgtgaacatagtccatcagagctggggcatggaaaagaccaggggtgtgtttcattgcttattaataaataggtcaaaagaaagattcattctttccaaaaattatgaaatcattcacttattaaacaagaatgtattgagcatctattgagtgttgggctgtggggaggcatcagtggcctaaaagtgaacaagaggggaaactgcttcagtgaagcagactgggatgtgattctttttttttttttttcttgagatgaaatctcgctcttgtccccaggctggagtgcaatggtgcaatctcggctcactgcaacctccacctcccgggttcaagtgattctcctgcctcccgagtagctgggattacaggcatgtgccaccacgcctggctaatttttatatttttaatagaaatggggtttcaccatgttggccaggctggtcttgaatgcctgacctcaggtgatccacccgcctcggcttcccaaagtgctgggattacaggcgtgagccacggcgcctggctgggatgtgattcttgacttcaccatttgaacctcccagtcctgtggcctagagcaggtcacttaatctctcaatcctgtttctatagaagttagtgggctcttgtacctcctattgtttattgctgccaggtgtaaatttaaaaacacctagtgctaggcctggcacatagtgaatgttcagcaaatcatgtctatattagcagaagctggtgatcactgaggttaaggatgacactctgtcctcaactgaacccatcaatcacggggaaaattgtgatcaccaaggtcaaaataaaatgttcttgaagaaaactctgaagtcagcaatgccccaccaaacaatagcacaaacaaggaaatctggcacttcctctggattgtggaatgttgaaaattctgttccaagagccttgcagggaaaaatatttccaagataggaagtttctcttggtggccttgggtgggggtggacagctcactcaatggtcccctcccctgaagatgcctcccacctcctcaagggactgaattttcacagaaataagtttccaacttcaaaacaataggagagaaagagtgatgccagggttgtcaatacaccacccaaattcacttttcctgcttgaaagcaaaaggcgttgattcattcgtatatttacaccctacagtagtttgagccagggacaaaagatgtgagggaatagattcactgaaattttttttatccacacctgactctgcatgctgaattatggaaatgtggcgactaagaacagcaaacattctccttcctgttaagaacatcctccctggtacgcactcgcctgtcatcgactcatcaaaactgtgactcaattttaaacaacaaaaagaaatttttaaagaccttatattcatttgctagagctgccataacaaagtaccatactgaagactgggaagtttaaacaatagaaagtgagttcgtcaccgttctggaggctggagtcccagaacaaggtgtgccagcagggctggtgtcttttgggggcctctctccttggtttgtagacggccatcttcttccagtgtctttacatggtctttgctccacttttctgtgtcctaatttcccctttttacaagaacgccagtcatattggattagagcccatccatatgacctcattttaccttaattccctcttgaaaggttctatctccaaatacagtcgcattctaaggtgctgggggttagaacttcaacataggaatttggccggggcgggagcagggggtagacaagattcagcccataacagaccctgttgtttactgggcctgggacgcagagtctttgctagagtccagtgtgaaagcattctgcagcagcacccaccaggtgacagttccaaatcttgtcttttagaatttcattttcatgggtgacttcaatgccggctgcagctacgtccccaagaaggcctggaagaacatccgcttgaggactgaccccaggtttgtttggctgatcggggaccaagaggacaccacggtgaagaagagcaccaactgtgcatatgacaggtaggaggccctgcagggtgctgctggctcaccacagtgcttggtgtgcactaggaaagacgcaaggtggctgggcactgtggctcacgccagtagtcctagcactttgggaggcctcgatggatggatcgcttgagtacaggagtttgagaccagcctgggcaacatgatgaaaccccgtctctacaaaaaatacaaaaattagccaggcatggtggcacacacctatactcccagctactcaggaggctgaggtgggaggatcgcttgagcccagaaggtggaggctgcagtgagccaggatcgcaccactgcactccagcctgggtaacagagtgagactttgtctcaaaaataaaaaataaaaataaaaataagaaaagcacactgcttgcagagctgagtcaattaaatgtcaggcccctctactgggtaccacatgtagcgtatgaaccacaggaccctatgcggtggccctgggcactgtagcttagcagaggtaagcactggcttcgctatcagataggcctggatttaaatcctgacattatcacttcatatgtctgtgaccaagagacaagctctctgtgtctttcatttcctcccctgtaaaatggaagttatcctagtgcctcactcatgaagatccgatgtggagtaaatgaaataacatgtcaggctgctagcacaatgcctggcatacggcaagtgctcattacattcatgggctgatcattgttccatcacaaagacttaccgcaattgatgcgcccaatccccatcattaggcattgggttattaccaagggtttgctgttataaatactgctaaaatcaatatcctctgtgcattttgtgcaagtatttatgatttcctcaggaagcaaccctaaaaatgagaccaattagtgcaacggtatttatatttttaaagctttagctacatattcctaaatgcaatgcatacatttaagtcctagcattccctcgtgctttttaaagtcccttcagggattttcaaacagctttcatctttgctccttcaatggggacagaggggggagtgcctgaggcgtgtgaatgttagtgatcttccatcacagagaccacaggtggggaaacccctaggagcctggtcccaggtggtggccacagttcccagagctcagcctgccacgaggaagtgtgagatggccatctgcatgagagccaccaggccactcgttttcacttcctctcggagttttttttttttttttttttttttagacagagtctcgctctgttgcccaggctggagtgcagtggtgcgatctcggctcactgcaagctccgcctcccgggttcacgccattctcctgcctcagcctcccgagtagctgggactacaggcgcccgccaccacgcctggctaatttttttttttttttgtatttttagtagagacagggtttcaccatgttacccaggatggtcttgatttcttgacctcgtgatccgcccgcctcggcctcccaaagtgctgggattacaggcgtgagccaccatgcccggcctgttcctcttggagcttttgaggctggtgtttcctttgcagaagttatcactctgcaaagtgggaacccaaggcggggagttacaggggtctaagtgcccagaccccctattttgaaggacttccagcaaagcctggacgatggccactcactcagttacacatggcagttgtgtgcccgtgggtaggtcaagtcccttctccagcgccattcttctcccctggcaaatgagtgggaagtgattgaaaatgatacagaagaatcagaaggcaacatggccacagtagatcaggtcaggggtagaacaggttagaaaaagatgtttactaaaaggatcctgattttatacacatgtatcccaaaggatggtgggattacatgtgacattttaaagattcatttcttattttgatgctctgaattttgtttctcataacaacatgtataactcttgtgcctcttttttttcttttttttgagacagagtcctgctctgtcgcccaggctggagtgcagtggcaggatcttggctcactgcaacctccgcctcccgggttcaagcgattttcctgcctcagcctcccaagtagctgggattacaggcatacacaaacatgccccgcttttttttttttttttttttttttttgtaattttagtagagatggggtttcgccatgttggccaggctggtcttgaactcgtgacctcaggtgatccgcctgctttggcctcccaaagtgcttggattacaggtgtgagccaccatgcccggcctcttgtggcttttaaaaagtcataggccagttgtggtggcatatgctgtaatcccagctacttgggaggctgaggcaggaggatcacttgagcccaggagttcaaggctttagagcaacatgatcacatgcctgtgaatagccacggcactccagcctggacaacatagtgagacctgtctcaatacaataaaataaaaagtaaaattaaataaaataaacggagaaaatgaaaagccataaaaatgatgttttaaaaatgtaattagacaagatggtctcagttccagtctttgttccatgttcacatatttatcaaacacctctcatgtgctgagtgctgggggaacatgcaaagatgcccaggatctggctggtgccctggactgaaaacgtcacatgaacactggcctggtcctgcacatccctagaagaagtcagaaatggaagagcctttaacatgtcattctttgctttctgagtcttaaagaaagctttcacaaatgtctaacttgatgcgaagaatttacatttgggttgaattaaaagccgtagcccgggccgggcgtggtggctcacacctgtaatcccagcactttgggaggctgcggccggtggatcacgaggtcaggagatcgagaccatcctggctaacacagtgaaaccccgtctctactaaaaaatacaaaaaaaattagccaggcgtggtgccgggcacctgtagtcccagctactcgggaggctgaggcaggagaatggcatgaacccaggaggcagagcttgcagtgagccgagattgcgccactgcactctagcctgggtgacacagagagactccgtctcaaaaaaagaaaaaaaaagccgtagccctggagcggtggcttacaccggtaatcccagcactttgggaggttgaggtgggcggatcacctaaggtcacgagttcaagaccagcctggccaacagggataaaccccgtctctactaaaaatacaaaaattagccaggcgtggtggcacacacctataattccagctacttgggaggctgaggcaggagaatcgcttcaacccggaaggtggaggttgcagtgagctgagatggcgcactgcactccaacctgggtgacagagcatgactgtgtctcaaaaaaaaaaaaaaaaaaaaaaaagttagttgtgctggtgatgttagcaaatgcagataccaaaactgttgattagaatggggaaggcccactggtcactcatgaaatggcagtttgactcaccttgccattcctcgggaagtcactcaggaccacgtagaccacaactgcatcacccaacttgggatatgttagtttgtttccaaaactcatttgactacctcattcttactttttgtcattattgcaaagcacatatgctgtgatttttctcgatattttccattaaatcgcttaatttcttgctgaaataaatttttaaaagaaatttcatgatactagcatgagtaagaaagcagcagcatttgccataaattgaaggtaacgtaaaaattaagtccagtgaaaatcacgccttgttaaattctgccttaattctcttgcctgcagaatgctcggagatggcagcctactctctgtcaacacgggactgagggaggtattaaagacaaaccagcacctccctgagaatttctccataatcaaatcagggaaagtgaaaaataattgaaaaaggaacagcgttctcagtacgcaagtcattgttgtgtgggatagtgtgcgtgtgtcatataaaatcttctcctactccaccagaacattgcccacactgggagacagtgtcctggtgtccacagaaccatggcagggactgatcctatttcacagttgtaggcactgtcctttagggtcacaggctaaaaccagctctggactttgagcgccacatgaaagggccagactgctcggttaattccagacagcaaacacagaccttggtttgatctcagcaatcacaggttggattaacacaactgttttccctccccttgttccaggattgtgcttagaggacaagaaatcgtcagttctgttgttcccaagtcaaacagtgtttttgacttccagaaagcttacaagctgactgaagaggaggtaaggttgccatcttgtctttctatgccattgtcctggaaagatgagttagcttgggcaacatgatgagactccatctctatgaaaaattcaaaaaaattagctgggcatggtgatgcatgcctatggtcccagctacttgggaggctgaggtgggaggatcacttgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctccaaaatttctgatcgagctggtcttggaatgacgcttaccagtaagtgttctgtggggtgacttcgggcatttcctctcccctccctggtcctaaatttgctcatcgctaaaatgaaagcatctcccaggcatctcctaatttccatgtctacctcccctttctccttataggccctggatgtcagcgaccactttccagttgaatttaaactacagtcttcaagggccttcaccaacagcaaaaaatctgtcactctaaggaagaaaacaaagagcaaacgctcctagacccaagggtctcatcttattaaccatttcttgcctctaaataaaatgtctctaacagatatgaactgctccctgtacttaggaaacaagagtgatccaactgctttcattttttgacctgaatttattctgacttgagccaaattggaaggagaatcttttgtatctctcttggtctcatacctcccctgaattgtctaaaagggaaccaggggcatttgtagaccaaaatgatgatcttcatgccctgagccagagccccatccactgtcactggccctgctcaaccctgtcatgcgagaggctgcagggggaggaagagcgtcagctttcagtcctcatgaggggtcctgttccacacgcaatgaccagaaacaccaaggccccagctgcccctgtgatttgggcaattaactgttttaagagtctgccccctcctctctgaggtcaggccaccatcacgtctcacagtgttgagggataaaggccactcccacctggtttctctgccttcgaattgtcctccaactcagccagcccaggaagcatcagtgtcatcctctgaaatactaatctgaccacagcccaccctcagtcccaccctcagtcccaccctctgcccataaatccttcagcggctcccatcaccatcggagagagctcagtcttggccaccatgaaggtctctgctatctggcttattgcgccagccccaccttctgccagggtcccaccctgaacccctgctccaggaggatgtcctccgccctgcataccccatgctctccctccctgggggccttggctctgccccccccatgccctgccctattccagagcccgggccaagtgcccccagccctcatgtgcgccctacctctattgcaacatccaccacattatatttgtcaccaaggtcagtgttggaggtctttggggccccagtgtgacaaacacctagtgggctggctgggactcgaggattttgttatctttctgcaatcaaggaggctcattggagtccaacaacacagcaccatttagcctgtatccaaggtgcccatttttgtttgttttgctttgttttccctgatgtttctttgttcaagtcatacacgaacatggctaaatgtgtgaacagtaccgaagaataagcagggaaaaggaatgccgtgccctgaccccatccccgagtttcctgtctcagaaacagcccctcttcccagctcatgtgtttttccagagagtctgcacagaaatgagcactatatgtaaccttaaaaatacaaaatatagcacaccatatgcatggttccactcttcgcttttttcctttaatatattggggatgatgtgacttttgatgtaggagaaaaagaccttaagtctgacacttgaaattatgtaacatctgactgggggaataaaatcaaaagggccctggttaagcacgggaagccatcttcctcaaatgtccaattaacctcattggacaaaggtctcactggaattggtgaggggtgagtgatggcaaggctgctaacacatctgtcacccttctcctaagccagagctcatagtcccaggaaacttaccagtttccaaggtccaaaatggtcaaacaaggtcaggcgaggtggctcatgcctgtaatcctagcactttgggaggccagcctgggcaacatggcgaaaccctgtctctactaaaaatacaaaacattagccaggcatgctggtacactcctgtagtcccagctactgggaggctgaggcacaacaattgcttgaacccgggaggtggaggttgcagtgagctgagatcgtgccactgtactccagcctgggcgacagagtgagactctgtcaaaaaaaaaaaaaaaagtcaagcaagtcataaatgggcttattccggagagagaggctcatccttctgtcccaaagtactgcaagctccgaaagcccacatggctgggataagaaccctggctgctggggcttgagactccatgctgggtgggggaggaatgggaaggaggaccagacactaaatgagtcagtccatggctctgacttggtcctgacaccctgcagcttcctcccaacaagacatctctccactcctgcccaggagcaggttactggagccacaggcatctgccagctcttattccggccaaattctgacaggcaagagggcacagcgcagggcatgtctcactgcgcataacctaatggagctgcaaacatcctcctgtccctttgggtcacctggcctggcctgggcaaggaactctggtggccttttggggaaaatgggtgtcccctggtcataggcacccttttagccttggctttgtccaaagagtctaaagcttggctgggtgcggtggctgacgcctgtaatcccagcattttgagaggctgagatgggaggatcacttgaacccaggagtttgagaccagcctgggtaacatagcaagaccccatctgaacaaaaaataaaaaaattagctgtgcatggtggtgcatgcctgtagtcccagctactcagaaggctgaggcaggagaatcacttgagcctggaaagtcaaggctgcagtgagctgtgatcgtaccatggcactccagcttgggaaacagagcaagaccttttctcaaaaacaaaacaaaaaaaacaaacgaacaaaaaagagtctaaaccttggtgtgcactggaatcccagggaaccagttaccatggtgattcccaggtcccagtctcccagagtctgggccagggcccaggaacctgcaatttcaacaagtcccccggttgattccaaggcacatgatctgaggcccagatttgaaatcactctcccagtcccccttggtgaggcgaggtgtagcatggtagcaaggaccaggctcactttggagccatagtctctaccacctaccagctgtgggacctcgagcaggctacttacctttagtttccttgtgtgtaaaacagagataataagagaatcaacctcataggtaaagtttaaataagatgatggatataaggcatggaggatgtgcctgatgcttagtaagccctcgataaattaaattcccttacttgtatatttgtattaacagggcttgctctgttaaagggtaggccgctttaagtctgggtgtgcaggttgctcgagcttagttattcagaatgaatttttgccacacaaggaatcatgccagggttccatttctttgtcattcaccacggcaaatattttggcaggtaaccctgaggatggagacgcccctgcttccagtccttgtgacatccttttccttgtcaacaccactttcctgccacaaatacagaaaccctcccccagtgaccttctccctgaccctgctgggggtggggtgggtgaagggagcttctgcaattcagcaaccctgctcctatctctcccttgggctggagagggcaagtataaagagtagttgccaaaccaggaaagggcgacaaactgggggccacatccctcgtccctcccggaaagaggaaaggcacccagcccaggcaggcgtgagggtggaaagcagggcagctgagagaggctcacatttgcatcagctgctgagtctcctgatcagggcgggcttccacctgaatgatcctgaaggagccagcatccccatgtcacttgcccatgggccatatttcaaaggaggagcgggtccccacggtccccaagaccctggcaacagtggcgtcaatctttgggattcagggaagctactaaaattaaatcaaaataagggaatttgaggaaacaagaatctatggatgcaggtttgtgtgtgtgtgtacgtgcacatacacacgcactcagctctttcccag

SEQ ID NO: 12439 - DNA, 118136 bp, Human
  misc_feature (1)...(118136): n = A,T,C or G
agcctctcgagtagctgggattacaggcacgcaccaccacgcctggctaattttttgtatttttagtagaaacgtggtttcactatgttagccaagctggtttcgaacctctaacctcaggtgatctgccctccttggcctcccaaagtgctgggattacaggcatgagccaccgcacctggcgctttttgcctatttctttgagacctggggttttgggtcacaaaacaggcaaatgccatgagccaccctcctcctctttctccatcttcttgtgctgcctcaggtcagagcacttacctgctcctgccttctcactgggtttccttgtctctggcctatttgtctccagaggggtcaaaacacttcaaatcctcctatttgtctctgtccactgtcaggagttccagttcccagaaccccaattttgcctacaaaatagcgtgtcttttcacggggagaggatttgttgagttttagtgggtactcaaaaagatctaaagccagttgggggggttcacacatgtaatcccagcacttttgggaggccggcctgtgagggtcgtttgggcgcaggagtttgagaccagcctggacaacacagcaagaccctgtctctataaaaaataaaataaaaataattagctgggcatagttgcgcacgtctgtggttccagctactcgggacgctgaggcgggaggatcgtttgagcccaggtgcttgttgaattgagctatgagtgcactactgcaccccagcctgggcaacagagtaaggacccagtttctaagaaaagaagattcattagctagacgcggtggctcacacctgtaattccaacactttgggaggccaagacgggcggatcacttgaggccaggcgttcgagaccagcctggccaatatggtgaaaccccgtctactaaaaatacaaaattagctgggcgtggtggctcacacttgtaatcccagctattcgggaggctgaggcaggagaattggttgaaccggggaggcggaggttgcagtgagccaagatcgcgctactgcactccagcctgggtgacagagtgagtaccccgcctcaaaaaaaagaaaagaaaaaagattcatgatctgctaaagttgaagaagtgggggaaaacattggagtgttagcggcgtcaagatcgggcgtgagcagaaagggcacagcatttgcaaaggcgtggaggagtgattttattgcgttctatccctaggaagcaatgacttggcctctaccatttgcagagcgcattgggaccctgctcccagagctggtttgcagtctgggaactgagatgcgctctgggacttgtagttttccccagtgccaggaaactcaaaaatcgagacatcggatcccaccacgaggtgtcgcccttgagcgagtacggtgggatctatcctatacttcagaaggctgttgcagacatccaacaatcacaaggaagaacgggagtttttctgattgacagatatggttctcaatgatagtcaagattcggatgttaaagcccgccctcttttgcctggttggctggagcaacgaagtgatatttatatgaaccaatgggaaattcttagggaacgaggtagtagctcaatccccaacaccattggtccacattgtctactggcacgtctgcctgccaataagatggtggaacttcgccaatgggcagagccaacgtgcctttttcggaaacacccccttcctctcttgacaacttgctttctgccgctattggctgttgcacaacagtgacggttcttttgtccaataagtcagcaagacggtccccagggggaaggtttactcaaccataggcccgtgcctagtttttattggctagtgtatccgagtggcggtgcagcaggccagtcgcgtgcggcgcgagtgctttgggcgcagcccccggggccggggcgggaggtcgctcgggtcgggtgtcgcctgagaaccggatgaggcggcgaccgtgaggccgagccgggagcgggcgtcttgccgaggcccgggcgggcggggagcaacggctacagacgccgcggggccaggtcgttgagggtcggcggcgggcgaggagcgcagggcgctcgggccgggggccgccggcgccatgggcaaccgcgggatggaagagctgatcccgctggtcaacaaactgcaggacgccttcagctccatcggccagagctgccacctggacctgccgcagatcgctgtagtgggcggccagagcgccggcaagagctcggtgctggagaacttcgtgggccggtgagcgggcgcggcagggatcgcgggcgggtggcggcctagggcgcggagggcggaccgggaatggcgcgccgtgcgccgccggcgtaactgcggcgcttgcgtgcccgcggcggggaaccggacggggtcggggaggcgggccctgtgggacgccctgggcagaggactccctgcaggggctccggagcaggcccgggccccaggggcggtgtcacgggccagggcgccgtaggacaggaggtgcgctggaaccctgcggtccatctggtcccagctttcgtgggtgaagtctgccatctggttggccgtgggtctggggtagatccctcttctgctctttcgggctgtccatcagaggtgaaaccggccatctagatatctattggggcgaccgctgcggtctggctggcttgttcttgtatctggagctgcccccgccgtctggttggctgtctctctgtcctgggcaagcctccctgccaccaccatttggttgtccatctgtccagtcccacctggcagccccctgctgtctggctagctgtccagggtgacctctgctgtctggccgcccatccgtgcccctcacagactttaacactgagcagtccctctgttgggtgacaccagctggcctctactgtctgactggctagctgactcctaggggaccctgtttgattctctctggctgactcttacagcttgattcctggctagcgctggctcctctcttccgtgtgaattcttctgtctgtctggccatctcctagtctgcccatgactacccctgagtgtctggcacaacggctctggaaaggggtggtaggagggtagaggggagaacagagctgaaggaggaggtttggaccctacttcccctctcagctggaaggaggactctgggggtaccttacttcaggattcctttccgagtgctagaacacaggggcccgcctcccagctacagcctacaaattgggggccctcctttggagcctgggaaggggcttcttgcgtgatcaggcctcagtggctagcgctgggatgtagccttctctggacagccttgagaagccgcggtgtgcccatctgtccagtgggcaaactccactctctggggctgtttccaggattcaggaagcaaatgaatgagaacagcccgtgcagccacctctccctcccaccaacccctctttcctttcttgtctcccagatgggcggccacttctccattccaggaactactcatttgtggtggtgtggctgccaaatgataacatcctcctcctgtcattattgtcattgttattgttgttatcattgtcaagggataatgtcccttcttgattcaacatcttgaatcccaagtaaggagtggggtggaggctgtgttatcatccccaccttagctgagctgggaggctcagaagggactgtgatcacccaaggccactaggctggcgtaaggccttgtgtctgccatcccagagccttggggctttgctccaagcagcacaaatctcctcttttgctaccttgtctctagctcattgccttctgtctaccgtggtggaaaggtgtggacttgcagccagctgggcctggcctgatctcaggctggactgtggtgtgggcccctttgagtgaccatcttcctgcctgcccaggcttctgggacgggggtggggggtgtttgcaaagctctgtctctttcacttgccttgtgaccttgcacaggttgtcttggcctctctaagtcttggttgactctcctaaacaagtttattttattttatttatttatttattttttttttttttgagacagagtctccctctgtcatccagtctggagtgcagtggagcaatcttggctcactgcaacctctgcctcccaggttcaggccattcttctgcctcagcctcccgagtagctgggattacaggcgtctaccaccaagcccaactaatttttgtatttttagtagagacggggtttcaccatgttggccaggctggtctcaaactacttacctcaagtgatcctcatgccttggcctcccagagtgctgggattacaggtgtgagccaccaagcctcgccccaggagttccaagaccagcctgggtaacatgacaagatgccattctacaaaaaataaaaaaattagccaggtagggtggtagtcccacacctgtagtcccagcaactcaggaggctggccctgggaggactgcttgagcccaggatgtccagactgcagtgagccgtgattgcaccattaccctccagcctgggtgacagaaccagatccggtttcaaaaaaagaaaagaaaaagtgcttacttacctaacgcactgcctggcacatagtaggtctacatggatggggctattgttgtttatctggctggttcctttgctatcagggacaaaagctaaccagaatgaaagtgctttcacgttacacacttaagccttatgagggaggcattgctataatccccattttacagagcaggaaactgaggctcagatagctgagcagaacactctcactggaggctgtaaagtgaggagttaggtgttctgggttgggaacctgggtctctctcccatccttacctctcctcagtccctctaccccttgcctttctctcctgtctaccatggtgtctggcagctgccggccagtatggagctggttcctgtggcgacctcctagaatcctgcaatgcaggagttgctcattatatatatatttttacaccgagtctcactctgttccccaggctggagtgcagtggtgttatctcagcttactgcaacctccacctcccatgttcaagcgattctcatacctcagcctcccgagtagctgggattacaggcgcgcgttaccacacccggctaatttttgtatttttagcagagatggggtttcaccatgttggccaggctggtcttgaactcctgacctcaggtgatccgcccacctcggccacccaaaatgctggcattaaaggtgtgaaccaccatggctggcctcgttaagagtattaattcagtacctgaaagccaaagttgtaaaaaggcctctctttgggtatgaggggctcaaacaaggcttacttttttttgggggggtgtaagagataaggtctctctttgttgccgaggttggagtggaggggtgcagtcctagctcattgcagcctcgaactccagggctcaagcaatcctcctgcctctgcctctaaaagcactaggattacaggtgtgagccattgcgccgagcctggattttctaaggatgtggtccgagtgggaacagcccagttagttcagccctatagctggaagtccagatcactggctctgggggccaaggcctgcctgctgggtcttttgttttacctgcgtagcttttgtttttaataagactttccagtgttagatttccagtcaatatccggatttcttgtggctctaagacactcagatctatagagttctgagttgtcatgcaaaggctgtgggcctaaggcctggttccaccatgtctggctgtgcgactcggccacgtggatttggcgttctgggcctcagattccttttctgtaagctgagggtggtaactggtaccctggggcctagatgggtgattgggtgatgcgtgccgagtgcatgtgtcttatacgcatggtggctgttgttgtaatcagtttcacctggcgttgctgagcctttgtcccttgtggcagtaatggcttcgatttcagaagcaccagtcactgtcccatcagactaagagtggccactccagctgccacagtccccactactccctagcactcacccaggcctagatcattttgcttggagcctcctggccctggaacctttgagtttgagacccctggcttgtctgcggtgcaccagcagatagaactttggccctaaggagaaaggagggcatcactccctcttgacccttgtcatttagcctcaggggctggccagaaggaaggccttaggcattcccgcaccctagcctcccgagtagctgggactgcaggcacccgccaccacgcctggctaatttttgtatttttagtagagacgaggtttcaccatgttagccaggatggtctcaatcttctgaccttgtgatccgtccacctcggcctcccaaagtgctgggattacaggcgtgagccaccgcgcctggcctgagatagggtcttatactgtcacccaggctagagtgcagtggcaccatctctgctcactgcagccttgacctcctgggctcaagcgattctcctacctctcagcctcctaagtagctgggactacaggcacgtgccaccacgcttggctaatttttcattttttgtagatacagggccttgctgtgttgcccaggctggtctcgacctcctcgcctcaaatgatcctcctgcatcagtctcccaacgtgctggcattacaggtgtgagccactgcgcccagcctcctcttcattaaaatacaagttataatagcacttctttccctttcttttttttttttgagacggagtctggctctgttgcccaggctggagtgcagtggtgcgatctcggctcactgcaatctcgcctcctgagttcaagtgattctcctgtctcagcctcccgagtagctgggactacagttgcgagccaccacacctggctaatttttttttttttttttttgagacggagtttcattcttgttgcccaggctggagtgcaatggcacgatcttggctcaccgcaacctcccctcctggtttcaagccattctcctgcctcagcctcctgagtagctgggattacaggcatgcaccaccacgcctggctaattttgtatttttagtagaggcggggttttcccgtgttggtcaggctggtctcgaactcccgacctcaggtgatctgccggccatggcctcccaaagtgctgggattacaggcgtgagccaccgtgcccggctaatttttctatttttaatagagatggggtttcgccatgttggccaggctggttccaaactcctgacctcaagtgatcttcctgccttggcctcccaaggtgctgggattgcaggtgtaagccaccgcgcccagccccgtcttctttaaaataggagttataatagcacttctttccctttcttgaatagggattaagtgagacagtttggagtgcttggcatagaagaagtgcttaaaacattaggtgttgttcgttcattaaaaaatgtttcctgagtacttttactgtgtgcctggggacatggccctgagcaagttaccagaacttctgctctggaggagctggcctttcagcaggaagcaaataaaggagaagcatgggccacttagtggctcaggcccacaatctcagctctttgggatccaggcgggaggatcacttgagcccagaagttggagaccagcctgggcaacatagaccccgtctctacaaaaaataaaaacattagctgggcatggtgacacctgtagtcccagctactcaggaggctgaggccggaggatggcttgagcctgggatttcaaggctgcagtgagctctgatcacgctactgccttccagcctgggcggaagaacgagacctcgtctcaaaaaaaaaaaaaaaggcgataagtatgatggaaaaaaggatcaaggagcaggatgagggagagatcacagttggagggggtacattttattttattatattattattctttgagacggagtctcactctgtcttccaggctggagtgcagtcacgcgatctcggctcactgcaacctccgcctcccaggttcacgccattctcttgcctcagcctcccgagtagctgggattacaggcgcctgccaccaggcccggctaattttttgtatttttagtagagatggagtttcaccatgttagccaggatggtctcgatctcctgacttcgtgatccgcccgcctcggcctcccaaagtgctgggataacaggcgtgagccactgcgcctggccagagggggtacattttaaatagggaaattggtgacatttgagcagagccttgaaggaggcgaggaaggaacccctggagacgggaagagaatccagtgcaaaggtcctgatgtgggaggatgcccggaggccagtttagcaggccagtggagggagatcagatctgggagatattagggtgggaccaggcctctaggaacattgtgggcagggaggctgtctgagcagagggaagtaaagctggtggcgctactgctgtccctctggacctggccaagctgagggctctctcctttgatttccagcttcaactcagttttctcagtaagcagactccacaggcatgtaggcgccccgtgccatttttcttttaataagaagcagctgtgccggggatgctggcgtttccagctgcgtttttatttggcctttggtgatgtgtccctccagggatatgtggatgagccgcgggggcactgcctgtgcctcagtgggtgctgcaccagtgcacatcggatgcccgttggctcctgtccctgacagatggaggggcacgtgatgtgttccttgggctggtttgtccctttaacagatcttattagtttagagccacttggaaatgacatcttctgtttccagtgactttccttttgggcaaagacaaattgcatcttgaaaaggccatacatggccgggcatggtgactcacacctgtaatcccagcattttgggaggccgaggcaggcagatcacaaggttgggagtttgagaccagcctggccaacatagtgaatcccgatctctactaaaaatacaaaaattagccaggtgtggtggcgcatgcctttagtcccagctatttgggaggctgaggcaggagaatcacttgaacccaggaggaggaacttgcagtaagcggagatcacgccattgcactccagcctgggggacagagtgagactccatctcaaaaaaaaaaaaaaaaggaaaaaaggaaaggccatgcaaggctcggttagggtggtctgcagtgctgggcctgctggaattggtacagtccagagggatctgtgggaatatggaaggcttggttctgccacacaccaaaaaagtgacctcacttctctgggcctcagtttcctcatctggaaaatgggaacatggtggtctctgcctactgggagtggactgagaatcacgtagcaaattgttgtgaaacaggcagcatttgtgatctcgttggttggcttttgtctccttttatctgggatcaggactctgatgacaggtgtacgtttcttttctcttgctctgtcccccagactggagtacagtggcgtaatcatggctcactgcagcctccaactcctgggttcaggtggtcctctcacctgagtctcctgagtagctgggactataggcatgagccaccacacctggctaattacaaaaaaatttttttggcagggagcgatggctcacacttgtattcccagcacttggggaggccgaggcgggcggatcacggggtcaagagattgagaccatcctggccaacatggtgaaaccctgtctctactaaaaatccaaaaattaggtgggtgtggtggctctcacctgtagtcccagctgctcgggaggctgaggcaggagaatcgcttgaacctgggaggcggaggttgcagtgagccgagatcgtgccactgcactccagcctgggcgacagagcgagactctgcctcaaaaaaaaaaaattttttttttttagagacagggtcttactttgttgctcagtttggtgtcaaactcctgggcccaagcgatcctcctgccttggcttcccaaagtggtggaattacaggtgtgagccgccgaacccggccttagtttctttttccttaaagagaaggaactcatcattactctgttgatataaatggagtgcctatcagtgcaggcaatgttcttgctctggggatacagccaggaccaggacatgcaggcacgccctgttccccagatcctgaaatatcgaccagaagttgttcctggttcctttctaagtgggaatcatggctgcaaacaagtaattggccgtgagagttatttacacacattttgtgtacggtgatgagaaatgggagaaaaaatgcccagcatcggatcaccagaggtcaggagttcgagaccagcctggccaacatggtgaaccctcatctctactaaaaatacaaaaattagccgggcgtggtggcaggcgcctgtaatcccagctattcgggaggctgaggcggagaatcgcttgaacctgggggacggaggttgcggtaagccgagattgcgccgctgcactccagcctgggcaacagagcgagactctgtctcaaaacaaacaaacaaacaaaaaccaatgataggggatttggccagataagcgtgtccagacaaccgactatcaactcgctactcagagggatctagaagaatctttaatgacccagaaagctgcacaagacctgttaggtaccagatgaaatgggctgtgggatcctgtcttgtttaaaacgattgtatttgctcagtgaaaagaccggaaagacatactctgccctaaccccacatgtgaatcgtctccccatgtgattcttggtttgtttttgctggtttggggattaggtttataatcaggaagacagatttctccaaagctgcgctctaggctgtccaagtgctttttcagagttacttattgacggataacagcccttgataggttcataacattgaaatcccctggtaataacctggattgtttctggatgagggcggaagatggccttggggacagttgtagatttagagaggaggttttcttttcttttctttttctttttttgtttttttttgagacgggatctcactctgttgcctaggctgaaatgcagtggcgtgatcacagctcacagcaacctcaacttcctgggctcaagggatcttcccacttcagcctcccaattagctgggaccacaggtgtgcgccaccacccccagctaattttaagaaattttttgtagaggtggggtctcattattttttgcccaggctagtctcaaacccctgggctcaagtgattctcctgcctcggcttcccaaagtgctgggattacaggcaagagccacggcacccggcctaggttagatttagagttttcagagttggcttaggcggtagaggctggcctttgaatggaaccctgtctcgctgtcgctctcagcgtttatatttggctcagagccacatctgccaaacttctgcccgatttgaatgaaagtgctgaaattataggcccctcggctgctgaaaaaaagtgagaacatcatgtaaaccgtaatttactgggattgccaactacaagctgtaattaagcccttattgtgttaaagctttggaaaaatccaagccaataatgagatatttatagggcattagctacaatctgaataaagggaaaatgtggccctgcgtctgaagcaggactgcaaagagaggaaagacgcctgcttccgggtgcgttttgggtttctgtgaatattggtaactaggtccctgctgggtggtgggaaattttcccctgtggcgtcacccgtagcttgaaccgggagctggatgactgtttcagtttcatctgctgctggacatttatgatgttaagagccagtgtttatggagaatcaccgtgtgccacatgtgcaagatctgaccagtgtcttctctgcccaggggtggcagctgctgctcttagcatccctgctttataggtagagaaactgaggccagagagggagactggcctgaagtcacacagggaggaggacagaggagttggagcttgaactggatgtgggccctctagagccacacatatggcggctttgggtgggaaggtgtgggcctgactcttgagagcagggctgaatggtgggcaccatggcgtttgtatctgaggactgggccaagattacagagggagtgagcaacgcgtggctttggatatgcatcgaggttgtcagctctgtgtccagcctgcgtgtggtaagcagcaaccactctacaccagttgctgggcacccagcagggactgggacagacaggacaggtgaacagttaaatgagcaagaacattctggggcaggcacaggggctcacacctgtaatcccagcactttgagaggccaaggcgggcagatcacttgaagccaggtgttcgagaccagcctggccagcatggcgagccccatctctaccaaaaatacaaaaattagctgagcatggtggtacttgtctgtcgtcccagctacttagcaggctaaggtgggaggatctcctgagcccaggaattcgaggttgcattgagctatgattgcaccactgcgctccagcctgggtgacagcaagacccggtctcaaaaaaaaaaaaaggctgtatgcggtggttcacgcctgtaatcccaacactttgggaggctgaggtgggagttcgagaccagcctggccaacatggcgaaaccccatctctactaaaaatataggcaggagaatggcgtgaacccgggaggcggagcttgcagtgagccgagatcgcgccactgcactccagcctgggcgacagagcgagactccgtctcaaaaaaaaaaaaaaaaaaaaaaaaaaatataaaaaattagccaagcatggtggcgggcacctgtaatcccagctactcgggaggctgaggcaggagaattacttgaaggttgcagtgatccgaggtggaggttgcagtaatccgagatcatgccacggccctccagcctgggcaacaagagcgaaactctatctcaaaaaaaacaaaaataaaaatattctgaagagtgagaagcggtttgccctgtactgcattgggtgggggaatggctgcagggggctgcttcacatgtggcttgttgggatgggtgtcctgcagtggaatagccccgccaggacttgggggaacagcatcgcaggccagggaaacagcaggtgcagaggcctcgcacacacccggcccgctgagtgccccctgcggaccggaaaggaccagtaggcacgtgagagttaggacgctgcccgtggaatgccgacttttctaaatttgaattacgcaagtagagcgtggagacagtgttcttggaaaaagggaaaccattacagatgaggaagagcacactgcccagcccgtcccttcctccagctctacctgggagcaccactgtcacttcagggtatgtctagccagacccctctggtgtttctgtacttaggtacatgctggtacctatagagaatacgtggcaccattatgggtggttattttttttttttttggaacaggtctcactctgtcacccaggctggagtgcagtggcacagtcatggctcgctgcagccttgacatcctgtgctcaagccatcctcctacctcagcctcctgagtacctgggacaacaaccacatgccaccacgcccaactaatgtttataatcttttgtacagatggggtttctctatgttgccaaggctggtctcaaactcctgggctcatgcgatcctttcacgttggccccccaaagtactgggattgtagacatgagccacctctcccagccacgtgcatatatttgttgaatgaaagtagctaaaggctggaagtggtgactcacgcctgtaatcccagcactatgggaggccgaggcaacatggcttgagctcaggagtttgagaccagcctgggcaacatggtgagacctcgtctctaccaaaaatacaaaaattagcaggcgtggtggtgcatgcctgtactcttagctacttggaatcccgaggtgcgaggatcccttgagctagggtagcggtggaacttgcagtgagcccacactgtgccattgcactgcagcgtgggtgacagagcgagaccctgtctcaaaaaaaaaaaagtagctaaaaaccagaatggagtgaatttcactgcacagtcatggaggggaccaggcagaggacagccctgggtcttggttttggagactcacagcctgcctggggatgcagggaccctgaagcaaggacatcttcctttggaggaagtggagatttgctccatctatataaagagtaataacagtaataggctgagaccctgaggctgggcagcgtgggtgtctatctgcgttggcttcgagggctgtaagatggggctagcagcgtcccctccagggtgggagtgaggccctgtatggcaacctgcggggtgccccctctgacttttgcttcctgcctggctgctcagtggccctggcaggggcaggcaccactgctctttctgttacaagagacctcctttggataaatctgaacacgctcccatggcagacctatggggcggtagacaagaggccagcagagctgtcccaggccctggtgacacctccatgcccaggtgaaggaggagcaggctacttggagcctgccctgtgacacactttcgcggtgatgagagcttctcagggctgcgatcctggcgggccagtcaagcgggcaggagcagccccagccagggtgaccctgcctgctgggtgatacgccctggcacgaccaggccagccctggggaaagcccccagggcggatcagggagggacacagctgtcctggccatgagacttctgtcttttgtatggatacacagggtccttctagagggtcacagcctccacccccgggaggcctaccagctggccgcgcagccaggatcctgcagccaccaggacactgcctttccaggttgttcttttcttttccttctttttttttttttttttgaggcagagtctcacagtgtcgcccgggctggagtgcaatgcatgatctcagctcactgcaacctccacctcctgggttcaagtgattctcctgcctcagcctcctgagtagctgggattacaggtgtgcaccaccacgcctggctaattttttgtatttttagtagagatggggttttgccatgttggccaggctggtctcgaactcctggcctcaggtgatccacccgcctcggcctcccaaggctctgggattacaggcgtgagccgccgtgcccggcccccaggttgttcttttctacatcaacatcaggggacagtgactgagagaggccacgagccactggctcagcttgacgaaggcttcctgtggtttgggttgatgtatctctctgtcttgcaacactgagttccccgttgtctgggcggaagccagtcagacggaagcccggcttctgtggtgcctgccctggtggcctggacaggttgctgggaagctcaggtcaggctgctttctgaggtggggaggccccacctggaatgtgctcccagcactgggtgaaaattgatgcacaggcttgattttttttttttttttttgagacggagtttcgctgttgttgcccaggctggagtgcaatggtgcaatctcggctcgctgcaacctccgcctcccaggttcaagcgattcttctgcctcagcctcccgagtagctgtgattacaggcgtgcaccatcacacccggctaattttttgtatttttagtagagactgggtttcaccatggccagactggtcttgaactcctgacctcaggttatccgcctgcttcagcctcccagagtgctgggattacaggcatgagccaccgcgcccttaaactcttttctgttaaaggagttattcaactgtttactcgttgtggagaaaaaaaaaaaaaaaaaaacaggccgggcggtggctcatgcctgtaatcccagcactttgggaggccgaggcgggcggatcacgaggtcaggagattgagaccatcctgactaacacggtgaaaccccacctctactaaaaatacaaagaattagctgggcgtggtggcgagcgcctgtagtcccagctactcgggaggctgaggcaagagaatggtgtgaacccaggaggcggagcttgcagtgagccgagatcgcgccactgcactcccgcctgggtgatagagcgagactccgtctcaaaaaaaaaggaaaaacaattcaccctgtccggaagtgcacagagtaaggctgggtgtcctttgcatgggaacgacctctagcagtctgtggctcttgccagattttttatatatatatatatatttctaggtgtgactacccccgactcatccaaccagtgagcctataagtctagtaacaaacgctcccgctccacagtccaaagtctcaacagaatgtgactgtcttgcaccaggtccctgctatatttagtgcctccaagaatgtttggcttttgttttctgttttttttttcttttgagacaaagtctcgctcttgttccccaggctggagtgcaatggcgcgatctcggctcactgcaagctccgcctcccaggttcaagcgattctcctgcctcagcctcccgagtagctgggattacagacacctgtcaccatgcccagctaatttttgtagttttagtagagatggggtttcaccatgttggccaggctagtcttgaactcccgacctcaggtgatccaccctcctcggcctcccaaagtgctgggattaccagtgtgagccaccgcgcctgggctggtgtggtttttttttttttttttggagacagggtcccactctttcacccaggttggagtgcagtggcatgatgtcggcttactgcaacctccccctctcgggctcaaaccattctcccaccacagcctcccaactagctgggaccacaggcgcgcaccacaatggccggcattttttttttattttcggtagagacagggtttctccatgttgcccaggctggtcttgaactcctgagctcaggtaatctgcctgcctcagcctcccaaagtgctgggattgtaagcatgagccacaacgccctgcctagaaataattttagatttagagaaaataaataagcttcaaatttacagaaagtacaaagataacacagagagctcctgtacatccttcaccagtgtcctctaattttatatttcttacaaccaagaaattaacctagctactcaggaggctgaggcgggaggattgcttgagtctaggagttaaagcccagctttggcaacataacctcttctctaaaaataaatgaatgaggccggacatggtggctcacgcctgtaatcccagcactttgggaggcagaggcaggtggatcacctgaggtcaggagttcaagaccagcctggccaacatagcgaaaccccatctctactaaaaatacaaaaaattagccaggtgtggggacatgtgcctgtagtcccagctatttgggaggctgaggcaggagaattgcttaaacctgggaagcggaggctgcagtgagccgagatcgcgccactgtacttcagcctggacaacaaaaggagactccatctcaaaaaataaaaaaaaaaaaatgaatgaatgaaattaaccttggtatactactattaagtgaggcctggcgggatgttgtggctcacactgtaatctcagcactttgggaggccaaggtgggtggatcacttgaggccaggagtttgagaccagcctagacaacatatcaaaaccctgtctctacaaaaaattgagtgtggtggtatacacctgtagtcccagccactcgggaggctgaggtaggagaattgcttgaacctgagaggccaaggttgccatgagctgagatcaagccactgcactccagcttgggcaacagagggggactctgtctcaaaaaaaaaaaaaaaaggaagggaggccaggtacagtggctcacacctgtaatcccagcactttgggaggctagattgcttgagcccaggagttttagaccagcctgggcaatatagtgagacctcgtgtgtagaaaaaaaaaaaaattagcttggcctggtggtgctcacctggagtcccagctcctctggaggctgagacaggaggatcacttgagccctggaggttgaggctgcagtgagtgatgattgcaccattgcacaccagcccgggcaacagagccagaccctgtctcaaaaaaaaaaaaaaaaaaaaaagccaaagccagaatgtacagatttcttcaatttttcccatatgagactaatttaaaaaaaaattttttttttttatcgagatgggggtcttgctgtctggaagtatacatactgagaaattttatttttcaaacaaaatcaccccttttcctgtcttaggactggacattgcatctagttgtcggatctccttaagcctttttctggtctgggaagcaactcagcccttccttgttttttataaccttggtaagtcatggaatgtccctcaattagggcttatctggaattcttcatggtgagcctggggtgtgagttttggggaagaaggccattggtgaggtgcccctctcttctgtgaatctttttttgtttgtttgttttttgtttttgtttttttgagatggagtcttgctctgtcgcccaggctggagtgcagcggcgcgatctcagctcactgcaagctctgcctcctgggttcacgccattctcctgcctcagcctcccgagtagctgggattacaggctgccaccatgcccggctaatttttgtatttttttttagacggggtttcaccgtgttagccaggatggtctcgatctcctgacctcatgatctgcccgcctctgcctcccagagtgctgggattacaggcgtaagccacctcgtccagccatcttctgtgaatcttatcaggagtataggataccaacaagactgataaattattgacagtgataactgatgatgctgaccttgatctcttggctgaggtaggcttgctaggtttccccactggaaagttactagttttcttcttttcatactctatcctttgggatcatggaaaattttatttttattttatttttggagagtctcgctctgtcatctaggctggagtgcaatggtgtgatattggctcactgcgacctccgcctcccggattcaagcgattctcctgcctcagccgcttgagcagctgagactacaggcgcccaccaccacgcccggctaatttttttttttcaagagatggggtctcgctgtgttgctcaggctagtctcaaactcctagactcatgtaataatcctcttgcctctggctcccaaagtgctgggattacaggcattaaccactgtgcccggccttttctggcactattgaaaagaccatcctttctccctaaagttgcttttgtctggaattagttggccatatttgtgtgggtccaacctgaactgtctgttctgtgacgttgatgtatggctctgtcctttctccaaaaccacatatctttcttctctttttagatagagatgggggctgggcacagtggctgacgcctgtaatcctaacactttggaggcaggtggatcacttgaggtcaggagtttgaaactggcctggccaacatggtgaaactccgtctctactaaaaatacaaaaaaattagctgggcgtggtggtgggtgcctgtaatcccagctaattgggagactgaggcaggagaatcacttgaacacgggaggtggaggttgcagtgagccaagatcgcgctattgcactccagcctgggcaacagagtgagactctgtctcaaaaaaaaaaaaaaagaaaaaaagaaaaaaatagagatggggtctcacaatgttgcctaggctggtttcaaactactgggctggtgatgctcctgcctcagccttccacagtgctggcattatgggcgtgagccaccacgcccactcatttctatattgctgtagctttatagtaagacttgaaatcaggccatgtgagtcctcttttttcttgtttctcaaaattgttttgtctagtctagttcctttgcctccacatatatattttagaatcagcttgttgatttcatagaaaagatcattgtgtattagtacgtggaaagccacggtattagttttttgtttgtttgtttgtttgtttagacaaagtctctctctggcacccaggctggtgtgccaatagtgttgggattacaggcgtgaaccactgtgcccagctggtactggtttttataactgtgtattattccatccactgtcactacttccccaggaccagtacagtttctgcctcctcagtcttgcacctttaaccttgtcctcacccccaggctgttctccctgcagtggacagagggagcctgttaagaatatccttcctagctgggcgccgtggcttacgctgtaatcccagcactttgggaggccgaggtggaaggatctcttgagcccaggagtacgagaccagcctgggcaacataacgagacccccatctctacaaaacatttaaaaattagccaggcatggcagcgcatacttacagtcccagctactcaggaggctgaggtgggaggattgcttgaacccaggaatttgaggctgaagtgagctgtgatcctgtcagtgcactccagccggggagacagagggagaccctatatccttcctctacttggaatcctccctggccctcagttccctcagggtaaaaatgaagtcgtccctgaggctccatgatgttctcatgcaggtgaggcgctgtcctacctcatggctttttcacatgctgcttccactgcctgcactgcccttcccccagataaccctgtggctcatttcatcagcattctaaggcctctgcttaaaagcctccttctcaaaaggctctccccctggccactctgctcaaacgccccaccctgttctctctgtccccttcccctgcttaatttttcttggaaccacttgtcattcctgtcattgttccacctatgcgtttggtttcttgttttctttttttggggtggagtcttgctctgactcccaggctggagtggagtggcgatcttggctcactgcaacctctgcttcccgggttcaagcgattctcctgcctcagcctcccaagtagctgggattacaggcgcacgtcaacatgcccgtatatttttgtatttttagtagagacgaggtttcactatgttggccaggctgatctcgaactgctgacttcaggtgatctgccagccttggcctcccaaagtgctgtgattacaggcatgagccaccgcacccggcctatttgtttgatttctctttctgtctccccccactagaaggggaatgccccatggtagggcggtgcccctggctgtagcgcagtcccttgcatggtgcctggcatgcgataggtaatcggggcacccatctccctctcgggatgcactcattgatgtacttgtcaatcactgagcaagacccactcagcaatgtctgctgagcctgctctgtgccaggctctgacctgaactgccacccttctggagtcaaacaggcctggttgccaccaagaggagttaggcctggcagaggagacaagcattagtctcacaacagaaggaagtaggccggacgtggtggctcatgcttgtaatcccagcactttggaaggccgaggtgggcagatcatctgaggctgggaggtggaggttgcagtgagccaagatcacgccgctgtactccagcttgggtgaaagagcgagactccatctcaaaaaataaataaataaataaataaataaaaaggaagtggagactttcattgagatcagtatcaaagggcacgaggtggcagggcatggtggctcacgcccatagacccagcactttgggaggctgaggtgggaggattgcttgagcccaggagtttgataccagcctgggcaatatagtgagacctcatgtcaacaaaaacagacaaaacaaaaaaaacaggggagggagggctacaggagggtgggatgaggactggccacagttggaggccaggcccttcctggggatcccagcggttgttactctttaagaaggacctggcctggtgtggtggctcacgcctgtgatcccagcactttgggaggctgaggcgggtggatcacttgaggtcaggagttgaagaccatcctggccaacatggcaaaaccccatctctatgaaaaatacaaaaaaaagttagttagctgggcgtggtggtgggtgcctgtaatcccagctacttgggaggctaaggcaggagaagtgcctgaacccaggaggcagaggttgctgtgagctgagatcgcaccgttgcactccagcctgggcaacaagagcaaaactccatcgcaaaaaaaaaaaaaaaaggctgggctcagtgactcacgcctgtaatcccagcactttgggaggccgaggtgggcggatcacgaggtcaggagattgagaccatcctggctaacacggtgaaaccccgtctctactaaaaatacaaaagattagcggggcgtggtagcgggcgcctgtactgtagtcccagctactcaggaggctgaggcaggagaatggcttgaatcctggaggaggagcttgcagtgagccgagatcacgccactgcactccagcctgggcgacagagcgagactccgtctcaaaaataaataaataaataaaagaaggacgtgttcccttgttcttctatggggacatggggaactcctgtactgttttattttcctgaaatatttttattgaaatataattcacataccataatacctaatccttttgaaatatactattcagtggattttagtatattcacagttgtgtaaccagcaccactatctgattttgtagcactttcatttcccctaaacccatacatatgaagcagttcctccctcccccagcacctggaagccactaatgtcctttctgtctgtgaatttgccaattttggatatttcctataaatggaatcttacagtatatggccttttgtgtgtggctttgtttatttagcatcatgttttcaagattcatccatgctggttgggtgcagtggcgcacgcctgtaatcccagcatttgggaggctgaggcgggcagatcacttgagggcaggaattgatgagaccagcctgcccaacatggtgaaaccccttctctactaaaaatacaaaaattagctgggtgtagtggcacatgcctgtaattccagctactctgggtggctgaggcacgagaatctcttgaacctggggggcaaggttgcagtgagccgagatcactccactgcactctagcctgggcaacagagcaagactctctctctctctcaaaaaaaaaaaaaaaaaaaaaaaaaagaattcaccaatgaagccacctgggcctggacttttctttgtgggacgttttttgaatactaattaaatttcttgtacatctattgagtttttctgtgtcttcttgagtcagtttcagtaatttgggtctttctaggaatttgtccatttcatctagggtgtatttaatttgttagaatagtattcccttatcatcttttttatttctgaaaggttggtagtgatgtctcctctttatttctgatttttgtaatttgagtcttatctctttttctcttggttaatctagctaaaggtttgtcagtttggttgatctattcaaagagcaaattgtggtggtgttaacttctctctccatttttttagtctctttatttcttctctaattatttccttcttttctctttggatttggtttaccctccttttctgaggttcttgaagtggaagattattgaaatctgaaagtatttgaaatctttctcttttttttgttttttttttttgagacggagtctcgctctgtcgcccaggctggagtgcagtggcacgatcttggctcactgcaagctccgcctcccaggttcacgccatcctcgtgcctcagcctcctgagtagctgggactacaggcacccaccaccatgcctggctaatttttgtatttttggtggagacggggtttcaccatgttggtgaggctggtctcaaactcctgacctcaggtgatccacccacctcggcctcttaaaagtgtggggattacaggcgtaagccaccgcgcccggccaaaatcttccttctttttaaatacagttgcttacatctatgaatttccctgtaaacctgctttagctgcatccataagttttgatatgttgtgttttcattttcatttatctcagcatatcttctcatttctcttatgatttcttctttgatacataggttatttagcagtatgttcatttctatatatttgagaatttctgaaaaacatctttcttgtgttcatttctaacttcatttcactgtggttggaggaactactttgtatgatttcaatctctttaaaattattgagtcatgttttatggcttggcctcgaatacggtgtgtcctggagaatgttccatatgcacatgataagaatgtgtattttactcttgggtggagtgttctgtacacatctgtcaggtcttattggtttcgtattttctatttccttgttatcttttatttggttgttccatccattattattatttttcttgcctgataccaatgctgatatccatccatgattgaaagtggggtattgaagtctccaactttctttctttcttttttcttttctttttggagacacggtcttgctctgtctcccaggctggaaacgtggtggcatgatcatagctcactgtagcttctgtctcctgggctcacatgatcctcccacctctgcctcccgagtagctgggaccacaggcgtgtgccacacccgactaatttttgtattttttctagaggtagggtcttgctatattgaccaggctggccttgaactcttgggctcaagtgatcctctcatcttggcctcccaaagtgctgagattacaggcatgagccactgtgctcagccccaaattggccaatatttctttcttttttttttttttttgagacagagtcttgctctgtcgcccaggctggagtgcagtggcgcgatcttggctcactgcaagctccgcctcccgggttcacgccattctcctgcctcagcctcccaagtagctgggagtacaggtgtccgccaccatgcccggctaattttttttgtatttttagtagagacggggtttcaccgtgttagccaggatggtctctatctcctgaccttgtgatccacccgcctctgcctcccaaagtgctgggattacaggcgtgagccaccacgcctggccaatatttcttttgttctgtgctttttccttcctccctcccttcctctttaccttcctctttaccttcctctttccctccctcccttctttccttccttccttcctttttgttcttgttcttttctttttcctctacccttctttcttttccttctttctttttttctttctttgtttttgcttgattgcagcatcatgagagagtcctgtgcttttttatagctgcaagtattcctgggtcgagcctactcccactaacactgatcactctcccccttgaatttttaggttatttctagtttttcccctcctgccagagacttgggggtccgcaggcttgtgtgtctgctatgctcagggtggataccctgcaagggagtgccatgttgcatcagaagtggatttagagtgatgttgccaggcccaccaggaaaggctgtgccaaggctctttgctggggtgccaagaagaagggtctgtgcctgttgtggtgccaggcattgacatccttcactcccacccccgtcaccctcatgaactagtgaactagtcctgtggaatagggccttatgcgtgctagaccctgggtttgtcctgctgacaaccccatagtgtaggtgctgttatcccaatttcatagagaaactgagggctggggaagtggcagccttcattcagttcctgccgtgaggctgtggctgagctgccaggctgcagagtcttcacccaatgatcttgctcagttgtccccatgaggaagctgagcctggccttcctgtctctggagtccaaggtttcctttccttgtgtgcccctggaagtgctgtgtggtgaccgggatggtgcctggcagatggagattagacgcaggttggattggtgcctcattggtcaggagggctgctcttagctgtgtgccaatagaccggatgacttaatctctctatccttggtttccccatctgcaaaacagggttggccagagccctgtgaaggtggaagaaggccctgtgtgcctggagctttgtgcagtgccctggagatgctagcttgtttttctttcttttttttttttttttttgagacagagtctccctctgtcatgcaggttgtggtgcagtggctcagtctccgctgactgcagcctcaacctcctgggctcaagtgatcctcccacctcagcctctcaagtagctgggaccacaggcgtgtgccaccacgcccggctaattttttgtagaggcgaggtttcatcatgttgcccaggctggtcttgaactcctgagctcaggtgttccgcctgccatggcctcccaaaatactaggattacaggtgtgagccaccacgcccggccgtgatgccagcttcttttgccgtgcagctagcatttgctgaacacctgctgtgtgccagatagtgtgctggaggcagggcagtgaacaagacagacgagatccctgtcctgtggagctgatgctctagctgggggcctgaggggtgggaaggaagcacaggtgctcgggtgagaaaaaacatcatgcggccaggcatggtggctcacacctgtaatcccagatctttgggaggctgaggcaggcggatcatctgaggtcatgagttcgagaccagccttgcaaaaccccgtctctactaaaaatacaaaaattagccaggtgtggctgggtgtggtggctcacacctgtaatcccagcactttgggaggcggaggcaggtggatcacaaggtcaggagatcgagaccatcctggctaatatggtaaaactccgtctctactaaaaatacaaaaaattagccgggtgtggtggcgggtgcttgtagtcccagctactcaggaggctgaggcaggaggatggcatgaacccgggaggcggagcttgcagtgagccgagattgcgccactgcactccagcctgggtgacaaagcgagactctgtctcaaaaaaaaaaaaaaaaaaaaaaaaaaaattagccgtgtgtggtggcgtgcgcctgtagtcccagctacttgggaggctgaggcagcagaattgcttgaactcgggaggcaaggttgcagtgagccaagatcacgccattgcactccagccagggcagcagagcgagactgtttccagaaaaaaaaaaaaaatacaaaaattagccagacgtggtagcatacgcccgtagtcccagctgcttaggaggctgaggcaggaaaatcacttgagcccaggaggcggaggttgcaatgagccaagatcctgccactacacttcggctggggtgacagagccagactccatctaaaaaaaaaaaaaattctttaaaaatcaggcacacagtgtgatctgacttgcagttttccaagcctgtggggcagggagcctgggggaggctttgccctgagatgggagacttggcctcaggacattagagcgaaacagaggaggaggggatgggtctggatatccaaggcaggatctgccgagagatacgctgtgggggtgggacaaagacctcaagaacgggtccgggctgttcctgtcacttgtgacattgtggactgagtctgcctggatatttccttatgggctggctccccatcaccccgggagagtctcggggtggagggaactagaacgtgtttgcctggaggtcactacctactcccctggaaggaaggggctccaggaggctggctgtggaatgcagactgtgggtggtgcccggctgcctgcctctagttcacttgggccctcagggtggtacagagctggaaatccatacatggctgaccaccctgtaagggctgcagacacagtgagcgttcactttgccctggcaactggaactgtctcctccagtcctcaccacaaccgttttacagagcaggacacctgttgcaagatgggagagactttgctaacaaggtcccacagctggcactcaccaggctggctggggtactcaggccaccccttgcagtggggagcagttaggatgacaccgaggacacccctaggagggcggagttgtgagctccaggaccccacatttgagcagtttccccgtcactcttgaaaatgctgctgggccggccagtttctttggggtttctcagtactgctgaaagttacaaggtcaacactggcctgcaatcacagttataaaaaagttataaaagcctgacattcaaatcacgttggagactataaaacagcaagtttttcatttgcacacctcacatgacctcaagcctgctgtccatacacaggaaatggggatgtgcggaaaaaaaacccgaagtggaggacatcatcccccacgcataatccagtccgtgcatcgcacttgaccttcggcactgcagcctgcattgctccccggactagctcccaagattgatttagccagttccctgccagtggacatttaggtcattatcggttttcattccacaaagtactgccctcagggagtcggctgtccttgccaaaccactgcattaatatgtttctgggtgctggggaaagggcgcttaagacccctgccctcaaggtgttgatattctagttgggactgttagataaatgagcaattaggctgggcacgcttgaaatcccagggctttgggaggctgaggtgggaggatcgcctaggcagcatatcactacagaaaaacacaaataaaaaaagttagctgggcgtggtggcaagtgcctgtagtccgagctactcaggaggctgagggaggaggatcgcttcagcccaggagtttgaggctgcagtcagctatgattgcatcactgcactccagcctggatgacagagtgagatcctgtctctgaaaaaagaggtgcaaataaaccagaaaagtaccaactagtgggcagtgctgtgtttagaaggaaaacagggcaacatgaaggggaggtgggcatcagtaggggacagacctctctgaggaggtgacatctgagttgagtccctggtaaccggagatagccaggattgtggaaatacttggaggagatgagatggtctttcgaagcaggaggccagcatgtgcaaaggccctgcgacagcaatgtctggcctccttgctgtttctttttatttcattttttgagacggagtctcactctgacctatgctggagtgcagtggcatgatcttggctcactgcaacctctgcctcccaggttcaagcgattctcgtgcctcagcctcctgagcagctaggagtacaggcacacgccaccacaccccactaatttttctgtatttttagtagagacaaggtttcaccatgttggccaggctgctctcgaactctggacctcaggtgatccacccacctcggccttccaaagtgctggcattacaggtgtgagctaccacgcccggcctttttgctgtttcttgaccaccaatgtggctggaggcagggagtgagggggtggtgggggaaggagggcacggaggtgacagggccatggggggcacttgggaactgtcaaaccgtcaaatgttatgagcagaggagggtcatgttcttacattgtatcgagttttcctttttgtttttttgagatggagtttcactcttattgcccaggcaggagtgtaatggtgtgatcttggctgactgtaacctctgcctcccaggttcaagcgattctcccacctcagcctcccgagtagctgagattacaggcatgcaccacacctggctaattttgtatttttagtagagacggggtttctccctgttggtcaggctggtctcgaactcccaacctcaggtgatctacctgcctcggtctcccaaagtgccgggattacaggtgtgagcaaccgtgccggctttttttttgttttttgttttttttttttttgagacagtctcactctgttgcccaggctggagtgcaatggcatgatctcacaatctcagctcactgtgacctctgcctcctgggttcaagcggttttcctgcctcagcctctcgagtagctgggattacaggtgcccaccaccacgcctggctaatttttgtatttttagtagagacggagtttctccatgttggccaagctggtctcaaactcctgacctcgggtgatctgcccgcctcggccccgcaaagtgctgagattacaggcatgagccaccgcactcaaccaattttttttttttttttagtagtagagacagggtctcatcatgttgcccaggctggtttcaaactcctgggctcaagagattgcgtgccaaggtgctgggattataggcacgaaccactgtgctcagcctgagttttactttgattcgatggggcgaatgttctcttttgggtatcatggtaagagtttcacaaacccttccacctcctctctgaggcaggtggcatcattcccacataacagattgggaaactgaggcacaaagaggttacctgacctgcccatcttgtccagaaaggaaatactggattccagccagggcctggagagtcccagagccacgatcacgaattgccacaggtcacctcctgcttttgctcccagcctgttgtgtcccttggatgagaccagggagcaggtgatgccacggcttgagtgccaagggcgggcctcgagccgggagctgcaggattcctgatcagggaggggctgctgggctgggaatgttggggaggagtgaggccaggagtggattgtggaagtgagaagtctcctcatctgtaaaatggcagatttggcccattgttctgcaagcattggtcatctgcctcctgcctgggtgtgtgttgggtactggggagagagcagagaaggggccgatacgggaccctgcgcccatgaggctgccactctaataggatgttgaggtgggggcagggacagactgcagctgggtgaacacatcaggaacccggaagatgccagttgtgagtggcactgagcattgagcgggttgatgtgtgaaagaaggggagcagcttcctatggcggggggagggagggtgcagtttgctgggagctgcccgcctgctctgttaatgctgcaggaagaaggttccaggctgagggaacagcctgggcaaaggccctggggcaggacagtgtctggtgtgtttcgggaacatggaggaggcatatgtggctggagtaaagccagcaagacagagagtagggggaggtgaggacaggaaggtgacaggacaggtcgtgcagggcttggggggctgcagggaaaagtctggcttttattccaagtgaagcgggagcccaaggagggcccataacaaaggggtttacagtgacatggtgtgcacaggcaccttgtggctgctttgtgggaggcagattgtggggaccaagggcacgactgcactggtgtaggcaggtgacagtgggacacgctgacagccttggacgtggagggaattgagcagaatcaggcctgatgtggaggtgaaaccagcaggactcgcggctggacaaggcgggtgggtgagggccaggggagccccaggtctgcagcctcgtgaggggtttctcccctccctgccctttggggtgaccacagggatgcagtggcacctacctgcggacactgtgtgggccgagcactgtaaggcttgggcgtccttgctgggtgaccaatggctattgttggaaggatgaggcagggaccgaggtgggcagaggagactgggcatgggtccccacttctgctccaacagagcgacagagaagcccctgaggtgggtgcgggtgactgcgggtctgcctcattggtgtcccacccacattcgtgtcctggctctgctcctccctcgctgagcgtcctgggcaagtcctgagactgaacctcagtccacctgtctgaaatgggacttttggccctggcatccttgtgactttcaacccctctggggttgtcagaggatttgccgctatgttgcccgagatggggttagagacagcctgttgggtggccagcgttccttgtgtggctcttatcagagtcctgagagaagaggccagggtggaaattggccctggagtgtgggctcctgccgaagcctcttcctgtggccagtgccatgctgaaggctggctgtggtgtcacgtgagccctcccagccacattcaggctcaaagagactgtgctgagcatatggtgacaaggaagggatcccagcccagggtcctggccaggccctgccagcaccaggctgcacaggtgaggggtggcttgccctggggtgctggctctgggccacactgctgactcaccctctgtgggcttatctgttgattctccctcccatgggaaggctctgggtttgagcctgcatcgttcctgcacgtagccgtccccaccctcataggggctggaagtcaaaaggcgcctggtggagccttgtggtctgttcaaaaaacggtaaataaacagcctgggcttctgatctgctggactcaacctggcacctctcccatcgctgctgggtgctgcctcccagctgcacccttccctgcctgtcccctaccgccttcctggagcgcttatccccttccagggagaggtggcccactttagagctctgaaacctgctctggtggggtgaagtgacttgagccaggccaagccggtggctgggccctctgtggcagactggaagtgtcctcccatttcatggatggccaagtcagtgcccagagaggggtagagacctgtccagggccacacagcccaggaggggcggagctcgactttgaacccaggctgcctggctccacagtctggattcttcttacccattcaacaaatacttaatgagcacacactgtctggcaggcactgttctaggtgctgaggatctagcagtgaccaggccaggtgcagaagtcttggcgtgtcacaggactagaccttcatcagaggccgttttgctgggagtgggaaggggtgtgtatttgggagggaggggcgcaagccatcacacctgcccatggccaggtaggcagggcctatgggagggtttcctggcagagggaacaccccctgcaaaggcctgaaggccagcagtgccagagagaactcagaggaggcaggtgcagggggtggggctggggaacccggtcagcactgggactaggactggacaggacgggctaggaccagtcacttggtttctgcaagagagaagcttggaggcaggatcttcattttagaaaggtcactggggaaggtgggaggttgggccaggaccctggggcctggcctgggcccatggataggaggccaggtactgaaatgatgcaatagtactaggctaggtgcagtggctcacacctgtaatcccggtgctttgggaggccgatgcgggaagattgcatgaggccagaagtttgagaccagcctgggcaacatagcgagaccctgtctctgcaaaaaataaaaaaattagccgggcatggtggtgtgtgcctgcagtcccagttacttgggaggctgaggtgggaagttcactagggtccgggagttcaaggctgcagtgaggtatgattgtgccactgcactccagactgggcaatataggaagatgccatctctaaaaaaaaaaaattagccaagcatggtgacatatacctgtagtcatagctactcaggaggccgagactgaggtttgcctgtaccctggagtttgaggctgcagtaagctgtgattgtgctgctgatgcagcctgggcacagagtgagatcctgcctctaaaataaataaggccgggcgcggtggctcatgcctgtaatcccagcactttgggctgctgaggcaggcggatcacctgaggccaggagttcgagaccagcctggccaaaatggcaaaaccccatctctactaaaaatacaaagaaattagccgggtgtggtgctgggcgcctgtaatcccagctacttggggggctgaggcaggagtaagctgagattgcgccactacactccagcctgggtgacaaagcaagactccatctcaaaaaaaaaaaaagttaataaactacttaattgtgcatctcctgtgtgccagccctactctatgctttggggatggaatgttggaggatcccaccttggggagctgtgtgtgagctccccacacagctcagatgggggtatggggtctgtatgtgagccagaacaaaatgcagctaagtgacatttagcatgtgttagttccacagagaaaaatgaggcatggggggtggaggtgggagaggtgtgaatgggggtgagagaagtctctgaggaaatgtcattcgagcggaatcactctgagcttggcaaggttaccctgtcttactgacgggaaacctagaccagagaggccaggaagcccgcccaggatcacacagcacagaggtggccaagcagggactggaatgcagggcagcctgggtgcacagagggcactgtagcagcagcaaagggagaggagaggagtaggtagatttcagtactctcagaatgcggatgggatcaacgaggaggaagtagatgacggaggctggaaagtcacttcctgctaagtggccagtgtcagtgttccaggcagagctgcttgggaggtggtttctggaaggctccaagtactcctgctgctgtgtcccagaaaacccttagggccaggcccctgctcaccaagctcctaggagacttctggggggctcatttcggaggcagtccaggccgagggtgaatgttggtgccctttgcatgcagcagtctgggaacttttagaagcaaaatcggataagtcccagggctcctggcgctctcagcctggcatgcgaggccctctgcgcctgccctgccctgtcctcaaactctcccctgagagctgcgtctccgtcgcccaggctgtgccctcctgtgcccgacttagaactgttcggaataacactcaaaattttaaggaaattaaacactcgaacaaaggatttttagcaaagcaattttacttctgtacagaggggtgcttgtccttggccagtcgccatgagagcacacctgaacaaagggacacgagagcctttattcctgatgcaagtcctgctcctgtaccctctccccattggccggggtcgggtcatacaatctaaaccaattttggttggctaaacatttgaatttttgtagataaggtgggcacgtaaaagagagaggaaaggggaagggatgtctgtagtgaactagaaagttagtcttctttgtaaataagggaaggaatgtgagctggtactggtaacgcctggtactgtggcgtgcctgggcatctaacaaagccagaaaggaaaaaggaaaaaagagtgtgtatgtgtgtgtggggtactatgaattaaaagattgatcagcctgtttgaagagaaacctcatcatattccacactacaaataccccaggcccagaaagtcaccttctcctgcctgtgcccacagctctgtgttctcttgggcgtcactcccgccctatgttctgaagctgtgattgtccgttgtctgagctgggcgctggtggcgtctggggcatcaccattgtcctcacagtgcctggcgcctcagacacaaagtggagtcacaggacagcacaggccacaggcaaacaccagaggtccaaagccgggccctggctgggagttactggagggtctgcctaagatgtgtttgctcagaaggccaggtgccctggtggttagacagctcaggccctgtgccttcagtccatgttcatgccacccccagatgctgtgtgaccctgggcaggcccccaccctctgggcctcatttgcatctgtaaaatggagccagcagacccattttaatggatcctgtcatggttaaatgggttaataggcaggtgcagtggggtcattgcagggagttcaagaccagcctggacaccatagtgagaccttgcctctacaagaaacttaaggtggcctggtgtggtggctcacgcctgtaatcccagcactttggactccattgcactccagcctgggtgacacagtgagactctgtctgttaaagaaacaaacaaacaaaaaaaccaaaaaacttaaggtggtggtgggtacctgtgatcccagctacttgggaggctgagacgggaggatcacttgagccctacagttggaggttgtagtgagctgtgaccttaccactgcactccagccagggcagcagagtgagaccctgtctctatttaaaaagaaatcaaaaaggttaataatcatgaaaagttctcaatgccttgcttggcatagagtcagtgttgaatagctattagctactctaatgttttgaactcagtaatgcgtgtgtatgatgcggaattcaaagatgtcggaaaacatgcagtggctccttccccaccaggccccagccgccccgggtcctgttttgtttccctttggttgtcttagtcacaaagtacagactttcttctgtaccttttccttccccttcccccctcccccttcccttcccccccccacttccctttccccttcccccttccctttcccttttccttctcttcttcctttccttttctttcttcagtaaaactgatcactacaaaccttttctttttttctcacttagtacaccaaaaagggagttacatgtctagaaaggacaggctctttttgtgtgtctgttgctgcatagcagcatggataggccataatttatatataaatacacgtattttattctattttaaaggtttttgttttgtttttttcccccgagacggagtttcgctctttgttgtgcaagctggtgcaatggcgcgatctcagctcattccaacctctgcctcctgggttcaagcgattctcctgtctcagcctcctgagtagctggcattaaaggcacccaccaccacgcctggctaatttttgtaattttagtagagatggggttgcaccatgttggccaagcaggtctcgaactcctgacctcaaacgatccacccacctcggcctctgaaagtgtttggattacaggcgtgagccattatgcccagcaatatatcttatatataaggtgattgaaaatatatgttttcaaaaagaaaacatattttcagtcagcttccttaggttgaacgtaatttatatttaactagtcccctgttgctgggctttaaaattctttgagatctgaatttttcgtcttattgagaaactaacagggttgtaacaattctgtgggcaaattttaatggaatgtccaccctgtacttttgtatctgaatcttcacgaacatgttctccttgacttgtgaccttttcctgagatttcagttagatatagttaatcgcttaagtctttttttttttttttgagacggagtctcactctgttgccaggctggagtgcagtggcgctatctcagctcactgcagcctccgcctcccaggttcaagcgattctgcctcagcctcctgagtagctgggactacaggcaccctccacctcgcctggctaattttttgtattttagtagagacggggttttaccgtgttggccaggatggtcttgatctgctgacctcataatctgcccgcctcagcctcccaaagtgctgggattataggcgtgacccactacaactggccaatcgcataaatcttaaacatataccttgattttcttgtcttcttcttcttcttttttggagacagtctccctctgttgcccaggctggagtgcaacggcgcaatcatggctcactgcagcctcagtctcctgggctcaagtaatcctcctgccacagcctcccgagtagctgacactacaggggaatgccaccatccgcagtgaattactttttactttttgtagagacaggggctcgttatgttgcccaggctggtctcgaactcctgacttcaagtgatccacccaccttggcctcccaaagtgctgggattacaggtgtgagccactgctgcaagttttgattttctaataaatgattgtaccttggtacctactggctagatcaagatgcaggacttcttcatggtctcagaaagtccctcctgccccttctagtccatttcccgaaagggaaccactgccctgatttctatctccagagactagctttgccggttcaagttcaagtccaccctgtgactcagcaagagaaacaaggacatgtgtctacaaaaagcgcatatgagaatgttcagaacagctttatttgtaataaattcaagctaggaagaccccaaatgtccatccaatggtgactagacgaacagactgtagtccatcagtgcaatggacagattcgaccacgaaaaggaatgaacgtcagacacacgaagcagacaggatgtctgtgattgcatcacatgctgctcctgtgttgttttatcgttgacatcttccacttgcacacttcaaaaatagtcattgaaaggatggagcaggggcactgttgtgaggggcacgtgctgtcaccgccgctgctggtgattcagtgtctagccagcgccgcatggtttctgagatgctgcatttgtctttttttttttttttgagacagagtcgttctgtcacccaggctggagtgcagtggcgcgatctcagctcactgcaacctctgccttccaagttcaagcggttctcctgcctcagcctcccaagtggttgcgattacaggtgtccaccaccacacccggccagggtttttttttgtctttttttttttgtattttgtattgtttttgtttttgttttgagatggagtctcactctgtcacccaggctggagtgcagtgatgcgatctcggctcactacaatctccgcctcccgggttcaagccattctcgtgtcttagcctcccgagtggctgggattacatgcttgcgcccccacacccggttaatttttgtatcttaagtaaaggcggggtttcaccatgttggccaggctggtctcaaactcctgacctcaggtgacccacccaccttggcttcccaaagtgctgggattataggcgtgagccactgtgcctgacctgagacactgcgtctctgatgtgcaagatgccaagtgtccctgcccctcaggtccctacctgtgagctaggtggcctggggctctggtagggccagggccaaggctacttgtggcgttcatgaggttaataccctgggacagcctggtgtccactgtgactactgtgacggaaagacaaggggccatgctaagaggtgactttggggtctgtcacctgcatgggggcgcccgctcgctgtttccctcgttcagttcactccgcctcccaattgatgtagcttgttccctcagtccccctgctcagagaaccctctccaattatcccagcccccaacccctctcacccctgcagtatgtcttcctcgcacccacccccgtcagaatgttggcgccagtgtcaccagcacctccccaagtgctcaggagccagtgagaaaggttcgctccttttcatgcaagccatgagctgtgatgttgtccaagtctcgtatcctgtttgtgcctcaggctcctcatcagccgaatgggaggctgacggaaagggattagagctcaggcatcagcttgaactggggcacatggcgtgacaggcctagtgcctggcaggcaggtccctcgggctctttgtcatcctcaggagtgtggctcgaagacaggtagcatcccaggcctggagagctgactgtgctgcctgtggctgcagagacaggatgcagaggccagggctcgtcccccagagccttgcaagtgtctgtagggcgctcccctctgtcttgcctcctcccactctctggctcttctctatccagcctgccctcaggttgtgaccatccacctcccaaactgccctggaatctgcctacggcctgtccactgccctccgtacccctgcctgccatctctctggtttcgcccctgatgtcactcacatgaaccacagcggtcacccccacctgcctcctgctcctgccctctcctctgccctgcatcagccagaggggggtttaaaagcttacatttgttaataatctggctaaagcttaacatttattgtaatccatccctaaatcccagctggtggcattgctctaacagtgatgaccagcctcctcatcataatccccagcactgccaccctcaaccccccagcgctgaccactggaggctgcttctaaaacttcagccctgctctgccagcagcgcccctggggtgtcttcgtagccctgttgcccatcacgatcccttttctcatgcagtccaggctgcaagcccccgccgagggcttgggctgacttgttgtgtagtcagtgctgtgtctctgcacccagccagaagtggtgggacagccccccggctgacgggctagaacccatcatccagggtgtgtggaaagagcacatctcccccccgacgccagccactgggtaatacattcccaggaatttccagtgcccagccccagctgagaaacaggtcttctggaaccctccagcaccctcatcaggggttcccagcatgggtagggccacctgccagctgggaatgattgtagtgctagtgacactcactcagggacccaggatgctgtctcgttctgtacagggcacagctgtacagtaccaattgccctgtgtcctgtacaaattttcaacgatccaaacatctaggtgcaaaacctgtttgaaattctctgtgttggccaggcacggtggctcacacctgtaaacccagcactttgggaggccaaggcgggcagatcacctgaggttgagttcgagaccactctggccaacatagtgaaaccctgtctctactaaaaatacaaaaaaattagccaggcatggtagcgcgtgcatgtaatcccagctactcaggaggctgaggcaggagaatcgcttgaacccgaggcagaggttgcagtgagttgagatcgagccactgcactccagcctgggcaacaagagcgaagctctgtctcaaaaaaaaaaaaaaaaaaaaaagaaaaagaaattccctgtgcctagaacctttcaccattttgtatgaaacaacagaatttcctttcgagcctttaatgtaccccgagcccactgtttctacttcagtcctcactggaaagctttcattttcctttctgagtgtacagggtgacttcctgtcttcctccttgctggaatcctggtgtattcactgtaagtcggagcaggctactccctctatcttctggggtggttgtgcctgagtcttttccattgtgaaagacatggaattgattcctttcttccttccctccttccttccctccttccttccctccctccttccttccctccctccttccctccctccttccttccctccctccttccttccctccttccttccctccctccttccttccctccctccttccctccctccttccttccctccttccttccttccctccttccctccctccttccttccctccctccttccctccctccttccttccctccttccttccctccttccttccctccctccttccttccctccctccttccttccctccctccttccttccctccgtccttccctccctnnnnnnnnnnnnnnnnnnnngaattcactagtgattggtgacttcctgtcttcctccttgctggaatcctggtgtattcactgtaagtcggagcaggctactccctctatcttctggggtggttgtgcctgagtcttttccattgtgaaagacatggaattgattcctttcttccttccttccttccctccctccttccttccctccctccttccttccctccctccttccttccttcctccctttcctccctttcctcccttccctcccctccctcccttccctcccttcccttctttccttgatggagtcttgctctgtcgcccaggctggagtgcagtggcacgatctcagctcactgcaacctccgcctcctgggttcaagcgattctcctgcctcagcctcctgagtagctgggattacaggcgtgtgccaccacacttggataatttttgtatttttagtagagacggggtttcgccatgttggccaggctggtctcaaactcctgacctcaagtgatccgcccacctcggcctccccaaagtgctgaggttacaggcctgtgccactgcacccggccaggatatgtacttttcttaaacagctctgtcgaatagtaatttacattccgcgaaatcgatccatttcagaattagtggtctttagtcattttacagtccttttttttttcccacacagagtctcgctctattgcctaagctggagtgcagtagtgcagtcatggctctgtacaacctcagcctcccgggctcatgccatcctcctctctcagcctctctagtagctgggatcacaggcgtgggccaccacgcccagctaattttagtttagtttagtttagtttagtttttgtagagatggggtcttactatcttgtccaggcttttacagttaattttagtaaacatcaccatagtccagatgtagaacattttcatcaccccagaaagctccttcccctccattggcagtcacccccgttcccacatccaggtatccactgatctgccttctgcttctgtagatgtgacttttctggacatgaaacacatcctattttgtcatcaataactttcctcgtattttacccatatacatgtggcattgtgttgatttaaaacacataggaaatgtgttgatctcctgggtatgggggaaatttaacaaatacatgccagggaatgggccccctgggagtacggggggtggggcacagcctgccagagggaaatggttctggtcactatgaccttccatgcataccttcctgagctcttcaggcctcaggaccctccaagaccagagcattccccagggcccagctggggttggtgcctttgctgaggtcgcccaaattgcaagacagagttgctccaccacatgtggtcacacttcctgcccctcgatccggacgcaagagtaatttctgtccctctccccccctcacagggacttccttccccgcggttcaggaatcgtcacccggcggcctctcattctgcagctcatcttctcaaaaacaggtaaaatggggcggcctgaggttcagcaggaagtggatgtggatgtgtggttgccaggagttgctgggggcggagggtggaacttgggtcctgggctgtcattggacattgaattcacgtgttccacatgtgtgaggaaattgaaaaacggctcagtgaacacttacacacccacactgcaagccctcagctgtgaccagaatgccaggtgccatgtgtgctttcttttttcttttttttgagacagagtctcactctgtcacccaggctggagtacagtgatgctatcttggctcactgcaacctccacctcccaggttccagcgattctcctgcctcagcctcccaagtagctgggattacaggtgtgaccctccatggccagctttttttttttttttgtatttttagtagagacagggtttcaccctgttggccaggctggtcttgaactcctgacctcaagtgaccctctcacttcggcctccctaagtgctgggattacgggcatgagccaccacaccggccccatgtgtgcttttcatgtgttatagataacccgattttgctgaacgctttcaaagtcagtagcagacgtggtgacacatccatccttcacgccccagtgcacctccccatgcaataaagacgcctgtctacaaagtcccagcaccatgccccagagaacgagtcattcccgcatgtcatccacgtcccagtttctactcagcatgtcgccagttgtcccccagatatctggctggttttatagctgctctgctcaatccaatgctatactcttttgtaatctcttcttctcttttcattaaagcagcctccccataatcactttttttattttttttaagagacagggtctcactctgttccccaggccgtgcagtggtgtagtcatagctcactgcggcctcgacctcctgggcccaagcaatcctctccaatcagcctctcgggtagctaggattacaggtgcacacaccaccacacccagctgatttttttttttttttttttttttttttttttttggtagagatgggggttatgttacccaggcaggtcttgaagtcctggcctcaagcaatcctcctgcgtcagcttcccacagtgctgggattataggcatgaaccatcacaccagccctctaccattgctttttattttttattttatttatttatttattttttgagacaaagtcttgctctgtcgccaggctggaatgcagtggcgtgatctcggctcactgcaacatccgcctcctgggttcaagcgattctccttcctcagcctcctcagttgctgggactacaggtgtgtgtcaccatgtctggctaatttttgtatttttagtagagatgggatttcaccatgttggccaggctggtcttgatctcttgacctcgtgatccgcccacttcggcctcccaaagtgttgggattacaggcgtgagccaccgcgcccggccaccattgctttttaatcagactttgactcttagggagacccagcctgttgaatatagtatggcctatgtgtggattttttcctgttctttccttccctgatctcagtgtatttctattcttcccacccgaggctgacatgaggtgggcgtatatcccagctggaaaccccctcgggcctccttgggaaggatcttgggtcagaagctagacccgggagaggtaagggtctccgtgccccttccctgctaatctgcaacatcagctctgggcgttcaacactcagtttgtgttaatgtcttcttgcggcccttttaaatactctcacactgggaaggcagctgacacacacacccccattctacagatggggaaactgaggcttagccatgctgcctgcctttccaatgggccccagatctgggacctgcatccaggtagatctgacctcaacgccagctctcagcttggcctcccaagactcctcactttcgtcctctggccccgcccaacctggcgagaaggcgtgtctccagtgagagacagcagccgatgggcccaccacctcttctttatgagctctgctatttcgtacgccaccgatgggccaatgggctgccacctctgggttcaggcgtccaatcagctgtgccaggaatgggcagccccaaagtcctgagagtcactatagaaatcagtgttggtagttttctgtttctcattgagcaggatggggacagatgtgcaaactgcatttttattttattttattttgagacggagtctcactctgccacccaagctggagtacagtggcgggtgatcttggctcactgccacctccgccttccaagttcaagcaattctcatgcctcagcctcctgagcatctacaggcatgagctaccacgcccggctaattttttgtgtttttagtagagacagagcttcaccatgttggccaggctggtctggaactcctgagctcaaatgatctgcccgcctctgcctcccaaagtgctgggattacaggcgtgagccactgggcccggccacaaactgcatttttaatgagtccctggtgatgctgccagtctctggccacaccactgggagagcctgccctgcttggtttaggcttggagcggagactgcccaggttcccaacccagctcctagggagggaccaccactgtgtttcctgtctggacagtgatgacaataacaccaccttgttagccttaaagcacacgttatttactacatgtcagggaggaggggagagaagcaggcagagagccttggccaggagggagcacagagcgcaggcctacccagtacctgacccggatgaacgatgatgggttcctgatgtctgtccccaccttacagaggagggagccgaggcttcctgaccacttgccttagggcacatgggaacattgtctttaaagtccacccttaagccacctcttgggggaatgtggccttaggccaaggtgtgacttgaccagatcctgtggctgttggtggaaaagggaccacaggggccagtgctgaggccagtgccctggaggaggcaggagtaggtgctggaaggggtgggggcaggtgggggatgggtgtggcagctgtggtggaggtggatgcatagttgcatcctgttgggctggttgaaaagggagttccagaagtgtcccacatgggtggggccttttcctgcctcccagcttgcacccctcagccccgcctgatcatggcattttcagtctctgtctccttttttgttttgttttgttttgttttgtttgagacaaggttctgctctgtggcccaggctagggtgcagtggcacgatctcggctcactgcaacctccacctcccaggttcaagcaattcttctgcctcagcctcccaaatagctgggactataggcgcacaccacctagcctggctaatttttgtatttttagtagagacggggttttaccatattggccaggctggtcttgaactcctggcctcaagtgatctgcccaccttggcctcccaaagggctgagattgcaggcatgagctaccgcgcctggcaaatttttaaattgagatgaagtcttgctatattgaccaggctggtcttgaactcctgggctcaagcaatcctcccatctcagcttcccaaaatgctgggatgacaggggtgagcccctgcacccgaccaggctccaatctcttattgctccaagtaggtgcccacttggtgctgggccttagctgatctccagggaggcagcgtgagcacctggcatggtcccagcccccgagcccagcctgtgagtgtctgttggattcaccttggggttgggggcccagagagaacattctaggtagggaaacagcattagcaaagcagtgtggggaggtggtgaggcttgggaggggccagaaggcaggagggactgggactggaaggcatgttgaggattcaggcagtgggagctggggtggcatgcatggtggcgggagaccactggctgccatgttcaggagggacagtcagggaccagaatgcaagtggggagtgggggatagggagtggcagagaggctggcatggcgccaggcaagaggcaatgggggcctggccctggtggtgctggcagatgccaggcagtctagactgtcttccaggcaaggcattaagcagcataggcacccttgctgggggaggtgggtgggaggtaggacgccttactaagaggagaggaaaatgaacacattgcgggcatcagtgattgctggggccggcggggccttgtggggtatacaccagaccacgtggctcctagggattggcagctggctctctgtgaccaaactcagaaccaggctgccaccctttactggcccgggacttgttaaagtgacttccctctctgtgccttggtagcttcatctgtaaaatgggggtgatggtggcgctgccatcgtggccatggcaccccattggctgtggtatgctgtctcttcctgtggggtctgatgtccaaagacagggcccccagggcgcagcccacgttcccctctggttcccgcagcttgccctcattccagccatccccagtgaaccataacttccagccatagaagtttaaacattacctaagaccataaccaccaggaagtttggtggcccatgagtgaaccctgccctcactgggaagcagccccgtaaactctgagtgcctgggactgttcctgtgtggaatgtgcacagtgaggccctgtgaaccaccccctccccaccgcccttggccttgaactggcctttggtgtgctcaccggaaccaaggaagagatgtcaggacctggctccagggcttcccattggcctcagaatcaaatcgagcctccttctcaaggccttgtggcccttgccagtctctgggacctcacctcctcctggtccccagccactgcccccatccatctccctcctgattctcaggcccagcttgctggttcccactgcttggcctctgtgctcactgtgctgcctgcctggaacgccctgttccctacctgccactgtctgctgctcacccgcacctggtcacttgccgccttcgttccccggtccccggcagcacgagttatcctgttcttgttttttctttttcttttttttttttttttgagatggagtctcgctgtcgcccaggctggagtgcagtggcgccatctcagctcactgcaagctccgcctcccgggttcacaccatgctcctgtctcagcctccggcgtagctgggactacaggcgcccgccacctcgcccggctaatttttttgtatgcttagtagagacggggtttcaccgtgttagccaggatggtctcgatctcctgacctcgtgatccgcccacctcggcctcccaaagtgctgggattacaggcgtgagccaccacgcccggcctgttttttcttaatggactctctctgcgccagcacacgagaacaggcatgcagatcggctctgcccagcacagggcctggcgccgagcaggtgctccgcatgcacggccgagtgaacgagctcaaagggctggtgctgtgccccttcttgcctactgggcgggaagtgatgggggttactttaccaagcatcttcccctggtgagcctggtccatcactctgccattccatctgcagccttgtatctagagagcagaccaagctggcgtgcgtcaggctgtgggctggctgggatgcctgcccaggctgacaccttcccagtggcaatttgtcctggactgggagatatttgcgtattgcctcggattagagagaactcaagggctaaatgggcatgggaagtgttgtgtgctgtgcccacttcttggtctgctgaaggctctcaaaagtcctgcatgagtggatcctgcctgctggcgtggtagctagggtctcctgatggtggcagatccccaagttgttccccctggtcctgcctgccaacagcaggtttgggaaaggcagatctcctctccttgccttcagggccagcctcgtcattgtgttctttgctgggggaacggtgagaagatccagggcagagccccagtgtgcaaagcactgggaccctagcccagcccctgagggttccctgagactaacagctgagccgtgtttgtgctcctgatgggatttgatcgcagtcatatgggagccccggcactgggttctgtgtcattgcattttggggaaactgaggtgctgagagaagggtaggaacccggagctgggtgtcgctaggctgtgaaaccacgaggcaccccgaaaactctcctccctctctccctctcctcacctccccaaacccggctgtcttttctgttgggctgaaggcaggtcttcccagcaggacctgggcatttcaaaattcttaagtagtgccagcgggcacgtgaccagtgtgctttgaagatagggagggccattctctgaccaagggccttcggtcactctggggctccacaagctcctttgaaacaggaggctccgaagacctccagggtctccaggccagaggtgactgtggcctctggcaaggggctgcttcttcatgtcccaggccccctgaccctgagaaggtggcagcttgcacctgtggctcccttctggggacacctcaaagggcctgaggtgcaggggattgactgtttagcacagtggggccccagttgggggttcctgggagtgatgtcctcctaggttagagcacagattcttttttcatggattttaattaagcagctgctgtatacgagatgctagggggaactgtgatcacaccaagtctctgctctctcagagctccagcttcagtaggggacacaggcttgggagggaggcagaacctctctctagaaaaacccgcaagtacaaccagtgggcccacagttaggaggccctgtggtgggcgaggacggctgactccctggccttggcagcgtgattgctggatgactgcccagattaatcctttactcctgctgtgtgccaggctgggtccctcagagtccccagggcctgatcacatgccagctgcgaacctctctgagggggcccgggctgaccctcctcccagggagccctcctggctcagggtgccgggtgacagtgggggtgtgtgtggagctatcaaaatgctttgcagtttgccgaggaattacaggaactggctttggtatctggaaatgcctgtctgcagagggtggctgtggggtgcagcttgatggcagggaccgggacaggcagagccaggggtggctcagtggcttgttggctgggcctcggctgctgctgctgtggacaagttgacagggaactcagtgttaaggcctctggctgattctttgggccagtggattgttaaaaaaaaaaaaaaaatcatctcatctccagcacttgagcgcatgcagcgttccagaggcccaggctaggccctccactctatttctctttttgtcattgttttgagacagggtctctggcctccccttgtcatccaggctggagtgcagtggcgtgatcacagctcactgcagcttcaacctcccaggctcaagcagtcctcccacctcagccacccgtgtagctggaactacaggcttgcgccaccacgcccagctaatttttaatttttttgtacatgtaggatcttgctatgttgcccaggctggcctccaatgattctcccacttcagcctcccaaagtgctggagttacaggcatgggccactgctctcggcctggtggaagcttttaaacctctattgggctgggcatgatggctcatgcctgtaatcccagcactttgggaggccgaggtgggcggatcacctgaggtctggagttcgagaccagcctggctaacatggtgaaacctcatctttactaaaaatatacaaattagccaggcgtggtggcatgcgcctataatcccagttacttgggaggccgaagtatgagaatagcttgaaccggggaggcagaggttgcagtgagccgagatttcactactgcactccagcctgggtgacagagcaagactcagtctcaaaacaaacaaacaaaaaacctctgttgacctggcattcagcatttactttcaccatgccagggagccctgtgaagaaaggcaggcagctgcggcagacctggtcggtgcctgggcctttttctctggtgtggttctgttgctcactgacccactagggaagaaacggttttctggcacctgctgtccatatccttcgcccacatggaggggttggccgacagcagaaggatcttggaggagagatcacaaagaacagcccttgctggccgggcgcggtggctcacacctgtaatcccagcactttgggaggccgaggcgggtagatcacgaggtcaggagatcgcgatcatcctggctaacacggtgaaaccatgtctccactaaaaatacaaaaaaattagctgggcgtggtggcgggcgcctgtcgtcccagctacttaggaggctaaggtaggagaatggcatgaacccaggaggcagagtttgcagtgagccgagattgcactactacactccagcctgggtgacagagcgagacttcgtctcaaaaaaaacaacaacaacaaaaaaaaacagcccctgtcttctctgatcccctgttggttcccagcctgcatgtgacaaccggggaaggtgccgtgctccaaagtctggcatgtgagtctggctgcctggttccagccccatctcgtgtctgcccctgactgggcggacttgggtggggcaggtggtccttcctgggcccgtttcctggtccttgcgttggggaatggcctgaggttccgggggaaccttttgcagctcagacacctagattcagcttgctggggaagcctgtggcagccgggcaggcagaacctccatttctcacctaacatgcgtgagtgtgcccttggggacacagcaatgaccaaggcagatgggcgtcccttccctggtggcatggacattcaaggtaaagctctctatattagatttcttctcaccctttgtcagatggtagtaagtgttatggggaaacgaaggcaggggaggagggggctgggtggagcagctgctgtggggagagagatctgcaggaggtggggatgctgtgtgacttgagagagtagcttgccctctctgggctcctgcctgtgtgtgctgggggaacgatggcgcccactgcccctggtgctgtctttgccacatcattccttggggacttctgcccaccagctgctcagaccgtagctgtgctggctatgctcttcctgtgcaggtattgactctgagtcctcatacagcctgttatgatgcgcattttacagatcagtagactgagacctgggcaggccctctgactacagactgagctcattactgcacacagcgtgctgccagtacatgctgggctctggggtgctggagccgcaggtcctggccccatcaatacaatccaaagtgagctggctctgatgaggaagaggccaagatgccccactcagggaagtcttcctgggagaggtggtagccaggcagacctgggagtaggaggaggtagggctgggctttgtagacaccacacttggtgggacagaggcctgctagggagagggcctgtgtccttgccaccagcccatcttccacgccatgtccccctgcactctttgaagggagatggtctcttttggggctaagctggggtcctggagccagaagagaactgagatttgctgtggggggttgggagctgttccatttttagtggctgctacaggaagagcggccgagtgtttccccttgtccctgcagaaggctggagtgtaactgtccttgggaactgggtcagctgatagcagggctgggggtgggggtggggatcctgaatcctccagcagatgtcctcattgccctgatctgggtggccagtgcctgtgctggacacggtcctcagtcatcggagcccactgagtctccccctgaccctgcagagaatttcaaagaggcgaagttccttccagtggcctcacaaaggctatctggcttaggagccattacctgaagccagaatttctgagttccaagtcccagctccatcacggaacttggcccaaggcccttaacccctctgggcctcagttttgtcatctttgaaatggggatcttagagatgcctacctgtcaagggacttgtgaggcgcaacgggaccacacgcagggcctggccagagtgccgtagtttcttcggttgccatgatgggacggtgaaactcctcacactcttctttctgccttgaagattctagacctggctgggtgttcatctccctttttgcctttgcttgaggcagtttatggcatggctgtgttattcacgtcgccaggtctcctcctggtggacgttgaggccattttcatttttttactcttaaaaacgacagggcagtgcacatcttcgcatctccggggtgggtcaggtctctgacctctttgccagtgtgacttattacccctttctttctttgtttttctttttgagacagtgtcttgctctgtcgccaggctggaatgcagtggtgtgatcatagatcatagctcactgcaacctccagctcctggctcaaatgatcctcccacttcagccgatattaatccattttcatgctgctgataaagacgtatttgagaccgggcaatttacaaaagaaagaggtttaatggagttacagttccacacagctgggctggggaagccccacaatcatggcagaaggcaaggaggagcaagtcacatcttatacggatggcagctggcaaagagagtgagagagcttctgcagggaaactcctgtttttaaaaccatcagatctcgtgagacttattctctatcacgagaatagcacgggaaagacccacccccatgattcattgatctcccactgggtccctgctacaacacaagggaattatgggagctacaagatgagatttgggtggggacacagagccagaccatatcagcctcccaagtagctggaactacaggtgtgcgccaacatgcctggctaattttttaaatttctgtagagacggggtctcactgtgtcacccaggccggtcttgaactcctgggctcaagtgatccaccctcctcggcgtcccacagtgctggataataggcgtgagccactgtgcccagccatttcccccttatttttagcatcactacagtagctgtgatctctgagctttggggatatcccctccccaacattttactctgaaaattcgaacatctggaaacgtcaaggctttgtacagtggacacctgtgtactcggcagccaccttccgtgatgaacatgccttatatttgctttgtcctcaatctgtgattcgggactggatttctcttgtttcctggtgggacccacactgcttgtcaattacttattttgttccccttcatcccagtcttgctgtgactttcagatacccccgggtcttatatacactcagggttatacccagaaaacatttctcctgggggatttgtctctaggtagggggccctcttgaatagtcagggggagaaagaaagactcaagaccagctctgaggaggcggcaggggtgccccttccctctacctgtgggctccttggggaagaaggacaagtgagtgccatgagaaatacccctggggattttgtggagctggaatgtgctggtggaccatgaatccacaaggacttgggcatcgaactcccttgactgggacccacagcaagggaggctctgcagcatcaccttaatcaaatggactcaccctctctgggtgatgtatcctggtgcttcctcttctgttcatcagtcaatcaacaaataaatggctgggcgtggaggcatatgcctgtaatcccagaaactttggtcattggttatgtctacctgtttatttttgggggagggggattcataatatgtcatgacgtatattaacagtttgcaaagtgccacatgggaacgtaatcttcaggatctggaaagaggctcagtctattcagtctataggaacccccgcctcccccaagacccttgtcatgagaacgaatctttcactcccaaattcctagagtgacgatgattgggtcattattttcttttttattttattttattttattttatttatttttttatttttttgagatggagtcttctctgtctcccaggctagagtgcagtggcgcaatctcggctcactacaacctccgcctcccgggttcaagcaattatcctgcctcagcctcctgagtagctgagactacaggcatgtgccaccatgccaggctaattttttgtatttttagtagagacagggtttcaccatgttagtgaggatggtctgaatctcctgaccttgtgatctgcccacctctgcctcccaaagtgctgggattacaggcgtgagctactgtgcccagcctgggtcattactttcattcaacaaagcatttctccccgcagtccatgcgcaccctgcccacagctctttctcattttcagcatctctcttccctttctagaacatgccgagtttttgcactgcaagtccaaaaagtttacagactttgatgaagtccggcaggagattgaagcagagaccgacagggtcacggggaccaacaaaggcatctccccagtgcccatcaaccttcgagtctactcgccacacggtaggcagcacgggtggggacccatcactgaccgtttctggtcgttcatggacagtgctatgggtgagcctgtgtacttccactcatgggtatcatgtgcccattcacaaacagttgatattcacacacacatagccccttgatctgtatcttcccacttgtgctaggtatgtagtacccagacctctgtctcagcttgaagaaagagcatgccaagaagttgtttggagtggtgggggattgcagccatttcccccttttaccaagggcagccaccacttggctcaaggcagccagatctgctggtgcctcaagagaggccagaaccagtcttctgtaaaatatcctgggtttttttttttttttttttgagacagagtcttgctctgttgcccagtctggggttcagtggtgtgatctctgctcgctgcaacctccgcctcccaggttcaagcaattattgtgcctcagccgcccaagtagctgggattacaggcatgcaccactacacccagctaattttttttttttttttttgagatggagtctcgctctgtcgcccagactggagtacagtggtgtgatctcagctcactgcagtctccgcctcccaggttcaagctattctcctgcctcagcctcccaagtagctaggactagaggcaactgccaccacgcctggcaaattttttgtatttttagtagagatgggatttcaccatattggccaggcttgtctcaaactcccgaccttgtgatctgcccactttggcctcccaaaatgctgggattacagacgtgagccgccgcgcccggccaaattttttttttttttttgagacagagtctcgctctgttgcccaggctggagtgtagtggcgcaatctccactcaatgcaaccttcacctcccgggttcaagcaattctctggcctcagcctcccgagtagctgggattacaggtgtgtaccaccctgcctggctaattttttttttattttttattttttttatttttagtagagacggggtttcaccatgttgcacaggctggtctcgaactcctgagctcaggcaatccacccacctcagactcccaaagtgctaggattacaggcgtgagccaccacgcccagcccattcagctacttttttgtatttttagtagagatggggtttcaccatgttggccaggctggtctcgaactcctaacctcaggtgatcgcctgcatccccctcccaaagtgctgggattacaggttttagccaccttgcccagccaaatatcctgattttaaaactctgcattcaaacagcagcccggggccatagacatcctctggcccagaggcacagattgctaccatgatgggttccttgcgataagttttaaatttgtttttcaataaatgacacctgcatgtggctcagaattcaaaaattacagaaaggtatatcgcaaaaacctaccttgtcaaccagttttgcacacatattttaggttcttcagatgacaatgcaaacatgagctgggtgtggtttcacacacctgtcattcaagctgcctgaaaggctgagtcaggagggtcacttgggcccaggaagtcgaggttgcagtgagctatgatcacatctgtgaatagctactgcacttcacctgggtaacatagcaagaccctctatcttaaaaaaaatgtgtaagcaaaaaacatgtaagcaattgtgattgtatctatgtatatgttgtgtatgtgtttatcactccttttccttaaattgttagcataacataaaaatcacttatgctttttttgagatggagtttcactcttattgcccaggctggagtgcaatggtgcaatcttggcttaccgcaacctccacctcccgggttcaagtgattctcctgcctcagccccctgagtagctgggattacaggcatgcgccacctcacccggctaattttgtatttttagtagagacggggtttgtccgtgttggtcaggctggtctcgaactcccgacctcaggtgatcgcctgccttggcctcccaaagtgctggcattacaggtgtgagccactgcgttggcctatgctttttttttttttttgtatgcctctcagaatgtttctttattatatatttatttttttttttttttgagacagggtttaacactgttggccaagctggagtacagtggtgagatcttggctcacttcttctcctgggctcaggcgatcctcccgccttagtctcctgagtagttaggacaacagatgcacaccatcatgccaggctaattttttatatttttggtagaggtagggtttcgccatcttgcccaggctggtttcgaactcctgagctcaagtgatctacccatcatggcctcccaaagtgctgggatgacaggcatgagtcaccgcgcctggcctcatccatttgtcttttgtttttgtttttttgagacagtcttgctctgtcgcccaggctggagtgcagtggtatgatctcagctcactgcaacctccaccttctgggttcaagtgtttctcatgcctcagcctccagagtagctgggagtacaagtgtgtgctaccacgcccagctaatttttgtatacttagtacagatggggttttgccatgttggctaggctggtctagaactcctggcctcaagtgatccacccacctcggcctcccaaagtgctgggattgcagatgtgagccaccgcacccagcctcatctgtttgtctgtaatggttctttggtattggctgaatggatgggctgaaatttattcagtcatttaggtctattccagtctgaactgtcctgatttagaactgtgccattgaaatggagtaggtagaaggtatctgtaggatgggatcctagaaggggagttactggatcaaaggtgtggttcaggcagagtgtcaggcgacatcctcaagtctgagccccgcgcaggaactttggtagtcagctgggtggctgcgggcctgtttgtgcctcccctctcctggctctgaatgcctttccttctggtttccctcccagtgttgaacttgaccctcatcgacctcccgggtatcaccaaggtgcctgtgggcgaccagcctccagacatcgagtaccagatcaaggacatgatcctgcagttcatcagccgggagagcagcctcattctggctgtcacgcccgccaacatggacctggccaactccgacgccctcaagctggccaaggaagtcgatccccaaggtaaccctgagcctagggcagtcccctcttccaggtgcctctgagcatgggatgtgcccagcatccttggttccaagtcactggcgttctctttaatccatggccgctgtaggaaaaggcctcctggaacatggcacttcctccgagaaccagcagtgctggtgggcatcccctgggaagtcactgtgtggcagttggacggtcctccttggacatggcagtgcccatgttgccagagtgggaagctagcctagggctgaaggaagggcccagcgctccatcgcccagatgcgatcttaggtcccatctagctgttactctgctccctgagacatggtcccctcttagtcagaacgggaacttcagtcctaacccagatagctgatgtgaggactgttgaacttttgggttgtttctgatctttgcatggtgagatcgtctatttcccttcgagttgacacccctgggcccctctagtcagatccttctactgaaccctcactgcagaatgtgagcaggaaggggccccagggagggcacagctgtggcccccttgatgcccaaattggcacccaccagagatcttcactctggcttccatctgtccccagtgtctcatgcacatgccacacatataacacacacggttagcacagagccaggccctcagcccccgtgggagcagttgatctgcagaggtgagactttgctagaaagacatccttgactctggaatgacttgtggagaggtggaattggatgggatggtttccagagtggaattttagccattcaggcaagaggtagtcctggaaacagtcgtgtcaaactcaaatgttcccttgggactttgccggcacttggaaagtccagcatcaaaatctggcccaggaatcatgtttacgtgaggtttcccaaagcctgcagcagcagaggttgtccttaataacacaaatgacaataacggccagcatttgttgagtatttgccgtgtgccaggctcacccttatgaccaccctgtgagatcagggctgtgaccatcttcattcgacatgtcggaaactggggtccaggcctgtgacgttctggctttcccaggtgatgtgacctggaagtttcagggccaactggaccccaggtggcttgcagctgccagctgatgctctttcctggtggcagcctctgacctctgacctctgggctctttcaggcctacggaccatcggtgtcatcaccaagcttgacctgatggacgagggcaccgacgccagggacgtcttggagaacaagttgctcccgttgagaagaggtgtggctttgggggtgctggggaagcaggaggatgggtggggtccttatcattactgaaaccccagcacctgttccctgcctgcctggaagtcattgcttctccatttcaccgtaactccttctttcttttccctttgagctatgtatctttttcttctgatttgtatgcattcgtttttcaagtgcacaattaacacctgctggtttctgaaacattagaaaacaagtgtatagaaagaggaaactaaactcacccgcagccacacttcccccagacagccactggtgaatctgcagctcccagctccccagggtttataactttaattaatttttttattactttctattatgagccttcccttcccttttccttttcctttttgttttttgagacggagtttttgctcttgtcacccaagctatagtacagtggcacaatctcagctcactgcaacctccgcctcccaggttcaactgattctcctgccccagcttcctgagtagctgggattacaagtgggcaccaccacgcccagctagtttttgtatttttactagagacggggtttcactgtgttggccaagctggtctcaaactcctgacttcaggtgatccacttgccttggcctcccaaagtgctgggattacagccatgagccaccgcacccggcctattatgagcattttcaaacattcccaaaagtgtggaaaaaagttcaaagaatcctcgtggatggcttccccagcttcggtggttattattattattttcttcctggaatattttattttttcattttatttatttatttatttatttatttatttatttatttatgagacggagtctctgttgcccaggctggagtgcaatggtgcagtctgggctcactgcaacctccacctcccaggttcatgccattctcctgcctcagcctcccgagtagctgggattacaggtgccagccaccacgcgtggctaatttttgtatttttaattgagacagggtttcaccatgttggccaggctggtctcgaactgctgacctcgtgatccacccgcctcggcctcccaaagtgctgggattacaggtgtgagccaccgcacccggccatcttcctggaagattttaacacaaatcctaggcactggctgggcgaggtggctcacacctgtaatctcagtgctttgggaggctgaggcaggaggatgccttgaggctgggagttcaagactagcctgggcaacatatcaagtccctgtctctactaaagattaaaaagttagctgggcatggtggcatacacctatagtcccacctacttaagaggctgaggtgggaagattgcttgagcccaggagttcgaagctgcagtgagctatgatcacactactacactctagcctgcacaacagagcaagatcttgcctctaaaaaaaaaaaaattctataaatcctaggcattgtagcattttacacataaatacccacatttcttttcaaatacttccccttgccatcccatttgtttttttctataccattcatttgtggaagaaaccagaccacatcacacatttgggatttggccaattattgttctctgttagctggtaattagatcaggttcaggttcaagttcaggtacagatcttctgataggagtaacctaagtattttttattttattttaaaaatattttaaatattttgggtcgggcatggtgactcacacctgtaatcccagcactttgggaggccaaggcaggcggatcacaaggtcaggagatcaagaccatccttgctaacacagtgaaatgttgtctgtactaaaaatacaaaaaattagccaggcgtggtggcacacacttgtagtcccagctactcgggaggctgaggcaggagaatcgcttgaacccaggaggtggaggttgcagcgagccgagatggcgccacttcactccagcctgggccacagagcaagggtctgtctcaaaaaaaaaaaaaaagaaaaatttttcaagcattttattttatcggagcagcagttttaggttcatagccaaactgagagggagatacagagatttcctatcagccctatagcccacacatctgtaacctctcccactttcaacgtgcccagcagagcggtgcatttgctagaactgatgagcctgcgttgacccattgtcaccaccccaccccacatccatggttgacatcagggttcactcttgctgttataagtttttttctttctttctttctttctttctttccttttttttttttttttttttttttttttgacgatgtcttattctgtcacctaggctggagtgcactgggacaatcatagctcactgtagccttaaactcccaggctcaagtgatcctccgagctcagcctcccaagtatttgggattacaggcatgtgcgattgctcctggctaggttttattttgttttgttttatttttttcagacagagtttcattcttgttgcccaggctggagtgcaggggcacaatctcagctgactgcaacctctgcctcctgagtagctgggattacaggcactcgccaccacacacagctgatttttgtgtttttagtagagatggggtttcaccatgttggctaggctggtcttgaactcctgacctcatgtgatccacccgcctcagcctcccaaaatgctgggattaaaggcatgagccaccgtgcccagccttcttttgtgtttttttaaagccattcctcccctctggcatctactctaagctgcgggcacctcctgcctttcccttcatgcttagccgcagtcatttagagcatttcttttactcctgggttttccacctcgatgtctgagatagatgtggggaaaagttcagaccttggttgccagcatcccccagcactgctgagatattgagtggtgaggcgaccccggatcccaggggaatgctgtcagggctaaattcaaaaccctgtttagctgtgaagatccggggctgagaagcaaatctgtggctggctgaggtttggggaggatttgctggtgctagagaggaaagcagaccctacccaaccccacgccctactacagccaccccgacccggctgcccttggacactgttaggcctccatcttggatcctaagggcctttggggtctgtgggcactagccaggctgaggatttggtgatatgggcctcttccccttcctcctgactcactgatgtccacagctgcccttctctgccttccttcctgtttctaagaacgaaggcgcttccactctcagctcacttgtaggcctgctcccgttttgtgacctcaggcttcagaagccctcccactggaccctttttcctggcgtactaatgactcacaactcctcctcctttacgggaacccaggctaggcgtggtgtctcatgcctataaccccaggattttggaaagcacagttgggaggatggcttgaggcccagagtttgagaccagcctgagcaacacagcaagaccccatctctctcttaaaaaattatccaggctgggcacagtggctcacgcctgtaatcccagcactttgggagaccaaggcgggtggatcaaaccccagctctactaaaaatagaattagctgggtgtgttggtgcatgcctgtaatcccagctactcgagaggctgagacatgagaatcgcttgaacccaggaggcagaggttgtagtgagctgagattgcaccactgtactccagcctgggtgacagagtgagactctgtctttaaaaaaaaaaaaaaaaaaaaaatccgtgtgtgatggtgcacgtgcctgtactcccagctactcaggaggctgagtccggaggatggcttgagcccaggagttcaaagctgtagtaagctatgattgtgccactgcaatgcagaatgggcaacagagcgagactccatctcttaattaagtaaatcaagccaaatccaagccagatgctttttactggcccctcctgtttccttctttgtgctgtcacacaggtgatggtgactctggcttcacagggatctaggttcagatcttgggtctcctactgtgacctcaccttggcatgtcttcgtttccctcctccctcttggatccaagagagatctggcgaggatgaagagcagtcacatcccacaagaccctacaggatagatgaccggcacctctcccttgcttctcaagagaaacatgcacaacccactacaaagaaaagggagcacaggccaggcactgtggctcacgcctgtaattccagcactttgggaggccatggcgggcagatcatgaggtcaggagttcgagaccagcatggccaacatggtgaaaccccgtctctactaaaaaaacaaaaattagccaggcgtggtgacgcacgcctgtaatcccagatgctcaggaggtggaggttgcagtgagctgaggttgcaccactgcacttcagcctgggcagcaagagtgaaactctgtctcaaaacaaaaaaccccacaaaacaaaaacctagccaggagtgcaatggtaggcattccacttggattctttgcaacagtgtgtattgaattatccagcttttctcccccatatactgaagcgttaactttcagttctacctccttctcggtgtagttttggactttcttttcagttccattgatctctctggacatgaataccctgatgtacccaactgtttaaaatatactcgtttgatagtggattttagctcttccctattgctcttgtttttaagatgttatttcttttttttcttgtgagacaaggcctcgctctgttgcccgggctggagtgcagtggggtgattacagcttgctgcaacctcgaactcccaggctcaggtgatcctcccatctcagcctcccaggtagctgggactatacacgtgtgctaccacgcctcgctaatttttgtatatttttgtagagatggggttttgccatgttacccaggctggtctggaactcttgggctcaagcgttccacccgcctcggcctcccaaagtgttggaattacaggcgtgagccaccgcacctggccttgagattttttttctttttctttttctttttctttttctttttctctttttttttattcagagtcttgatctgtcacccaggctgaagtgtagttgcatgatcttggctcactgcaacctccgcctgccgggttcaagcggttctcctgcctcagcctcccgagtacctgggactatagtcacgcgccaccatgcacggctaattttttgtatttttagtagaggcggggtttcaccatgctggccagggtggcctcgagctccttaccttgtgatctacccacctcagcctcccaaagtgatgggattacaggcgtgagccaccgctcccggccgagatttttttctcacctatctttgaatctcagcttgtagatttcatctgccccaaagcttttttctgtccctgcgcacacaggctggatgtgagctctccttcctccaaatacttaatgttgctcttcgcagctgccatgtgcattcgcaccctctgtgttgtttctgagtaacatgttatgacagctgtgagtgcctcgtgggacaggatccatctctatacttgaatcttgcccatccccgtgccaggtccacttggctcacctagctttgcccctgacctgactgcctctccccacaggctacattggcgtggtgaaccgcagccagaaggatattgagggcaagaaggacatccgtgcagcactggcagctgagaggaagttcttcctctcccacccggcctaccggcacatggccgaccgcatgggcacgccacatctgcagaagacgctgaatcaggtactgcaagggtttgcacgtagtgtgcagtggcataggctgtgcactgcacaacagctgcaatcctcactggcacttgtttcaggctagagcagcacttgttttagcaaaatgggttcagtccacatttagcctaggagtttgagaccagtctgggcaacatatggagaccccatctctaggaaaaatagaaaaaattagctaagcatggtggcacatgcctgtagtcccaggtactcaggaggctgaggcaggaggatcacttgagcctggaaaatcaaggcttcagtgagccatgttcatgccactgcactccagcctgggcaatagagtgagaccctgtttcaaaaacttaaataactaaataaaagaaatgtacttgattcagggtctggtgaagagcagatgttcagtgacttggtgctgctactattacaaccatcgctgttattattaccaaaattttaattatcattgtaattattcagtcatttacccagaagactgtatgcattgcctggggttggtgacagggggttaataactcttttttatttattattattattattattattattatttttttttatttttggagacacagtctcactctgtcacctaggctagagtgcagtggcatgatcttggctcactgcaacctccacgtcccaggttcgagtgattctcctgcctcagcttcctgagtagctgggattacaggagtgtgccaccacacctggctaatttttgtatttttagtagagatggagtttcaccatgttggccaggctggtctcaaattctgagctcgagtgatccgcctgtgtcagcctcctgaagtgctgagattacaagcatgagccaccatgcctggcctatcgttctcttcttgtaagtaattgattcacatggtgcataaacagaaatgatattaaaagctatacagtgggccagtgtgtggtagcaggggcaagacgctcctcctcgctgttttctagcaccttccagggtggcagcagggcctcagcagcactccagcagtcatcttttcatgcacatatcagggggacacagtgtccacacgagagtaggttcctgtccttgtagaaggcataattctaatgggggagactgacacccaacaaaccgccagataaatgcacgatcaagaatccagtaggggcgcgggggccgggaaaagagccacccagagaaggcagctcaggagagcaaagagggaagtcagtgtctagagggaggggccctccaggagaggaagctggggtgcttacaaacgggagtagggagaggaagggaagtaaaactccgcagctggctggggcctcctgagagccagcagtgaaaagtccagctggcctccagggagcctggagggggctcagcctccttccacgtggggtgcttcccagagcagcagcgccccttcctctccatttgctcatgacttaagtgccctagtatcctgtcacagaccaagggaaggccagcgtagctccctgcctttctaggcagcccacatagacgggggtcgatggccagggctgcagggcagggacccctggtcacggaggtctttgggttaccccacttgctccatgccatagatgtgaggttccttcatgcctcttttctagctcgccagacactttgtatttattttttatttttttgatgattttttttttttttttttttttttgagacagagcctcactctgttgcccgggctggagtgcagtggcatgatctcagctcactccagcctccacctcccaggttcaagtgattctcatgcctcagcctcccaagtagctgggattacaggcgtgcgccaccacactcaactaacttctgtatttttagcagagacagggtttcaccatgttggccaggcttgtctcctaatctcaggtgatctgcccgccttagcctcccaaagtgctgggattacaggcgtgagccactgtacccatcccggccttcccctcaaccccagatggagtctcgctctgttgcccaggctggagtacagtggcacaatctcggctcactgtaagctccgtctcccgggttcacaccattctcctgcctcagcctcccgagtagctgggactataggcacccatcaccacacccggctaattttttttttttttttgtatttttagtagagacggggtttcaccgtgttagctgggatggtcttgatctcttgacctcatgatctgcctgccttggcctcccaaagtgctggaattacagtgtgagccactgcccccggcccatgcccagcctttttgatttttcagacaaggtcttactctgttgtccagaatggattgcagtgacacaaacacggctcattgcatcctcagcctcctgtactcaagcgatccttttgccttagcctcctgagtagctgggactacaggtgtgtgctgccacacctagctaatttttaaaactttttttatcttttgtagagagaaggtctcaccatattgcctgggctggtctcaaacgcctatcctctagtgatctgtctcaacctccccaagtgctaggattacaggcgtgagccactggacccagctttctctgttgtaggacagatggccaaactctgctttacactttgcaagtataggctgattttatggctttgtttttctttttctttttttttgagacagagtcttgctctgtcacccaggctggagtgccattgtgtgatctcggcccactgcaacctccacctcccgagttctttctcagcctcccaagtagctgagactacaggcacccaccaccacaccgagataatttttgtattttttggtagaaacagggtttcattgtgttggccaggctggtctcgatctcttgatcttaagtgatccttctgcctcagtctcccaaagtgctgggattgcaggtgtgtaccaccgtgcctggcccacatttgtctattttgaatcttccttgcttttctctgtagatgcagatgcagccggggagctcatcttgagtgcattctccaccttttcaggggcgatctttccatcttagtttgtagggcctgtccccatgtgtgttcattggcccccgtttccgtggtctggatggactgtccttgcaagctgttgcttgtcctccaaggcgtggataggcccagtgcctgatgtcggccccgtgggctgtttgtagcctcttacactcatgggcagctccgtgccgtctccgttcccagacatgagtgtgtctgtggcttgatttatctgttgctgtctctcaaggctgtgtggtgtggtggccgcatagtggcaccctggtgttggcccttggttggggggagtgtgtctgccactccctggtatcctgcccatgccaccctttctgatctctgacctctctcctgcagcaactgaccaaccacatccgggagtcgctgccggccctacgtagcaaactacagagccagctgctgtccctggagaaggaggtggaggagtacaagaactttcggcccgacgaccccacccgcaaaaccaaagccctgctgcagtatgtaccccggcacccaccaccaccaccaccctggcccctgccttccatcagccacagggccccctaggctgggcaccactcatcactcgtccactcattgattcagcagacacttgctgcaagccttctgcgtgccaggctccatcctaagcatggcattcgccccagtggaggggacaggtgtccgtccctgcccctggagtgctcagaatggggggaagtgggacaaatgggacaaaaaacaagaaagaaaatgtatagtgtgttaaatgtcaaaatatgaaagtggtgctagtgtgggagttgtcgggaacagcctcctttagaaggtgagcattggccggccaggagcggtggttcacgtctgtaatcccagcactttgggaggccaaggtgggtggatcacctgaggtcgggagttcgagaccagcctgatcaacatggtgaaaccccgtctctactgaaattgcaaaattaggctgggcatggtggctcacacctgtaatccccgtacttttgggaggccgaggcgagcggatcatgtcaggagatcgagaccatcctggctaacgtggtgaaaccccatcactaccaaaaaaaaaatacaaaaaactagccaggcgtggtggtgggcgcctgtggtcccagctacttgggaggctgaggcaggagaatggcgtgaacccaggaggtggagctttcagtgagtcgagattgcgcaacttcactccagcctgggcatcagagtgagactctgtttaaaaaaaagaaaaaaggccaggcacggtggctcacgcctgtaatcctagcactttgggaggctgaggtgggtggatcaccaggtcaggagattgagaccacggtgaaaccctgtctctactcaacgtacaaaaaaattagccgggcgcggtggtgggcacctgtagtcccagctacacaggaggctgaggcaggagaatgacatgaacccaggaggcggagcttgcagtgagctgagatcacgccactgcactccagcctgggtgattgagcaagactgtctcaaaaaaaaaaaaaaaaaaaattgcaaaattatccaggcatggtggcacatgcctgtaatcccagctacttgggagactgaggcaagagaattgcttgaacccaggaggtggaggttgcggtgagccgagatcgtgccattgcactccagcctgggtgatagggcaagactccgtctccaaaaaaaaaagatgagtgttggccaggggtggtggcttacgcctgtaatcccaacattttgggaggccgaggcgggaggatcacttgaggtccggagttcaagaccagcctggccaacatggtgaaacccctgtctctactgaaaatacaaaaattagccaggtgtggtggcaggcgcctgtaatcccagctactcgggagactgaggcaagagaatcgcttgaagccaagaggcagaggttgcagtgagctgagaacgtgtcactgcatatcagcctgggcaacagagtaagactccgtctcaaaaaaaaaaaaaaaaaaagaagttgagtgtcaggcgaagacctgaagcaggtgagggcagggcaggagccgtgtgggattaagcccggccagtgcaaaggccctggggcaggactgggccgggcatgtcagaggaagaccctgtggctggatggagtgagtgaggggagtgggaggaggtgatagagcaggttgtgcagggccttgtggggcctcagggaggacattggcttttgctgtgagtgaggtgggagccatggacagttctgagcgcaggagagtcaggactgactcaggtgctcacaggctccctagccgtggtgggagaagagacatgggagagcgggtgggagccagaccttggctaggttaggtccctctccagcttggcctcttaagatccaccccatgacttggttggtgcagctgcttagctgtgagattgggaagcaggtgtgcccccacaatcccaaattctcactcggggactcttctgcctctgaccttttggcttttggcctgtaagggaccttgaggcactggaacagctggaccagagcaggtgacagggacacctgggtagctcatactgcagacagtgccatgcatgaggcacttcccacagggacaccaggaggacaccgcctcctctggccatcacagccctggcatccccccaccccctctgccaggcagtagtgcatggtcgtgggctaaggggccagagtgcttttatgctcagacagccttgactacgttacaaaacactttctacagagcagatagtggccctttgcaggcttcaggaggaaattcatagccggggatggtggtgcacccctgtaattctagctacttgggaggctgaggcaggagaatcgcttgaacccaggaggtggatgttgcagtgagccaagattgtgccactgcactccagcctgggtgacagagcaagactctgtctcaaacaaacaaagaaacaaacaaacaaacaaacaaaacacaagattcagcctactagactgaaggaagtgttgttgtggaggattcagcctaagggtggacctgggcctgctgggtgaccacaggcaggtgattggacctctctgagcctcattttctgcacctctaaagtgagggtcatagcagctgtcatctcacatggccatggggacaaactggcagattacaaggtgcctgtaatcccagcacatggggatgccaagtcaggaggattgcttaaagccaggagtttgagaccagcgtgagcaacaaagtgggatcctgtctctgaaattaagaaaaaaaaaaaaaattaggctggggacgatggttcacgcctgtattcccagcactttgagaggcttcagtggatggatcacttgaggtcaggagttcaagaccaccttcaccaacatggtgaaaccctgtctctatgaaaaaatacaaaaattagccaggtgtggtggtgggcacctgtagtcccagctacttggaaggctaaagcaggacaatcacttgaacctgggagtcagaggttgcagtgagccaggatcacaccactgcactccagcctgggcagacagagcgagactgtatctcaaaaataaataagtaaataaataaataaataaatttaaatactacttgttaagcctatggcaggactgggccaggggatgcccatcacaaacagtccctgtcccccggggcttagcacgttacgtcatttgtaaccagttgccttgcagggccctccctgcccaggcactctcaccatggagaagcgccactgttatctgtgtctcctgtcaagagctgggccttcttgctttagcattttatctgagggtccaaggtcctcatgcagacatgggcggtctttctcggttcacgccttacaagagaacgggaattacggtaatagacttcccccagcctgaattctgcacttggcttttctcttcttgttaaagcaaagcctggagccttctgtctccgcctggtgcagcccacagactgttcatgtatcccagtgcccatggggacacccagggtttttttgtttgtttgtttgtttgtttgtttttggccttaaccgatgcttgtaagttcatctgtgactgtacaggcaaggattcctgcagggcaaagaccccagcagagggatcttgggttaaggaacatacgtgtttaaaattgatttttaatttttcattttattttatttatgtatttggtggttttttttgtttttgttttgagatagagtctcgctctgtcacccaggctgaagcgcagtggcatgatctcagctcactgcaacctcccaggttcaagcgattctcctgtctcagcctcctgagtagctgagattacaggcatgcgccaccacacccagcaaatttttgtatttttagtaaagacaggggtttcaccatgttggccaggctggtgtcgaactcctgaccttaggtgatctgcccacctcggcctcccaaagtgctgggattacaggcatgagccaccatgcccggacctcatgtatttgttttttaaacggggtctcgccttgttgcccaggctagagtgcagtggtgcaatcccggctcaccgcagcctcaccacttgggctcaggtgatcctcccaccacagcctcccgagtagctgggaataatacaggtatgcgccaccatgcctagctaatttttgtatttttgtagagacaaggtctcactatgttacctaggctgatcttaaactcctgacctcaagcaaaccgcctgcctgaactttccaactatgagatcgcagacgtgaaccaccacgcctggccttgtttttttaatttttatttattttattttattcttttgagacaaggtctcttgttctgttgcccaggctggagtgcactggtgcaatcatggctcactgaagcctggacctcctgggctcaagcaattcttctgcctcagccacctgagtagcctgatcctcaggcgtgcaccacagcacctggctaatttttaaagtatttctagagactggatctcactatgttgcccaggctgtctcaaactccttagctcaagcgatcctcctacctcagcttcccgaagtgatgggattacaggagtgcaccaccatgcccagcccaactccccctttttataaggacaccagttatattggctatgagcacaccctgtgatattctcttgactgattacatctgcagtgaccctgtttccaaataagagtacattccgaggtacaggggggcaggattcaacccgaattccgcgggacaccgaccagccggtcacaattgtccagaatgctctgattgtgcagcgtgggttgggcctgtaaatcacctccagggcccccaggaggctggtgcccaggtgtgctttgtcccctgtggctgagagcaggtccccagagtctccatccttgcctaaccctccccctccccccgtcgcccagtctgttgtctgtcattagtttagtgctatgcctttgctgaccttggtcctggtttggtccacaattcaaattctccattccaggctgggtgcagtggctcatgcctgtaatcccagcactttgggaggccaaggcgggcggatcacttgaggtcaggagattgagagaccagcctggccaacatgccgaaaccccatttctcctaaaagcacaaaaattagctgggcatggtggcgggcacctgtattcccagctactggagaggctgaggcaggagaatcacttgaacccggcaggcggaggttgcagtaagctgagattgtcccattgcgctccagcttgggcgacagagtgagactccagctcaaaaaacaaaaaacaaaaaaaacaaattccccattccaggtgaagcattaacctaggcctttgtgtgtctcctggaaggaaattaaatgtgcacaccctttacttcatgtgaggaaagagattttggggatctgggcagcttgtgcttgcctctcccagttggggtatgaaggagacccccctttctttggcagcccagccttggtggccctgacagtggtcaccatttgagcagttcccctttaggagcaagtccccaggtacttcagtagatcatgatttttgggagggaaactgatgaagggagacagcccagtaccctaaggagagcaattaggaatgcttaggaaaactaaaacgtgaacaagatcatcctacttttttactattcacgatgccaataggcaatgctgagagactctttttaagggccaggcccgttctaaggggcgacacatgttattaccactttttgtccattagatgagcaattgtttaccaacaaaaattttctttcttttttttcttctttttttgagacagggtcttactctgtctcgcccaggctggagtgcagtggtgcgatctcggctcactgcagcctccgccacccagattcaagcggttctcctgcctcagcctcccgattaactgggactagaaacgtgcaccaccacacccagctcgtttttgtatttttagtagagacggggtttcgccatgttgtccaggctaatctcaaactcctgggctcaggtgatctgcctacctcagcctcccaaagtgctgggattataggtgtgagccaccgtgtccagtatatatatatattttttaataaaatgtggtctcactgtgttgcccagggtggtctcgaactcccagactaaagccatcctctcacctcagcatcctaaagtgctaatattgcaggcatgagccaccgcacccggccaataaaacattttaacttgtgtgaaaccaggtgtctttgcagaattaccattagtggcagcattttttctttttttgtgggcacacaaaataacagtgcattttaggatcagtgacttcttggaggtaatgagatctaaaaacatcttcagtctccacgaaggaggtagatgttgttaccctcaacccattttgtagatgaggaatcggaggctcagaggggcaaagtcctgtccaaggcctcacatcccatcgatgggtcaggaccaaccccagcaggctgggaggtggcgggaacctatggaagccacctgaattgtggggaagtggctacctttccttcccagcatcctgtaaatcaagttgagcttcagggcagaggtgctgagctttgacccctgaacttcactcctgtcttctgcaaagtgggaggaataagtgggccttctcagatcgaatgggtgaataatcggaacaggcttagcttgagcctgactcgtagccagcatttgccattgggagctcttgaatttggtttatttgtcttaatatagacagaagacattttgctgctgaaaaatggtaaaagaacagtaaaccctggcttgacttggaacatcattccagagtagtgtggaaacctccgttttgatgcttgctttttccttttcctcataggatggtccagcagtttggggtggattttgagaagaggatcgagggctcaggagatcaggtggacactctggagctctccgggggcgcccgaatcaatcgcatcttccacgagcggttcccatttgagctggtgaaggtagtgccccccggggctgggccctcccgtctctggtcaggcaccctcctgctggcctcaagccaggcctcctcccaggcaataaggtctcaagctcctacctctaggcctgaacttgtggtgggcagggtgtggcctggatgaggtgtccccatgggcttccttttctgacactcagctttgaggttttgggcagaacaatatgaaaacccctgtgtttttcctctgacaaaagccaatatacattctttgcaaaatacatagaaaatacagataaatttacatgagaagatgtccctagcatgtcattgaagaaggaaaaaataggcattggagccagcatgtgcaacatagcactgagctgatatatacaacatccttatgtatgaaactgaacatggatgtctgtctacaagtgtttctttgtatttgcaaggatgtttgcaaaaatgtcagccctgggtgctaggatttgggacttctttttccgtgtgtgtgtgtgtgtgtgtgtgtgtgtgtgtgtgatttgcttgaagttttatactgtttacaatgagcacatagcattttttattaaaaaaacaaacagttttttaaaatcagaggagcaagaccaaatgcagtggctcacgcctataatccgtgggaggccaagggggcctgatcacttgagcccaggagttcaagaccagcctgggcaacatggtgaaaccccatctctactaaaaatacaaaaattatccaggtgtggtggcatgtgcctgtagtcctagctacttgggaagctgaggtaggagaatcacttgagcccaggaggcagaggatgcagcaatgagccaagatggcaccaccgcactccagcctcagtgacagagccagaccctatctcaaaaaaaaacaaaaaaaacaaaaagaaagaaaaaagaaaaagctgggtgtggtggtgcatactgatagtctgaaaaatctaagtttacatgaatttatattcccaccaatatgatgagagagttggtgtcatgtcatgctttctgaaactgggttttaattaattaatttgtttgtttatttttattttttttgagacagggtcttgctctttcacccaggctggagtgcagtggtgcaatcacagctcactgcagcttcgaccttcctgggctcggatgatcctcccacctcagcctcccgagtagctgggactataggcgtgcaccagcccacctggccaatttttgtatttttagtagagatggggtctcactatgttgcccaggctggtctcaaactcctgggctcaagccatctgcctgccttggcctcccaaagtgctgagattacaggtgtgagccactgtatctggccagttttcaattttttaaataaaattttgacgagttaaatattctgccttgtgaatatagccacacgtgggagagaacgttccccagatgcacgcctgccacgggggcgccccgggtgcctccatgcatgtgcttggtttgtctcttctcagatggagtttgacgagaaggacttacgacgggagatcagctatgccattaagaacatccatggagtcaggcaagttccacgaggagagtcaccactgttccttcctctccgtggtgcgaccccccagctaattgggtcacccacacctctgagtccctaatcgttaggccttaagagggctcttggatggttttctgtagctgcgagcccctccctgagggtctccaagggcacatgagggtggatgtgtcttagtcctgcgtccattgcaggcttcagggctgtctgcagctcctgatcaaatagggcttagttcctgcccagtcggttggtgtgaacctcatgctaaactaagaatgctcactgcagatttgcctggggaggggcggggcggcactgaatcagggttttgggaagccagcatgagtccccatcatggcttcctcgtgagcctcttgggtcccctccttattctaacaaaggtagttgctccaggtgtctgcccttccatcgccgtggggtcctcgggtcaccctgagggtttccgggcagtggactcaggcatccgaccccacacatgacacaaccttcattccttgttggggacccggccagggccaatgaaattgctgaccatgctttgtttctctctgacttatctcccctgcccccgggtctggacggtttcaggaccgggcttttcaccccggacttggcattcgaggccattgtgaaaaagcaggtcgtcaagctgaaagagccctgtctgaaatgtgtcgacctggttatccaggagctaatcaatacagttaggcagtgtaccagtaaggtattgctccctcggcagggtgactcctgaccttgtggaaacgggggtacgggggtttggtatcaggctcccagcgcctcattggcccccactggtgccttttctccccatatcgctttgtgtccgtgaacttggcctctccccagaggctggggcaggagcatgtaggcctgggcccaggcacacaggggagtgccaggcctcctggactggccagacagatgcacagttgtccctgggaccctgataccaagcctagcatgtgtctgatgaaattggggtttcactgggctgttgctttgctgcctcctgggaagcagagagggaccccccgcgtcaactgctggaggctgagctccttgaagctccctggctgtcaccccttcttgaccaatgcccggcattctcagacttccctggagccaccgacttctctgtccctcagctccgggaatggcctgaatgccagcgacatcatgagagccagctggggtcctaagtgcccctgcccaccccctgcaccccacgctgtcccccaggggcagcccatttttggatccacttagtcacagtgcctctatgcgctctcgacgagccactgcctccactcagcaggacgcgccgggctcccccaacccgcgccaacgccgcgggcctggttcccagggcagcacgctttggccaagcagctgaaatgcctcccagtgggcagtctgtgcttgcgcgaccacagtgtccccagcgctccgggttgccagggaatttctgcttgagcccctctgttcttagtctggaaaagcccacatttgctgcttaagcttcttcgattagaaaagggagggggaaaacagtccaaacaggttggaaaacgctcgtcctagagccaggtgtcatggacatgaatgttagaggactccgcacaccttggctgtctgtctgtgcaatgacaaccccccgtggcccttctgtaactacaccccagaccgagcccacacccccaaaccccagacctctttgatccgaagcagcttccggggcaaatgcgggcgcaggctcccccatgcatggactaatcagatgactctcgtttcttctcttctctctgtctcctgtcctgcgtgtgtggcctgcactgtccctgggtgtctttctgcctcatcctgccctccgcatgacccaggacggggctcttcacccccgacatggcctttgaagccattgtgaaaaaacagattgtaaaactcaaagagccgagtttgaagtgtgttgatctcgtggtctcagagctggccacggtcataaaaaagtgtgccgagaaggtaacaggttttgttctcatctccgcatttgtccccgtcctccccctccatgtgttagtctcaacccgagcatctggaaaattcagcctcggcaggaacccccttccgcctaccagttgtcacttagagatgtcgccaccttgcattggcagatggaatggggggagtggcatcacacgtgggttgtggctgcccgtgggggcggtcagcctttgttgttgccaaacgcattgcatttactaagcagtgccctttcctggaacccctagagaaaggggtttcccagccagcaccaaaacagcaaaacacaggaaacacatcatctgtatagccctgcatgttctcacagtctaggccacctgagagtaaccattccattttccccgactcgtggacttgacccacactgcagaagatgggactcccctgtgcatgaggtctggttaagttggtgctgcagatgaagcctggggaggtgggggcatttggcgagtgtgtgccacagatacagtgatcaggagtggttctctgcaaggagttcctatcgaggctgatggcccagatacccgccttaccattctagaacagacgctactcactcacgctggcgaggcccttcagggttcctgctctcacccagtgctgggcaagaggggggtgccctgaagccctgcatggcaaacatgcccctgcttttctgctttcatgttgcctcctgcctcctgccccccggtcactggctggaaaagcagctctgctctcctgctgtctccggtccacggtgcccccactcttctgctcttagctcccagctggactcactgggggccaggagcaaggtgtgggctcggtgggccccctcatatctcattccccacccccctccgcattttctacctgtgtggttcatgttgcttcccgtgccacgaggaccccgccaatgcgaccactctgcttgttcccccagctcagttcctacccccggttgcgagaggagacagagcgaatcgtcaccacttacatccgggaacgggaggggagaacgaaggaccaggtactggccttttgtcttctttattgggtataatttacatgcagtaaatgtcaagtgtactgttctgtgcatgctgacagctgcatatggcaaagtaacccttacctcaatcaagatacagagcggttccgtcacctcctaaaatccctgtccctatcatgctgacagctgcatatggcaaagtaacccttacctcaatcaagatacagagcggttccgtcacctcctaaaacccctgtccctatcatgctgacagctgcatatggcaaagtaacccttacctcaatcaagatacagagcggttccgtcacctcctaaaatccctgtccctatgcccctttgtagtcaacctctcaaaaacccacaggccaggctgggtgtagtaactcacgcctgtaatcccagcacttagggaggctcaggcaggaggattgcttgagcccaggagttcgagaccaacgtgggcaacatagcaagaccttgtctctacgaaaacataaaaaaattagccaggcgtggtggcgcatgcctgtggtcccagttacttgggagggtgaggtgggaggatcccttgagcccacaagatcaaggcttcagtaagttatggtcgtgccatcgccctccagcctgggagacagagcgagaccccgtctcttaaaaaagaagcagcaaaggaaatccccaggccctggccaccaccagcccgctccctatcctacagtccttcaagtggactcccacaacgtaaggcccattgactcttgactcccttcctgccacccttcttccctccctccctcccctcggcgtctgcatttgggagccaagcgtgttgtttgttgtatctgtagtttgctgccttgattactaagcaatcttccagggaatggatggagcacagcaaggacctccacttgcctgctggagggtgtttggggtgctttttgtgttgtggttttttgtttttttttttttttttgagacagagttttgctctgtcgcccaggctggggtgcagtggcacgatcttgactcactgccacctccacttcccaggttcaagtgattctcatgcctcagcctccgaagtagccaggactacaggcacatgccactttacccacctaatttttgtatttttagtagagagagattttcactatgttggccaggctggtcttgaactcctgacctcaggtgatctgcccgccttggcctcccaaagtgctgggattataggggtgagctaccacgcccagcctgctttttctttttttaacatttaacgctttcttgcaaaggcatgcaagcacacaccccaagttgctgcctacccctcagctgagactgtcacccacgaagcactgggccgtccttatactctcctgcagccgcagcctcagcctcccaagtagctgggactataggcgtgagctaccacgcctggctaatttttgtatttttagtagagatgaggtttcgccatgttggccaggctggtcttgaactccttagctcaaatgatccacccacctcagcctcccaaagtgctgggatgacaggtgtgagccactgctcccagatctgttttgagtcactttctctcagttgtcctctgtgttctttttacaactgtttgttgaaaccagagcttaattaagcccttgcttgctatgtcactttgtttaaaatggtccctctccccttgccattgatggggatgaaatgggctcatttgtcctgcagggaggcgcccagttttgatttggccaattgctccctcagggcaccagtccacctatgcctcatagctgctgtagcttggaaattgtatcaaaagtctggaagagtctgattctttttgttgttactgttggtaagaatgctgccggcccttccacagcccctggtgcccacctgccatgctgccaggccggatctgagagcgctgggttgaggagactcaggccttactaaaccagccacgctcgctcccacagatggagcaccctggcattttccagcaggcgacaggtccgagtgccttgccctactttattctcaggaacttggaggtgcagtgaggggaagtgactggccaagggccaggggagtccagtgacgcgcatcccagcgcctcctccccagcagcctggcctgttataaatgggaatcaagccagtgagctgcctggatccatggttcccatagaccaacttcatcctgggcaaaagacaagaaggatgagggagggagagtttcagcaagtgcagtggactcataagccctgctcctcacatgagacctttctagcttgatagcttgagcgtgtgtgtgtgtgcgcgcgtgcacgtgcacgtgtgtgttttattttagtgttcataattggacaaattagcttcgcagttttaatgcaacactttgaacacgccaggcgctaaagactttacaggctggacacggtggctcacgcctgtagtcctagcactttgggaggccaaggcaggtggattgcctgagctcaggagttcgagaccagcttgggcaacacggtgaaaacccgtctctactaaaatacaaaaaattagccaggtggtgtggcgtgcgcctgtggtctcagctactcggaagactgaggcaggagaattgcttgaacccaggaggcagaggttgcagtgagccgagattacgccattgcacgccagcctgggtaacacagtgagactctgtctcccaaaaaaaagaaaaagaaaaaaatacaaggcagtggcttgcagtggttcacacctgtaatcccagcactttgggaggccaaggtaggaggatcacttgagcctaggagttcaggaccagtctgggcaacatagtgagaccccacctctacaaaaaaagaaaaatcagccaggtgtggtggcacatgcctgcgaccccagcatcttgggacgctgaggcagggggttgcttgagcccaggagtttgaggctatgattgttctactgcactccagcctgggagacagtaagttcttttctcaaaaaaaaaaaaaaaaaaaagccaggcgcagtggctcatgcttgtaatcccagcactttgagaggccgaggcgggcggatcatgaggtcaggatttcgagaccagcctgaccaactcagtgaaaccctgtatctactaaaaatacaaaaattagctgggcgtggtggcaggcacctgtaatcccagctatttgggaggctgaggcaggagaatcgcttgaacccaggaggcagaggttgcagtgagccaagattgtcccactgcactccagcctgggcgacagagcaagactccgtctcgaagaaaaaaaaaaaaaaaacaaaaaaaacaactgcacattattaaacccttggcagttgggcctcctgtcaccccattccacagctcagtaacgtgaggcccagggtcacacggccaattagtggctcaatcaagactccagaccttggggacagcggccctgcctgtgactggcacattgggctgcgtggctgtgctctgttgtcccaggctctgttgcctatgagggtgtggggagtgcgacgccagcccctgttctcctgtctgggaagcctcctggttcccacgccttccctgctggcaaggccaggaaatgctcttgccgctgcccccccttgccaggcttggccttgtactcacagtgacccccgctctcccccagattcttctgctgatcgacattgagcagtcctacatcaacacgaaccatgaggacttcatcgggtttgccaagtaggtacttttagagactggctggtcgggcggcaccaatcctcactctcagatccaaggaggtgactgagttgggattctctgagagggcaggtgtcagacagtctctgtcgggggtcctggggtgaaggcagagccaactgagaatatctggaagctctcctgggctgatagtggtccactgtccccaaccaacacgccttctgtgaggcatccccatggttagtttagggagagggcagtgctatgttcagatctgcagggagagggggaagccagccagctgctgcaccccctctccttcaggacttctcagagcctttagcgaccagtgtgcagcttttcccagactctgccacttcatggacagcatctcatgggctcagggctccggaagctgctctttgggaaatgctgcctggggtctccctagcttcaaggcatacactgtagatttaaaccagaaccttccgtggcacccagatgagggcccacatcggggagccctgatttcagcaggatgtcgattcagtgtgcgtggtctcaggcatcacccgctgattccttcagccccttggcatgcttaggcctcactcagattgttggagaggctcacgcaggccttcctgcctgaggcaggccgggtggtgccgctggtatgccctctcgctgggccctgtgatagagcagtgggcaaacccacacccagctccccaccctcagaggaagaccacatgcagggaaccgatggggacccagggcgttaaggtgtagtgtgcttagtgctgggcggggccgtgcagggcttgtgggtgtccagagggcggccactgggccttgccttgaggggtcaggcaggcttcctaggggagggcctctagagccaaatctcaggctatggagtcaccagatacaacatttatcggtgcacctgacaaagctgattgaggatctgttccgtgctgggcaccaggtaggtgaggagaagggaggaaggaaaacgaaggaatgagggcctcatcagaacccctcctagagatgagccgaagtccctgactgggcctcccctgcctgtgggtggcagcccccggccctgtgctcccggccgccgggtgtgtgtgggctcacagcgctggtccccatctttggtttgctgctgttttcctcaccttgatgtctctgcttctcacacttcatccacagttccttctcacaatctctcctgtttttcctttgaccactctttcctctggattcctgggccttcccacttaccccagctgttactatactgagcagctggtgacctggtgggtattgcctgctgtgtgcctttgccctggtgtgtgaacggggtacgccctggctgggtggccccagccctgggtgggacatccctggggcccgctgaagagctacggggtgctctctcagagccagggccagtgctgggcctctgggccaggaccttgaccgcaccagctgtagcccctgctgtttcagagcctgcaggctggggaggtggagtccttaaacaaattgtcacaaggatgatgagagtaggaagagagggtaggggatagactatgggaaaggggagctgggaatgtggcctggagagatcttcctgaagaagtcaggtgatgccagggggacccagagaattggacccagggaaggaaggctaccagaccaggcaggtagaggtaagagagccagcggccaggccccatcgccaggagggccctgcaggtccaggggaggattttggattttcccccaagacaccaggatgcttctgattagatccaggcccaggagaggggccaccttgtgggctgctatttgagggagccctggcaaggatgggagccaggaggcccttaggaaatagcacctctggaacctcactgtcacccagccatcactgtggaggttggctcagctcagtgccacctccttcagatgctgttgatgaaaatccttcttgtgcttgaatgttctgggcttcccattgccctccaaatgtatattataaacagggcccaagcctggcgcagtggctcatgcctgtaatcccaatactttgcaggaggccaaggtgggtcgattgctggagcccaggagtttgagaccagcctgggaaacatggtgaaaccctgtctctacaaaaaatacaaaaattaactgggcatggtggtggtgcgtaatctcagctacttaggaggctgaggtgggagaatgacctgagcccaggaagtcaaggctgtgctgagccatgatcacaccagggctctccagcctgggtgacagagtgagactctgtctcaaaaataaataagtaaataaatagcccagataagaagccctataataaacttactgaatgttgggaatatcactggataaaattctgcctttgttcttagttttccagcctttcctgatctagaaacagaagcctactttctcccttatcctacagccaacttggactttaaaacaaaacccccgaggtagtcagcaaaggaaggtgaccaagctgacttgcttttccatattgttctgaaagtttcagccaaagcaataagaaaagacaagaaaatatgatggataagtaacaggagatatatgttgtttgcaagtggtgatatgattgtcagagtagaaaatatattagaaccgtaaggtggtggagtaggtgtccacatataaaatatagtgggatttgtctatgccggcatgaactagccaggaagtaggatggataaagaagaaaagagatctgggattgtggatgaataaggaaccttatagaaacacaccctgtcgaccttggatgtcctctaaatttgggtcaggagtcatgcaagatatgtgtcatttcatgaccagcagctgtcccacagtctgatgtctaagactggatggctctgtggttagagccacttacaggctggtgttgggatcaaatgatgagaagagtaggaagaagggccaggtgcagtggctcatgcctgtaatgccagcactttgggaggtggagccaggcagatcccttgagtctaggaatttaagaccagcctgggcaacacagtgaaacctcgtctctacaaaaaatcaaaaattagctgagcatggtggtatgcacctgtggttccagctactcgggagactgaggcaggggaactacttgagcccgggagggtcaaggctgcagtgagctgtgattgcgccactgcactcatcttaggcaacaccttctcacacttccccttagaaactccgggattctagtgacatctggaagtaacctgcgctttagtaagtcggctgagatgagggcctagaagcctcaattgaaccagatacatttacttgttccgtgtgcccaggccgtttcccttgcgcagctctgtgtgtgcagggggcttctctctgcctctacctgtggctgctcacttggtccccagggagagaacggccacattcgcctcttccccttcttcccccccggcatcttgtccacgtgaaccctgtctgttctttggtttcagtgcccagcagaggagcacgcagctgaacaagaagagagccatccccaatcaggtagcacacccctctgcagtctcccgctctaccctgggggcgggaggacgctaagtgacagctaagcccccgtgatggagctcggcctgtgtaaagccccaccccacagcctcagtaccaggccatctgctctctctagaggccacttaggaattgataattctgggagatggcctgagagccaacactctggcagggcctagtgggcacattttacccacccagaaggccctatgtgccatccaaggccagggttagaacttgactcttggctgggcacagtagctcacacctgtaatcccagcattttgggaggccgaggtgggaggatcacttgaggctaagagtttgagaccagcctgggcaacatagaaagactctgtctctacaaataataatatttaaaaattacctgggagtggtgggctcatgcctatcaccccagctacttaggaggccaaggtgggagggtcacttgagcccagcagttcatgaccatccggggcaatacaatgagacctcatcttaaaaattaataataggctgggcacgatagctcacacctgtaattctagcatgttaggaggctgaggcgggcggattgcctgagctcaggagtttgagaccagcctggctaacatggcaaaaaccccatctctactaaaaatacaaaaaattaaccaggcgtggtggcacgcgcctgtaatcccagctactcaggaggctgaggcaggaggattgcttgaaccttggaggcggaggttgcagtgagccaagattgcgccaccgcactccagtgtgggtgacagggccagactctgtctccaaaaataataataataaagatataaataagaatttttcccttgagcgggggtctgtgacctctttgagctttccaacacagccccagggattgggagcccctaggtgagagccgctggaaactacattgtcactagcagctcaggggagcttgggatagttgaagccccacacctggagaagccctgagccacaaagggttgtaccttgacatcttaacccagctagaggccttgtgaaatatgaacggctgtatcaatgcctgccttcagtaccttattattattattattattttgacacagagtctcgcattgtcacctgggctgcagtgcagtggcgcaatcttggctcactgcaacctctgcctcccaggttcaagcgattctcctggttcagcctcctcagtagctgggattacaggtgctcaccacaacaccaggctaatttttttttatttttttcttgagatggagccttgctctgtgtcccagctggagtgcagtggcacgatttcagctcactgcaacctccacctcccgggttcaagcaattctctgcctcagcctcctgagtagctgggattacaggcgcccgccagcacgcccagctaatttttttgtatttttagtagagagggggtttcaccatcttggccaggctggtctcaaactcctgacctggtgatccacccgcctcggcctcccaaagtgctggaattacaagcgtgagccatcacgtccagcctttttttttttttttttttttttttttgagacagagtctcactctgccaccaaggctggagtgcagtggcgcggtctcagctcaccacaacctccgcctcctagcttcgtgtgattctcctgcctcagccttctgagtagcgacgattacaggagcctgccaccacccctgactaatttctgtatttttagtagagacagggtttcaccatgttggccaggctggtctcgaactcctgaccccaggtgatccacccgcctcgcccggacaaagtgctgggattatcatgccagcctttatcattaatttttaagaaaacctggacgggcacggtggctcacacctgtagtcctagcactttgggaggccgaggcgggcggatcacctgaggtcaagagttagagaacagcctggccaacatggtgaaaccccgtctctactaaaatacaaaaaattagcctggcatgatggtgggtgcctataattccacctactcgggaggttgagacaggagaatcacttgaacccaggagatggtggttgtggtgagccaggatcacaccactgcactctggcctgggcggctgagcgagactccatatcaggaaaaaaaaaaagaaagaaagaaaaggaaaccataatcttcgcaaaatttctgcctatgtccctcccttctccccattgggcaggggtgggggcggggactccaccatgtaccttgcacgatcatagagcctactggaaggaagaacgtaaccattgcatgatttatttttgcgcttgccgtaggtaatacatatgttgttgcttttttgtttcttgagataataatgaattaaatattaacaccatgaatatgattaatagcatgtaattttttttcttttgctgttttttcccctgctcttctcttctcctgtttttgtgcttttcctgctttttctttgtccccttcacgtcccttccatctcttttcctttgcctgctcttccctgatttacccacaaccctaactttgcatattcaaagggggagatcctggtaagtacatgcttagtgtggtagcaaacattagagaatctagtggtgatggagaccccgcccacccctaatattccctgttccccatcccctccaaataacaaaaatactaaaaatcgagctaacctggaaaccccatgccgcagccggcgctggactgcacgttgccctgggtataagtcgactcacacaggcactaactggaccgccacccttgaaggcgcacttctgcagccagttcctggcaggttttcctggtttcctgtaggtcagggatggcaaatacttacacaccgcccctgcctcccctcacatccctggctgtggaagatctcgcttaagccagaccagaattcattcttggcactgcccctcctccttctatctcctatgcagatgtcactcatggatcagagcatatttttccacatggcagaaatcttgccctcttgtgcccatggcagacatggctagttgatctagcactctttgccttgtgccgctcctctagcacacgcccatggcagacattgctaagcaatcctagcattctttccaaataagcttgccagcactcctgttctatagcagatgtggctaagtgattaaggtattgtttttctccctatatgataccctcttctctatgcatggcaggcatgactagtcaatcaggagcctctttcctagatgctgcctcttgtcctccagataaattgatgaggctcttctgttccacttaccctttctcctatccttggcctgtgacaggcaacactaattgatcctagcaccgtttcctgccacgcccagaattctcaccacagtgcttcaggtatcttgtaccagtcgattgacatggctcccgagatgaatcatatttgctgtccatccctgctgtgggtaacacctccttcctttgtgcagaaccctcagctggggcccagtgtggggcgtgagatgggcgtgaggcccagtccagcccagcccagcgggaagcagcctgctactcatagctgagaactgaacccagctcaaggagctcacctctaggcagccggcctcagcccggctcttacacttggacagcacagcctgggcctccagtcctagcaggggctcccttttgctggacattctcccactgccagccaccaaggcgctggtcatccctgccactgccctctggcggggctcttctggcaatcccagggtctttcttgtagctgagccgatcctatgccagggcctcgctgctcccagggcctgggtgtgcagatagggccatgggtggggcagtgacgggaggaattagttggcctcgggcttgtggttttcaggttcctcatgtgttccccccagtccctttgaatttgccaggccaagaccaggaacctgcttctcccttgtaccccaagaggtttaggggttcctcttttcctaccagaggccacatagcccagccccgtcatgagcgtggccgtggcctctgggtctcccatctgtggttcccatctctacccgggagactcaggccaggaccctcacccaggaaagagactggagcagcctgccagaggatccctgctttgccgccccctgcctgccctgccacccataccgccccatgtgcctgcctgcctgtcactgtgcaccctagcccgcaacggcctgccgcctcttctgtctctcccacccctacttccttctaagcccagtcccattgggatgtgtcccttggatgcaaacctgactttctgctgaggcctggctgctccctttctctggctcacaagtggtggatggctaacgggcctttgtttgccacccacagcttgcagctccctagggtgggattttgtctctgaacccgtgtggagaagggcacctcagggcttctgccagacgtcctgccccaaggcttggtgtgccatccccagcatggccccgatcagtgccctggccctgtggccatgcaccccaaagtgtagcgtgggccctgtgctccagctctgaccaacactaaccccggctggaggcaggagagccaggccaccgaggggtgtgcgggcacatccctctccttagaaaccgggccaggcctaggagtatggaggcctcacatttctctgggggagcaccgacagcctgtctccctgttttccctcacctggttgtcattcagtcatggaaccagggtctactaagcactcgttctgtgcccagctctgggctgagacaaggcagtgcccccaccccgctccccccgggtgaatggaggcattcccagactgccagacctttggtgctaacaccaggacgtcctggacagaccaggaagagctcgtcactgcgttcccagaggggatgctgtgacctcacaggggctgctggcctcagccccctcacccaccaccaggcagcccgtgaatggccagatgccaggggtcactgcctgctccaaacaactgtgagagtcctgtctgctcatcccagggagggataagtctgtacccttggccttaacaaggggcgcccggtggcatctcatgctgtccccagcctgggcagtgacttctgcatggtccaggggtccctgggtactctttagccacctccgtcttcatggccacctggggcttagcactcacatccagccaccaaggagccgctggagctgtgggctggtggccctggttcagaatgtcaggcccggggtgggtcggggtagtccggatgaagcccctccagaggaccgcccccgactaggacagcatctgggccccagagggattcctggaggccccatctctggcgctcctgccgtgccgtgccctgccatgccctgcactgggggatgcaggccagcccttcgcagctgtccatggccatgctcagcccaccctttgtagcttggccaagtctgtcagtgcctgggtcccaggccgccctgtgcgtgcctccgtgtgcttcctgcagctcccagggccctcgtcctgagtggggtggggggctctgcccacacatgcctccagcggccagggagcatgggagcacagcccccaggctgcctgccgttagttgtcaggtgagtccctgcgcaggcctgggttctgacccccacgcagatgacagctacagccacacaatccccatccatggggtctcccagcctgaaaccctgatgtgtcagtcaaaaggatgaccaccaggcttgcagccagcttgggacatgagccgcgctccttcaatgtccttggggagggcccctgggctcacacctttgaccctagccctctgtgtggatgctacccttggaaccttatctcacgcaaacaagtgcagttcctcagatgtcacatttcatgtgccacagccccacacacaagccccagggactcctcccatgggcccctttccatcaggcctctgtgagtctataccccatcagcccctggcccagtgagtctgtctgtccgcccacctgcccaggtggcgcctcatgttggtttcctgctggaaatgcttgggacagggtggaactgggtttcctgggctttggggctggaggtgtctctattgcggtccctggcttcccactgagctgtgggcaaggctgctgcgctgggggatggctggggcacggagcgaggttccctgctaagctgcgcgctttcccccaggtgatccgcaggggctggctgaccatcaacaacatcagcctgatgaaaggcggctccaaggagtactggtttgtgctgactgccgagtcactgtcctggtacaaggatgaggaggtgagtggcaggcgggagcagggctgctggggtaggtggggcagccagggaagagcgggtgggcgctccctctgggcagaactcagtcactgcgccactctgccctgagtcaccattaggactgtaactcgccgggcacggtggctcccgcctgtaatcccagcactttgggagggcgaggcaggtagatcacgaggtcgggagtttgagaccagcctggccaacatgatgaaaccccgtctctactaaaattgcaaaaattagccaggagtggtggcacgcgcctgtaatcccagctactcaggaggctgaggcaggagaatcgtttgaacccgggaggcggaggttgcagtgagccgagattgcgccactgcactccagcctgggcgagagagcgagactccatctcaaaataaacaaacaaacaaacaaaaaacaaccgtaacccagggctggagagcagccaccatgtgccaaaaggcttacattgtacctggcccccatgggaccagctcctagagtgcaaaagggagatggagggtgatggagtcactagcaggctagaaacaggccctgacctccagtgccactgtgactgccccgtgctcaagagaaggggccatgcccaagggtcaggggctcaggcatgcagccagcctccaggggcaccggggttccatcacttacacctcagtcaggccccttgcctctctgggcctcagtttttctatctgcgaagtggtctaggatggtccctgcccactgtgcggtgcttggccacagtgtgcagaacgatccccacatgctcgtcattatgggaaggaagtggagaggcccctgggtgatgactgcagggagcagtgttgagtgctgagtcatgggagggactcgttcactgcgagtgagggggcaggccttgagcaaggatactgccaaccggcctctgctctccatgctgacccagcatccctcctgatggtcctatgtagaaaaagatacataatgtttgacatatttatggggtccctgtgatgttttattagatgtacagagtatgtaatgatcacggcagagtgtttgtggtgtctgtcactttggtattcctcattttcctgtgttcagaacagttcaggtcctctcttctgactactttgaaatacacaaggctgggcacggtgcctcaggcctataatcccagcactttgggaggctgaggtgggaggatggcctgagttcaggggttcaagaccagtttgagcaacatagcattaccctgtgtctattaaaacccaaaaaaaattagctgggcatggtggtgcatacctgtagtcccagctactcaggaggctgaggtgggagggtcacttgagcccaggagatggaggctgtggtgagctatgatcacaccactgcactccagcctgggccacagagcaagacactgtctcaaaaaaaaaaaaaaagaagaagaagaagaaatagacaatacgttgttgcattgttggctgggcacagtggctcatgcctgtaatcttagcactctgggaggctgaggtgggtggatcacctggggtcaggtattcaagaccagcctggccaaacggtgaagccccttctctactaaaaatgcaaaaattagccaggtgtggtggcgcacgcttgtaatcctagttacttggggggctgaggcaggagaatcaccggaacctgggaggtggaggtggagtttgcagggagccgagatggtgccactgaactccagcctgggcgacagagtgagagactccctctcaaaaataaaaacaggctgggcgcagtggctcacgccattaatcccagcactttgggaggccaaggcagacagatcacttgaggtcgggagttcgagaccagcctgaccaacatggagaaaccccgtctctactaaaaatacaaaattaatctggcgtggtggcgcatacctgtaatcccagctactcaggaggctgaggtgggagaatcgcttgaacctgggaagcagaggttgcggtgagccaaaattgcgccattgcactccagcctgggcaacaagagtgaaagtgtgtctcaaagaaaaaaaaacaccagacaattgttgttaactatagtcttaactgcagtcaccctactcttctgttgaacaatagaagttaatgccttttctctaactgtatgtttgtacccattaaccccacctctctttaccccctacttgtccccacctttcccagcctctagtatttatccttctactctccacctctgtgagatccgctcttctaccttttatttttttagctcccacgtatgagtgacaacatgcaagatctgtctttttgtgcctggcttatttcacttaacataatgacctccagttccattcatgttgctgcaaatgacaggatctcattcttttctatggccctgatcaacccgtttcttgcttaattctcttgacgtaaccatggcttagtggcctggaagggaagccacttctgtgtgatagcttgttgctactctgatgcggtccaggttggctttcaagagtccctggcaaagagagctgtgtttttctcattgtcctggttgctctgggagaagactgcaggctgtcctgtgagccatggctgtgttatgtgggcaatggatttgcgtctgtaacagaggcccaaaatgaaggctcttaaagagatgaagtctgtttcttgctcacgtctcagtgagcttggtgaccctgtgctgcaaggctgtccagggcctggctccgcgtctcctgttgccaccttaacacagggctcccttcatagtttaaaatggctgccccatacccatcaccatgtagcctctagcagcccaagaagggaaagaagggcctctgtgtgtgggaactgtgagtccagctaacagttctagcactttctaagaaggaagtggatattggttgtttctgagcgtgacagctggggcttgacacccggaagtcaccaggatattggttgggtggtgtcaacccttcgtgtctcgtctccccacctataaagtcaggactctggcctgtcccctctggactgcgggaaccagtgggggaattctggtacttgagcccaggactgtgcctggctcactgcatgtgtcccaggttttgtcctggtaactaccagcatcaagtcctcccagctcctctctgtaggagggaacctacccacctacccccagtgcacagaggaggagctggaggctgtgtcaggtgcagggccagctggccagtccccatggtccctgggatggcacagccaccaactcagtccaggcaacctcagtggagaggctggggttgcctgaggcccctggagccgccctgcctggctctcttccccttgggtttgggggaatgctctgtaggagtgccccccactggggacttgctggcacccaacccagccccaggataggcaggactgggcttggaagtcccagacttagagagaaggcaggctggggggccccggctggccccagggagaagcaaagagaggcgggcctcttggctatggacccctgctctgtgctgggctcattggctaagagagcccactgaggccacacctgaggagaaccctactccccgtgaggaaaccctcacgcttgctattcgggtggctctgtggtcacccccatctaaggctctgagcggtgacttgccccacatcatggagcgggggagggtccccctggggtggaggcttccccagtgcacgtctgcgggcccatgctccctgacctgagggacaccccagcccgacatccgaacacctccgctgcagcccaggcctgatgtccccttgactgaggacattgggggtgaaaggatcatcccgctccacatgaggccagacgctcatctctggaatgttcctgaaacctcaggagccctgaggcttctgcgggactctggggcgctgtttctaaacccagggtggtggagtctgctgagccaccatacaagcatttctggggtccctgtggaagcttccagaacctcagatccagcgaacctcatggggttgggatgtgggaggagtgtggagccaggcgtggtctgcagccttctccccgcctcaggcacctctaggaactcacgtgtccagatcggatggctcctcaaaatggctggggtggggtagggtgccctttctctttttctcccctctttccgccttgcagtgagaaaccagcctgcgctgtggtgtgtgggctgtcaggccggctgagagctggtgccctgcctttcagttcagggctgtggggaccttccagggtcccctgggtgggaatgccaggcctggggcagcgagccttggaggagcctctgggcctgaacctcagcctggcagctctctgcctggcagcattgcaagtctagttttcagatctcctcttccttcacgtgaggggcccttcgtgtttttctcatctgagagttgaaagccagagcccccgaccctcccgtggagccccacactggagtctggagcagcagtgggagaagggccgggcgccggccgtaatgagaaacagccgacctgtgaaaggggccctgtgtgagccccagacacaaagcaggctccattcaggagggggcagccatggaacctgacccccgccaccacccaagttaggatcccagcagggacccttggagtcacacacgtggcagccacccctgaggaggaggccaccctcttagatgcctcagtgagacacaagacatcaatatctctttatttaaaaaataaacaagacatttacagccatggggtggggatggcagactgatagggccagggcctccaacccctcggccggcctcggggctccctctgcctttccccagtgcctcttctcccacccaggccctcgaatcttctatgcgaggctctgccacagtgggaaacggggtggtggaaaatgacactcacctgccggcgagtttggggggcctgtctcgacgagccgctcacccaagcccagcctaaccaatgtgcagactactgtacacattgagagcctcctgaacaggtagtctgaacactgggttggcggggccggctatccatcctgcagaaccccccaggcagacgctggggccaccaggccaggccgtgcctcagcacctctgagcagccaaggaaaccaccactcttcccgagacgatccgctctgtcccttctgacgtggcaaggctggggccggctcgcatctggagaaagttctgggttttcaggaaatcctaaagagtgggggaggcggagcaggaggcagggtttgggatcgtggcttctgggctcaggaggaatgtctgactctttgggggtcgggggtggggaggaggggcgcacacacacgtgtgtgtgtgtgtgtgcgcgcgcgcgcacgcgtgcgtgccggcagcaccaggaaggcggccactgatttctcggcggaatcgcactgtaaacagttccagatgtggcattagctggaatggcctgtgactcagttacttggccctgctggctggaagcttccggccgcgtgatatgatagggtcagggcagcaaaggcccttgggcaaacgtccgagccgggggcagggcttctgcagagccccctcccctagccccttctaaagcccccaaaactcttccccgaaaggtgggagggacccaggccctgtgttacccagccttgcctgggatgacgggtgcaggctttcttcatcaccttccctcccttgggtccgcagcggcatccctccctccatggccaccgggcccctctcctatgctctgctccctccatggccaccgggcccctctcctatgctctgctccctccatggccaccgggcccctcttcctatgctctgccctacttctttgcctagagcctggcaggctaatcctggagccgctcacaagagcaaccaaagaaaatcccgggtgctcatgggcaccagctctgcagtgggcaccaagctcctccatcctccttggatagatgaggaaactgagatgaaatgggaggtggcggggaagtggcttgcccgagggcacacggccaggaaagggcagggctggcatcacctcaaccatgctgagctcctaacgccctgaggctgagcccatgtgccaagcccactgcttcatcctggctccccttgcaaagtcctgacagtcccagctggcccccacttgccagggagcccccgctgccttctccacagtcactgtggctgctcctgaacttggaggcggcagccaggttaggctttgtgctggggcagcgcagtgaggggacatgagaggagtttccagagacggcccagggagaagaagggccaggggcactgtggggaggactgggctttgggtcacagagacctggcctctgaagtcctgctgtggcttgcgctgcctgccgtgtggccttcggcagccagcttccctctctgagctaggagggatccgtgaactgagaccaagcagtgcatggcatgggtccccaagagctgctgctgtggcgggtgggcacacacatcactgggtgagtgtgggactccagggtgccacccccagctccgtgactcgccagccccttgcccctggccgaggggcccacctctgagctgcctccctagcagtctggacagccgtggctggcacttggtgcttcctgaacagggccaaccttagaaagcaagtgatagggcaggtgcggtggtgcacacctgtaatcccagcactctgggaggctcgcttgaacccaggagtttaagaccagcctgggcaacatagcgagaccccatctctattaaaataatgataatgataataataaagaaagggagtaaggcttctgcagcacctggcccaggacctatccagccccaagatgtcctaaagcggccaaggttgaaatcccagccctgctcctctctgcctcagtcttcccctctgtaaaatggcatcacagaggtaactcactcctaggctcgtttcaaagatggagcccagataaaagttccattcacttcgtgcaaggcgaggggcagttgtgttgtgcgtgccgtcagccacatgtcagcagtgaactcaacaggagtccctgccctggagaaacttgagtcagtccagtggcagtcagccacctaggtcaataagcacaggcagtcaggcacctaggtcaacaagcgcaggatacgtgacgtgttgtgtgagggaaaaggaggatggaggtggggagggtgcgggtagagttagggcaggagggagccatgcaagtgtcaggatcaggcagtagcccggtcgtccgaaggccctggggtaggaacccaggtgggatactcagggagcatcatggagggcagcgtggctgggacagagtgacggacggggaagggccggcagatgggctcatatacagcagcgaccagcattgagaagcccccggggctggtggtggcgcatgctacacgctctggcctggggcatcctgagttgtcacgtggaccgctcagggtgactcttttccctccaccctcaggagaaagagaagaagtacatgctgcctctggacaacctcaagatccgtgatgtggagaagggcttcatgtccaacaagcacgtcttcgccatcttcaacacggagcagaggtgaggggcccaggggcctggggatggctcggggtgaagaccaatggcctcattcacactccacaaccttcactgagcactgagcacctggctgtcagcagtccctgcccttgggacccagcttttagaaaggggagtcacgtgagaaatagcaaatgccagggatgcttcccgtgctgggtcagagatgacctctctgggcagagatgaggatgaaggcaggctccgagtcagtgggagccatggagagttctgagcacagggtgaccaggacctggctcaggtgcttgcaggagccctctggtggctgagagggaaacagtatgagagggtgagagatgggggacgagggcaaaggccgctgccttgtccaagtgggcgatgatggggccagaacccatagggaaggagggtgcagattctgggtagaagagtcaggcggagccctggtgggcatggatatgagagagaaaggcaccaattgtgaccctgagtacgtgggcctgagctcctgcactgcccagctgctgccattggccgaggtggggaaggcagcggcaggtaggcctggagacagccaagagctccatttaggccatgccaagggagagggtgcatcagggaggcacctgggtagatcgaggagtgtgatgtccaggaacgagctccagtctgggatgtgaactgggcagtcaccattgcgtggatggtatttcaaggaacgaaaccagatgagctcccaggagagtgaagctggagaatgggaggccccaggaagctcacagtacatctgtcccatgaggcgtagctggagactttagcagagacactgctctcaggaagaaacccagctggcaggagggctcttcccatgctcacacaatcacgctcatccaggaagcagggcccacctgagtcagggattagctgtcagtaaaggcccggtggtaccctgagacctgtaggcaggcactgacgtcctccctgctggccccagaacctccttgcctactgcttggctacacccaccaactccagctgagtctcctggttccctcctgctttgctctggctggcctaaagctcgagacccatttgtccaccagctggccgtgaaaaccttcatagctcttctaggcttgcccctggccatatgacacctggcagctgtcccaggtccctgagccgtgtgcctcctgtacagggagggtgacaatattatctgatatatcttttaagagcaggttcaggaaacccagagtagtagctgcaaaaacaagataagatggttgatagttttttgtgtaaattaagtccagactttagtatcccgggcaaagtggagcagctccacaggcatcagggtccaggccctgcatgttcctcaggattccacctgatatgcagaagccgagctctgcggtgggacaggcctgccatgaaatcctgactttttttttaaacggagttccgctgttgttgcccaggctagagtgcaatggtgcgatctcagctcaccgcaacctctgcctcctgggttcaagcgattctcctgcctcagcctcccaagtagctggaattacaggcatgcaccaccacgcctggctaattttttatttttagtagagacggggtttctccatattggtcaggctgggctcgaactcccaacctcaggtgatccacccacctcggcctcccaaagtgctgggattacaggtgtgagctactgcacctggcccaaaaccccgacttctacttctttgtccaaaatggctgcccagactccagccattgtgatgatgtcccaggcagcagcaggaaggagaggaggagctacaagggcatgcctctccccacacaacctcatccagaggtcgttcggggcagccacttgctgaccacaaacccaactctcacttaaaggctttgtgggcagcttggctgtcttaaccacacctggatgtgggacaggaaaatgtgcgtggcatgtggcacggggcctggcctgtagaccaccatctgcaagcactgtttagcatccattccatttatctcccagctttgagaccctggttcttttttctttttctttttcttttttttttttttttgagatggagtcttcctctgtcacccacccaggctggagtgcagtggcatgatctcagctcattgtagcctccacctcccatgctcaagtgatcctcccgcctcggcctcccgagtagctgggactacaggcgcacaccaccatgcccagctaatttttgtattttctgtagagatgggggtgttgctgtgttgctcaggctggtctccaactcctgagctcaagcaatccccctgtctcagcctcccaaagtgcaggaattacaggtatgagccaccatgcctaaactttacaaaaatttttttgttttgttttgatacatagtctcactctgtcgcccaggctggagacagtggcacaatcttggctcactgcaacttccacctcccaggtttaagcgattctcctgcctcagcctcccgagtagctgggattacaggcatgcagtaccactcccagctaattttttgtattttagtattgacggggtttcaccatgttggccaggctggtctcaaactcctgacctcagttgatcctcctgcctcagcttcccaaagtgttgggattacaggcgtgagccactgtgcccagccaaaactttttttataaaaaacacacaggccgggcacgggggctcacgcctgtaatcccagcactttgggaggccgaggcaggtaggtcacgaggtcagaagatcgagatcatcctggcgaacacggtgaaaccccgtctctactaaaaatgcaaaaaattagctggggtggtggcaggtgcctgtagtcccagctactcgggaggctgaggcaggagaatggtgtgaacccgggaggcggagcttgcagtgagccaagatcgcgccactgcactccagcctgggcgacagagcaagactctgtctcaaaaacaaaacaaaacacattcgggcacagtggctcacacctgtaatctcagaactttgggaagccgaggtgggcggatcagctgaggtcaggagttcgagaccagcctgaccaacatggagaaaccccatctctactaaaaatactaaaattagccaggtgtggtggcgcatgcctgtaatcccagctactcgggaggctgaggcaggagaatcgcttgaacccgaaaggtggaggttgcggtgagccgagattgcgccattgcactccagcctggacaacaaaagcgaaactccgtctcaaaaaaaaaaaataaataataataataataataaagttctggtggacagtgctgctctgggctttcctgaaaatgccccagtgggagcttcccagccacagttggtgtcgagggtcacatgcccacctctgggggcccaggaaaagagaagagtcagctgatccaacagaaacaaagaaactcagacacttgccgagcttgtgcacagcgctcttctgtgtaggcgtcactcacggtgacccctcagcatgaccaggtgaagcctgggttgggtttgggttcctgatcagtcagaaagacccctagagcccattcctctcggcagtctgccagacccatggcagggtcaagcttgtgcccctccttccccacccccccgcagaaacgtctacaaggacctgcggcagatcgagctggcctgtgactcccaggaagacgtggacagctggaaggcctcgttcctccgagctggcgtctaccccgagaaggaccaggtgaggagccgtcctgcgcagccaggcccagagcccccacctgggagaggaagcagggctggctttccccaggacaggtcattttcaggccatgttagccaggagtctctgaaatcatgtagcagatgcccacttgagcaagcaaaggagaaattgggggtactttgtcatcagggcccagaaagttccctcacggaagccagtgaccggggcacacaggggatggggtcccacttgctttgttctcttctcttttccccttccatcctgaggtagagtgaacatggccacccttggccccaatattaaaatgccttgccgggcacggtgggtggttcgcccctgtaatcccagcactttgggaggctgaggtgggcagatcatttgagctcaggggttcgaaaccagcctggccaacatggtgaaaccccgtctctactaaaactacaaaaattagccaggcatggtggtacgtgcctgtaatcccagttactcaggaggcttaggcaggagatcgcttaaacccgggaggtagaggttgcagtgagctgagatcacgccattgcactccagcctgggcgacagagcaagactccatctcaaaaataaaataaaatgtcccaaggttgggtgtggtggcttacacctgcaatcccaacactttgggaggcaatgtgggcagatcctttgggcccaggagttcgaaaacagcctgggcaatgttgcaaaacccttctctccaaaaaatacaaacatacccaggcatggtggcgcacccctgtaatcccatctactccagggcgctgaggtgggaggatcacttgagctctccctgggaggttgaggctgcggtgaactgtgtttgtgccactgcactgcagcctgggtgacatagcaagactgtgtcaaaaaaaaacaaaacaaaaaaacaacgttccaatgcccaggtgaggggatccaccccagcatcagccagggtcaccccattgtttgggcagctctggcccagggcaagcaggcctatctggtgccagtggggctgtcaggggccagcctgaggtcagttattggtgggacaatagggcagatggtttccagagaaccaggacttggcccaggccacagtcacccctcagcacctcccctcccgcttgcaggcagaaaacgaggatggggcccaggagaacaccttctccatggacccccaactggagcggcaggtggagaccattcgcaacctggtggactcatacgtggccatcatcaacaagtccatccgcgacctcatgccaaagaccatcatgcacctcatgatcaacaatgtgagtggagaactaaaaatgagaaggaggtagctgggtgcggtggctcacgcctgtaatcccagcactttgggaggccaaggcgggcggatcacttgaggtcaggagttcaagaccagcctggccaaaacggtgaaaccccatctctactaaaaatacaaaaattaggctgggcgcggtggctcacacctgtaatcccagcactttgcgaggccaaggcgggcggatcacgagctaaggagttcgagactagactgaccagcatggtgaaaccccatctctactaaatatacaaaaattagccgggcacggtagctcacgcctgtaatcccagctactcaggaggctgaggcaggggaatcgcttgaacccaagaggcagaggttgtggtaagcctagagtgcaccactgcactccagcctgggcgacagagtgagactccgtctcaagaaaagagagagagagagagagaaaaatacaaaaagtagccgggcatggtggcgggtgcctgtaatccagctacccgggaagctgaggcaggacaattacttgaacctgggagatggagatggcagtgagccaagatcgtgccactgcactccagcctggttgacagagcgagactccatctcaaaaaaaaaaaaaaaaaaaaatgagaaggaggccaggcaccctaggccatacctgtttgtagtcttagcactttgggaggctgaggcaggaggatcacttgagcccaggaggttgaggctgcagtgagctatgatcatgccactgcactccagcctgggcgacagagcaagaccttgtgtccaacaacagcaacaacaaatttgaatgaatcaccaccctttgaacaccagaatctgcacggccatcctctttgggaaaccctagggtttccgagccacactgggtccatagtcccatcaagtccactaactggagtgaacactgcaggtgtgcgccttctctgaattaacttaggctggcatcagaataactgcaggagggagaacggccatcttccccatttcacagacagaaaacaaggccagagagatcaagtaacctgccccaagttccttaggaaagtgggaagtgggattcaaacccacgtttaccctggttgcaaccatacccttgggttgtgttgggcagccgctgtgtcctaatgatctggggcccagcctcttcctcatgggcgtcacccgcctggccccgggttccctggagactctcagggctctgggctcctcttcagtgaaatgcagctgtactgatagtatctccagctcaggctgctagagggctcagggcacttgtgtatcaggcctttggcatggcactagccactcaggaagctttataaaccagctttggggccggagcagtggctcatgcctgtaatcccagcactttgggaggctgaggagggaggatcacttgagcccaggagctgaagaccagcctgggcaacatagccataccccagtctctacaaaaaatttaaaaattagctgggcgtggtggcaaatgcctgtagtcccagctactcagaagaccgaggtaagagcatcacttgagcccaggaggttgaggctgcagtgagccatgattacgccactgctctccagcctgggtgatggagcaggaacctctttcaaaaaaaaagtgtcttgggttttgtatatgaatgtcaaccacagaaacctgcggatctaagtaaaactcccacacagggtgtggctgggcatggtggctcacatctgtactcccagcactttgggaggcttggcaggaggatcactcgatcccaggagttcaagaccagcctggacaacatagtgagaccccatccctatttaaaacacacacacacctcccacgtgccatgccctcccaccctgttgctcccattctcagtagtgatcagtgttcacagtttcatggtgtcctggtatgtttcctcatataccgataggatcggagacatatacggttcttctgctatgaaatttaaaatgcatatatcctttgaccctgcaagtttacttttaggaacttctctaagagagacaattgcccacgtgcaaagtgagcttatacatgcttattgttttccatgatgttttatagcagccaaagatgggacataattatccatttttaatagactcttataaaataaaaatattttattatttaagaaaataataaatctgtcggcccagctactcgggaagctgaggcaggaagatcacttgagcccaggagatcgaggctgcggtgagcaaagatcgctccactgcattccagcctgagtgataggagtgagaccctatctaaaaaaaaaaaaagttgtgacggccaggtgtggtggctcatgcctgtaatcccagcactttgggaggctgaggcgggcacatcacgaggtcaagagactgagaccatcctggccaacatgctgaaacccccctctactaaaaatacaaaaattagctgggcgtggtggcacgcgtctgtagtcccagctactctggaggctgaggcaggagaatcacttgaacctaggaggtggagtttgcaatgagcggagatcatgccactgtactccagcctggtgacagagggagactctgtctcaaaaaaaaagaaaaaaaaaagtaactgaaaaacttctgtatccagtaggaggttccagaaaggacaatgtataaaattcatgaacagaaactagtagtgtttgaacagaagccaggtggaagatgtaacaggattagccgggcgcagtggctcactcacgcctgtaatcccagcactttgggaggccaaggcgggtggatcacctgaggtcaggagttaaagaccagcctggccaatatggtgaaaccccatctctgctaaaaatacaaaaattagccgggggttggggggcacgcctgtagtcccagctacttgggaggttgaggcacaagaattgcttggacccaggagacgcaggttgcagtgagccaagattgcactgcagcctgggtgacagagtgagactctgtcacaaaaaaataaagatataacaggattggctgggcgcggtggctcacgcctgtaatcccagcactttgggaggctgaggcaggcggatcataaggtcaggagatcgagaccatcctggctaacagggtgaaaccctgtctctactaaaaatacaaaaaataagctgggcgtggtggcaggcgcctgtagtcccagctacttgggagactgaggcaggagaatggcataaacccgggaggcggaggttgcagtgagctgagattgcaccactgcactccaacctgggcgacagtgagactgtctcaaaaaaaaaaaagcaaaaacaaaaaagatataacaggattattctgccaaggttaaggaaataaataaataagctaaaacaggagaaaagacatcaatggaagaggcaagatactagaaataagttgaataagaatctcataaccagcctgggccacatggtggaaccctatctctaaaaaaattacaaaacttagccaagcatggtgtcaacgtgcctgtcgtcctagctacttgggaggctgaggcaggataattacttgaacccgggaggcggaggttgcagtgagctgaaattgagccactgtactccagcctgggtgacagagcaagactctttttcaaaaaagtctgggggtggccccgccctgtgagagatgtttttccagcagtcactgtgggttctgggttggggtgatacacaagcctgaccctccccaacccctgcccgcagacgaaggccttcatccaccacgagctgctggcctacctatactcctcggcagaccagagcagcctcatggaggagtcggctgaccaggcacagcggcgggacgacatgctgcgcatgtaccatgccctcaaggaggcgctcaacatcatcggtgacatcagcaccagcactgtgtccacgcctgtacccccgcctgtcgatgacacctggctccagagcgccagcagccacaggtccggaagcctggttcccctaccctcaagcattcggcctgcaggttcctgccctccctgtgtgtcctgcagggtcctggcaggaaacaggacacagcccaagggtggcacccagggctgggcactgtgggagctgctgccctgctgaggccggaggagggagagaaggggtatgggggcgagccagccctacagctctagggcaggaccctgtgaataaataccccgcctgccctctgctggtgccttccattggcacagcccaaatggaagctggggtaagaggctggaggggcagcagccacaggagagagatgagcctcctggagcacagagaagggcagatgggaggctctggaggggcaaacgcaaggcgtggccagagctgctgccgcccctgagttgtccattgaggccgtcgggcagggaacctcagagggggctgccttgcagagccctgggggagccatggagttccttaaggggaggatatcgcacccaggcctgcaggtggcagggactgaggcccaggagggaatctggatgtctggacagggcttgcaggttccacggcccctagagatattagggcttgatctggaggactctggaagtgtctttggctgtgagggtggatcccaggcccaaggcctgagggggccctgtgagtgggaagtgcctgagggggccgagggcaagggaaggtgggactggcgctcaggttggggtgggaggatcccactgcgcctgcgctgtccccatagccagcccccacctcaggttctggcagccacagtggcatggcgggggctcctactccatctgtatctgtagctcacaccctctccttcctcacagccccactccacagcgccgaccggtgtccagcatacacccccctggccggcccccagcagtgaggggccccactccagggccccccctgattcctgttcccgtgggggcagcagcctccttctcggcgcccccaatcccatcccggcctggaccccagagcgtgtttgccaacagtgacctcttcccagccccgcctcagatcccatctcggccagttcggatccccccagggattcccccaggagtgcccaggtaaggccaaccccctgccctccaccccaactgcctgcaccctggggtctctcctcctgtctcacttcctcccagtgagctctcactacgtgcccagctgctggagtggaggaatcgtcctcatccctatttggcttgcgaggaaacaggcccagagaggccaagaggcttgttcagtgtcacagagtagcggagccctggtgactccggggctcccagcttgccctctgcctactggggtgtgccaccaggcagctggggaaccctcacactgggcacctcctcccactgtttaccttcttctccttcctgctcctgcctgcctcaacctaccgtgggccaggctttattctccccacttctccggtggggaagctgaggcccagggagggcagggggctcactgagggtcaaacagcaggcgagttgatgcctaggtttggcactcctgcccgacaccctggtggcttgcggaggtcagcctgggaacaccctggggtggtgtgtgggtgggggctgggtcctcaacccaggcctgcctcttgctcccggcctcactgccgtctccccctccccacctgtctttattctctttgcagcagaagaccccctgctgcgcccagccggcccaccattatccgcccagccgagccatccctgctcgactaggcctcgaggggggcgtgctctcgggggggcctcacgcacccgcggcgcaggagcttcagtggtctggggccctccgccgcccctatgctgggaccaggctcccagtgggcagccctggcctcttccttaacgctggccccggtccagggccggcccctgtgcctggctggacaccgcactgcgcaaaggggccctggagctccaggcagggggcgctggggtgttgcactttgggggatggagtctcagggtggcagaggggggaccagaacccttgacaccatcctgaatgaggggtccagcctgggggggactctaccaaggtcttcttgggctgggaaagcccatgtagggcaggccttctataagtgcgggcaccaagggcgcctacatccccaggccttgctggggtgcaggggtatatcaacttcccattagcaggagctccccagcggcaagcctggcccagtgggctcggtagtgcccagctggcaggcctgaggtgtacatagtccttcccggccatattaaccacacagcctgagcctggcccagcctcggctgccagaggtgcctttgctaggcccggagccgttggcccgggccggccttgccctattcctctcctcctcctcctcctgggtcccccagggtggctgggcttgggctatgtgggtggtggtggcggggggtcttgggggcctctcagctcccgcccatgcctccctgatgggtgggcccagggcggcctctctctgaggagacctcacccactcctcgctcagtttgaccactgtaagtgcctgcactctgtattctattaataaactaaaataaagggaagacgctgctggtggctgctgtgtgggcctcttgtgttagtgttcaggctggggacatgggtgccacctccatcaggcctcccataaggatgcccaagtccctgcactcataagtgcctcccatctccctgagggctctgctttcgggggtgtcacctttcagaggaagccactcgatacaggggagagcttttactttccttagcatgtgaggagtgggagcagatattctctgaccccctgcacacccccacgtgcacaggcctggctgctgcctggtgaagcggggaccccagcgctccacccccttcctaccctcaggccctgcttctctcacctcgtggggaagcccaagcctcgtggcccaactggggctcagttaaactttgctttctgatttttctcttgtgccaggcgaccacctccatcggctcccgcacgacctttcttctgagcttcgtgggaggcccctcccacctgtctggctgccccctcgggggccggtctgtcctggctggtgtccctgagccccaatcagcaggctcttgtgattttctgaccataatttattgactccaatgcccaggccacaccaccctttgttataggaggcttctgcctagactttggccgggccatccctcatgcctgtgtggggcccctgcaggagaggggccggggcaggtggtcttccaggcccccttcctggcattctgttaccagacctcaacctggcttggagggcccaggtttccttgttaggccctgccccgcaccaggcaacgctaacacaggatgggaggcttaggctaaggcacatttacagtagaggggccaggaaatccgaggctcacgttccaacgctgcagtgcccaccatgtgagatttccaggaccgtcggtgcagccactgagccgtcccttctacaagccagaggtgttccctgcccgctgaggacggaaggagactcatggggccagaccgcaggccctgactgcacactcccgttttggcaggaaactaaaattggggagggacccccaagtctcatatgcacacaccctgctgcccctcctttgtcccgttcttccttccatggcaggggctacgtgggcaccgggcgcttgtcctggaagaagcgcttgagcgtgcagacctgcagcacagccaccagcagcagcaccgccacgttgacagctgaccagaagttgacccgctccaagttgccctcttgcaggttgcggtcacgtgcctcgaaggcccgcagtagcgtgagcatctggatgctgcgctccagccgggtccgcatggtctcaatggactcctacagggcagcgggaggggaagggtcaggcctccctccacccatcagggagcagagaccaaaaaaaccgggggatacggagggaggctgtattaaccctgggaggtacagctgcaaacacagacttgttcaggctaagttcaaatcctcaccctgccactcactggctgtgaccatgagcaacttaattaacctatctgagcctgtttcctcttctataagcttccaaattgctgtgaacatttaatgcctaaataaatgtacaaggatgagcatggtggctcatgcctataatcctagcactttggaaggctgaggtgggaggatcgcttgagcccaggagtttgagaccagcctgggctacatggcaaaaccccatctctacaaaaaattagccaggggtggtgatgtgcaactgcaatcccagctactcaggaggctgaagcaagattacacctgtaatccaaacacaggaggatcacttaaacccaggagttcaagaccaccctagccaacatggtgaaacctcgtctctacagaaaacaaaaaattaggcatggtggtgcacacccgtagtcccactgaggtggcaggattgcttgagcccaggagtttgaggctgcaatgggctatgatcacaccactgcactccagcctgagtgacacagcaagaccttgcctcgccgtagc

SEQ ID NO: 12440 - DNA, 37282 bp, Human
accatgaaccaaacaaatttctgtttttgttttgttttgttttttaataaattacccaggctatggtatttctttacagcagcagaaaacagactaagacagagctcttactgaatgatctaatgccagaaaattggaagaaatatgtcttgttttcatttaattttaaggtagattcacgtttaaggaagagtcaataatttgtaataataaattattttttcctataaagtgcctatattttatttttaggaaacctttgtgtgcaaatacaaaatatgggagaaatagtaatgtaacagatttgcaaaccaataatttggggttagcttttacacaagtttttctattacctttgagaaagatagataatgggaaaagagagcacgcagaaagtaggccaaaagaagtaggatcagaacatcaacttcccagaactgtggagagtattctggattcatttgaattgagcagtgcctggaatctcttcatccaaccaatatatgccattttttcagtaacaccaatttaattttgctcttctatatcttcctagttcagtggagaatatcatgttatagaaaaaggtaatgataacttcattagctgaaaaaaatgtgtttctattttctagggttggagaatttgtctttgaattatttaagctgtatgactatctatttatctgtctatctatctatctaaatatatacttagatgatgcttaaacatgcacagaattacacttggctgtacacatatacatctaagtaatttttctatttctatattcccattcttttctcccaaaacgccagatataaaaatattccattaaaatgactgtattttctgattgagaaatcaaattccaatgcagtcacaaaatatgtttattagtgggtataccactagcaataaaatactacaagatatcttttagttttttttctcctgggtcattcattttccaaatcttcctagcttctaattctaatgaagcagttacatttatttctgtctctacatacaaggagaaattgttcccattgtcaaataagctgaagaaaacctttctttcctcccttctcagcagcatgggtgttgggctctaccttaacatttgaaaatatttatccttctgtcctaacttccatcactgccattgagtgcaattggtatcactgagctcactaatttgggacaggaataatgatgctaaagctcttgttagaggaatcattagggtttaaaaaaatctacacttgatggcctgattgtactattaagctaggatatcctatgtgtaatgtacaagtaattagggtgaatagagtgattttagagagacttgctctcaaagattgtagttgtccttgaaaaaatataaaggtaaaaagcagtggcatcttgtacaacaaaaggaaagccacaagaaagattatatgctagctatttctttattctctttcttttatgaagtctttacattctgataagtttcctgtgacatctagagaaccaaccacagtgaatagtcaataacaggaagtagataccatgcctttatgaagttgctgctttaaactggaatgccagttctctagcagaactacagtgttctacaggaccgatgacacttaaatgcttagatgggagataacttctgatgagtgtgattacacacgcttaggtcctctgcatttgccaatggcagttgaggaggcatcacttccttgcatggcgtttgtgcacaatttatgtttgtacccgagggcaagacaggttaataaggccaagaaggaggggaggctgtgggagtgggtaataactggggaggacttcacagcatcaacctgggggaaagggaggagggctgaggatgaagggtgttccctcctccttctgcctatgtgttaagtggcaagagaaattttgaaagctgctgtgaggaggagctactgactgggttttggggtgttttgtaccccaccctcctcacttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggactgcttctgatggctctggcctctgctgccccagggagcatcttctgtaagcagctccttttctctctcctggtgagtaacaaccaaaggattagggaattcaagcatgttactacctgcttcctctctgcagtttgggcttgaaagagactaggagtgaggatgggaggcagagaagagagattggggaaaacaaaagcagatctgaggaagattcagggaagagttgagaggcttgggattcaggatggaaagtgttcagcttacttctcaagcacccactgccagagtgttaaaatttttcaagggaatccctcttccatcctgctgtggtgtttttctaagagtagagaagtgaattcattctttaggcatttggcccagaagtttctgaggtttacttctgctaccagtgattacataaactcatgttatttaacatgctgagttctactaagctgcaaaaaaagagaaaggattctgggtgaacatgcaaattatccaggacattttgaattttacccacgaagcagtttaagcaaagaatagtttaagaaaaataacaaaaatgtgactgtcattgaaaatatcctcaacttggcttccacttgggtttttaatagctttgtaactgtgtaaggtgctattttttctttggaggtgagggaagagaggggggttatttcacacatccgtccatcatttctgaggtgtgagtttcctattttttcattttagcaaaatacttgagtttcaaaatatatttttagaaatggcaggtatgaggacaaacattttctccatgtaaataatatacaatgcagggttgatggtcaccttctcatcctgtaactgcttagggagacgataactcagataccatcttaagttagtacaagtttggtaaaatgtggtaaaaatgtttcaaaggattctacccacatttcttttgcttctgatccctgtactgtctaatatctcttggacaattcatctcctgtttatttatttctgactctgaaactgactaaaagggtgtcactaagccacttagtcagtgatttaacctgaagacgggaatagtatttaatgaatggaaaccttcagtggctctgcctgcagagggaggaccatcaacatggaatcctaggacaagaaggaaagaagatgggggtgggagtggaagtgtggatataactataagaatgtctcatatatttatatatatatatgtacatttatatatatatacacacacgcacatatacagtcatgctctgcaaaacaatgcctcagtcaatgatggactacatatatgagtggtcccatagattataatggagctcgtctgtataggtgaaccattttttatcttttatattgtattttaatgtactttttctatatctaaaaatgtttagttacacaaatacttacaattgcctacagtattcagtagaggaacatgctgtacaggtttgtagcttacaataagctatactatatactatacacctaggctgtaccatggtgcataccatggggcatacatatataaatcatggtgtataccatgtaggtataacccaggtgtgtagtagactatatcctctaagtgtatgtaagtatactctatgatgtctgcacaaggatgaaatcacctaacgttgcatttcttagaatgtaagcaatatatgactgtgtgtatatatatacacacatacacatacatatataggtataggtatatgtacaggtatatgcatatgtatgtgtacatatgtatatgtatgtgtttatgcatagcctaattacaatatgctgtttccacattgtatacttagacaactattaacagtatggtctatgcttagaaagttctttaagtataatttattatgttccttggcattagggatgaacatatttaaaaagttaaataaatacgaatgtctcacgttttaaaaagtggtttttaaattaggactaaataaaaatgtggccttttaattccagatttctgcctaacatagatttttgtaaaattacaaactatttaattagactgctacagtatatctggtagacttgagatgagctggaaaagaagtgcacatccttaatatggatgttaatccattctctttcctcctcgcaagtaatgggtcccgtaactctagaattcagagaaaagctgaaagctgatcataaaattgacctacatgtttctggaaaacctagctctactctatcttatatttaaataataaaaaagcagttattttgataaagaggaacaaacagaaaatgccaagaaaaagaagtaaaatatattttgaacctatagacatttttgaaatgatagcttttcttttgtttttttcagatagtgtctatgtctttgaactacctaggttttaaaaacaatagctgggccttgaatttaattaaaaatcttcacccatctgaaggatactctccatattttgacatatatttctttttagattagtcatgtgatttgagatcatttagattttggcgttttggccaagtcagtcacaaaattgatttgagaacaatgattttttgggggcattatttttctgtgaggttaaaaaagcccttaactattttctagacttcatcaactataacttcaaatagtaaaatgatgattagagaattagggcatatatgtaattatgcatttcaaaggtaagtattttcttcatgctaaaaatcagaatggcatttatgaatggtcttagagacgtataacttctatataaagtcaatggtttgtgaaatattttcttgcattgacacaatatgatttaggttctaagaactactattcacttaatttttttcattgacaaataaatgacagtgctattcctaaagctattctctttgctggttccttttaaagtgagtattaaaaatgtaaagaattaaatgattaatttgtttccaaaattgacaatatttttatcaataagaaaaagctacaatgtgaaaatttgtgatcaaatttaattcctgatattttttctttttttttttttgaggttttaacattactttgcgatgcttgtcagaaagtttatcttcgagttccttctcatcttcaggctgaaacacttgtaggcaaaggtgagaaacactattaacagtttcatagctgtaacttgtcacatttagctgcaggctgctcttgtaaagtttgggataaaaaccacatagtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccaagaggcggagcttgcagtgagccgagattgcgccactgcagtccgcagtccggcctgggcgacagagcaagactctgtctcaaaaaaaaaaaaaaaaaccacatagtagctacttgaagttaaaatcggatgtacaataaaagacaggctacttgttttttggtagtggttagaaataattaaaataccaaagttagttgtatacttctcttgccaaaaaaattagcaaacatcagaaggctcaattatcttggattacgtcaaacaaagcaaggcaccaaaaccaggagcatattctaatttgtataaactaatctgctgccaaaatttcaaagccaagattcttcaattgattagacatgaaatggatgtctcaaaatctaaatgcccccaataaaatttgtacttgaggttgattacaatgaacaagtatccaccaagaataaatgtgacatatttcacagaacagcttgtgaaaatcaaatacagttttggtgggtcttagtaccatagccatctctgaagtataagttggttgttctgagcccaaacgtaaaatttttttcatcaaggtttttcactggctttgcattcacatgtaaaaaattacaaacaatacagaaatggtatcctttccaagccagatgttgttttgcccagtgctttaaggtttgaaattaataaacagtccacactctaaagacacatagtaaatacactaaatgtgttaaatatgaatctgtaaaggaggtaatttgataataaccacagcgcatcgggtttactaaaccttgaaagatattacagaaagattatttgcaatattactgggaaatattacttaagaatagactggttttcttcttatttatttatttagagacaaagtcttgctctgttgcccaggctgaagtgcagtggtgctatctctgctcactgcaaccttcacctcccaggttcaagcaattctcctgactaagcctcctgagtcgctggaattacaggtgcacgccaccatgcttggctaatttttgtatttttagtagagatggagtttcaccatattggccaggctgatctagaactcccgaccttgtgatcctcccacctcggcctcccaaactgctgggattacaggtgtgagccacttagttttcttatttttggcaagatagttttaagtatcaaactactgcaaaaagttcaaaacctactgacatcatacggttataccacttatgacataaaaaatcaagtttgtatacacatatataaatttatacacacacaataattaagagttcaaagaaaagagaataaaatcagtgacactaggaaaatattttatttctcaaattaatgtatgacgaaggtagtggaaaatgtgactccattaatataattatttaattttcatggcccccacgttttagaatagcaggtgctgagcacattccaaatgtaacctccctttttctgcttctcatgcattaactcacggctgtcattcctgtaaaacttgttccactcctgtttcatctgacaaactgctgtgatatttcttccctgcagtgaatctggaggagtgtctcaagtcggccagcctaatccggtccagtgaccctgccttcagaattctagaagatggctcaatttacacaacacatgacctcattttgtcttctgaaaggaaaagtttttccattttcctttcagatggtcagagacgggaacaacaagagataaaagttgtactgtcagcaagagaaaacaaggtataaggcaagggcttaagcagcctagcacagtcatatgcttacgggagtccttcgtgtttcatgtgttttaacgtgtttcatgttaaaatctatgctattgaatgacaaatttgtcttttccacttacaattagtgtaaataaagactagacttttaaggagtggcagagccatttacaaacttttataaagatgaatgactctgtagaccaggagcaaagtaagaatatcagagttttctaatagtgatttcaagtttgggaataagaacaaaccaacctgaggagcaaggacaagacaggggcgggtctaaaactcagcgaaatgtgattcaggctggagatgtgggctccaccctgtgcggctctcttcccactgattgcgggtttgagtctctctttaaagaggagaagagactgtttaaagcttactcccatcttactagaatattctatagggcaggccctctcttcagagagtggaggtgtggccaatccacagaattgatttgaatgtttaactctaggctcattttcttgcactgagcggtagagatcagttcagaaagcagggaggaaaaagttgctggaattcacatctcattttcagcaaattcaccacaatgaatttcgtcttataaaaccatttcttaataaatgattctatttaggagaggatttcccaactaaattctttttgattgtatgaactcctcttaatatgcttaagactttaaaaatgttattttatatccacattgtaaaatccccacattatataaaatcaagtatacttgagcaaatgctgacctgtgtctacatagatgtataaatgattgtattgtggagtgagggttttaacagattttggttgtaccagtcctagtggaataaagttgatccttaaatatttattaatgaattatctattttagggggagtttatactttctcaaagtggcatctttccaaatgccctatacatttcctggtggttaactgagtaaatagagaaataggtagaacgggggaacataatgtagtctgaggtgtgtgtgtgtgttttatcaatagaaatgctttgctgactagccatgatattgtaatgtgtaacccttacatctgcttgttgatgtatgtgtaaaataatcacagttccaaaaaatgataagcaatgctacatttctttgtttcttgtcaaatgtagtctcctaagaagagacataccaaagacacagccctcaagcgcagcaagagacgatgggctcctattccagcttcattgatggagaactcgttgggtccatttccacaacacgttcagcaggtgcatttcacttatttgattttatatgtgtccaaatttttttttgttcttaaacttttcatttgaattgcacagcatattgaatcagaggtttaaactaatggtacaaataatgatcatctattcaccagaactagggtcccatagaagtgacccagtatatcttattactttcttacagatatcatatttagaaatttagaaacaagttttatatttggagtttctggtgctcttaggtctatgtctaaattcacccaaatactatgctagacttgttaacactaatgtacagaaggcacacctacatgttttgcatagttcaactcttgcttaaactaacactcatcttttataaaaatgacctgtatttctgcttaccaagtaagattgcctcactgccacatagctggattgcaaacatagaacagttttgaaattttggagtatagtggcatcagctcagctcactgcaacctctgcctcctgggttcaagcgattctcctgcctcaacctcccgagttgctgggattacggacacccaccaccacgcccagctaatttttgtatttttagtagagacaaggtttcgccatgttgaccagtttggtcttgaactcctgatctcaggtgattcacctgcctaggcctcccaaagtgctgggattacaggtgtgagccactgcgcccggccaaaattttctaattcttgaggaattaattgtggaagaaaagttgctttacttctagttttattatcacataattttcaattccaaagaattcaaaatcacggaaactgttactgttatttatatgaagataagaataaatagataaaacttgaaaagtgtattactctacatgttttatagatatacaaatggcaaaaaagttgagatcaaataagtgacagaatttgtggctttgcacaatgcaaaatgcaaataaaaattcggaaaacatggcagataatgggcacctaagcagaagaaagaaagaataggagagtaggaaagaggggtagtggtaaaaaaataaaccatcacaagaggttaggttgaaaatattcatcatgacgtatttgttctattcctaaattattactgcagatccaatctgatgctgcacagaattacaccatcttttattccataagtgggccaggcgtggacaaagaacccttcaatttgttttacatagagaaagacactggggatatcttttgtacaaggagcattgaccgtgagaaatatgaacagtttgcggtaggattattgaaatatttattcataattatatctttattactggcttactaatattttcaactatgcttgtttacatattataagaatcaattatttgatttaatattcaagatattaatatgcaatataaactttaaatttctattcaccattgatggggaaaaacagtggatataataagggaagtggcgggggaggtaaagaaaatataacgatggaattttaaaggatatattttggtctgtaatcctggagaaataacaaagagttttactgaatttaaagttatccataataaaatgactcagttattctcaaccatggctgtacattataagtcatgtgagaacttgaaaaaaaatactgatgcttggacccatgcccaagtattctgatttaattgttctgggatgagatccagtcatccaacgtgattctaaatgtgtaagtgttggatccactgccttagccccttacatagcttttttttttttgcatccctttctctcactattcttcagcaatgagatcccttagtaccattttacttccttagtaacccagaacaagtttatcaattcatttgattctatcttatcctacccaaagacaagacaattctaactcttctgataattaaatccttttgtttctgttaattttatataactctttggtggactgatgtctcatctgatgaaatgagatattcatagtaggtttttggaatggtggtgaataaaactgattaagcatttattgtcttgaatgatataagagtataataaagttctttgctaaaggagaatataaaaatgaaacttatctcatacttgggcagttcagagagtaatatcttagcagacatctggagaatgagtagtagttagtggccacctcaaggcagttatgaaagaagttaacaattgtggggatgggaagtggtagacaagtattccaggaagatgcatcagaaatggaaatatttacttgttaaaaagaaatcaacaacaacaacaaaccctggctgaagtgtaatttgaagctaaggaagagtgtgaaatatgaagctagtaagtaaaaaatagagagggaaagaccttataatttatcctaaggagtagattctatcgtaaggatatcctccaaagcagtctataaggtagtgaaaaatttgaaactgtataaattttccactttagatgtttcataattaaatacaaaattcatggtgggattgtagtggcatattttctttataattttatgttcccttccaaattctctagaataaacatattttacttctagtaatataacacacttttactttaaaaaatagtgtatccaagttcttacaggagaagtaagctaagcaccattgcaatcactttgatctttctactcataaacaaataaataattgatagtaagttctctgctgcttttacagtttctttactagagaaaagatctaacactagaagtcactcttgaggagatataaaaagctcatactctgtatgttgcaatattcacttcattttcaattttgctgaggaattgtttgatagggttctgtttgccaacctgctttctatctttgcttcttactgtgatcattgccagagggaaaaggagagaacagtttataattaaaaataagttactttgctatttttaacatttaaaaaaatgtaaatgaataaaataggttgaaatttatcctcaaagttaaacttttaaataatttcgcctcagaattacccatgtttctgtaggtcccattaacacagttaagtttgaattggcattaagaaacaccacttgcaaattagtaaaattcattaagtgaggtatagcaacaagatgtaaacctgatgcaattataaaatcacttgaagcaggatagaatagaagacttccctgtcaatgcagaggttaaaataagataatatgtttttaacgtaatatactttaataatagtttaaaatattgaataatgtatgtttctgggaattggtagatcctaagtatctgttcctttccttgtagcctcaaacaaatcacaacctcctagagttcgctttcttctttgtttatgggctgctagtagctgtgttcccaacctcagtagtgttctgatcattaaatgccgtaataccagtgataccactatgtaaactgtaaaagttgttgaagatattctaatggtagatttaacaatacacgtgttctagaattttgtccttaaacctgggaattttcatggaatttcctaattctttgattttatataagccatattcatgttaagtattaataatagattatttttatttgaaataatttgatttcgtagctttgggagtagtagccataggtctaattcaatacatattcaaagaatagttatataagaagggaactttcttcaacaattccaagtgatgctgtgaaagcagctgcaaacttcctttctctctgagtgttggggataatctgtacctttggaaaagttagcttcaatctgctcctttcttacctattcctattcaaccagaaccttactatcttttattatcttgtttttttttgttgtttttttgatatagggtgtcactctgtctcccaggctggagtgcagtaatccgatctcggctcactgcaacctctgccttctgagttcaagcaattctcctgcctcaacctcccgagtagctgggattacaggcgcccaccaccacgcccagctaatctttgtatttttcgtagagacagggttccaccatgttcgccaggctggtctcaaactcttggcctcaggtgattcacccacctcggcctcccaaagtactgggattacaggtgtgagccactgtgcccggcctcttgtaatgtttattttctcttctgggcacacaagtcgattaattctcttcatatatgtgctgttaattcacattctgtacccactcagctttggtgttactgctctctcctttctctgccccatctactgaatgcctgccactgtaaggccaaactcaagtccctatttctgtcagtagctgtttgcatttttccaaagatgacagcaatttcagcaatatatagtgtgaaagggctaaaagagatgagattctttaagctatagaataattcagaggaaactatatcacaataacacgcacatgacactaaataacccacttataacctagctaaaaatacaactaataatattctaaattattttttattgtaacaacacttaagtatattattattgcttttaatacagaatgatggatatagtaataaaaccattacctctattgagttttttgaaattgttgctttgttgactaaataacatatttataatgagttactctatcatatgaacataagtcaattctcctagagagttaggctctgttttaatgatgattccaattttgatttattttggagatacttggttcattattagcacaataaaacaaaaccaggatactacctgaagtaaaatcaccaactctgagtcagcggaatgtgaaataatatttacttgtagtcaaataacaaaaatattatttcaaattacaaatgagcatatggtgggaagcagatgatcttcatttccattgaagagaaaaactaagacaaattagtctaaattatagcagtgtggacttagtaggttggataaggagacttgttaataccattttaatgaggtagaaaaattcattacaagagatgcaatagaatctttatgacaatttttacagaaggataactgaaggcgtagtttgtcttcctaaaaggaaagatgagtagaattgaatgcaaagagctatttattgaagacttacccaaggtaaggcagtgtgttactgtgtcaggtacttctaggatacacgtatcagtaagtctcagtcttcaagcctgacagcaactgtaatctaatagagatataaaaccattttatagttttatccagctaaaatatcaaaatgacagcattttaaggaataaaaatccacatcatctatacgaagagaaagggaaggatttttaggaagggtgactgatgttgatacctggatgtgctggtagtgatgatgataatgatgatgtgacagtggtagtggtgctgatgatagtggtggtggtgacggtggcgatgatgatgacggtggtggtggtgttggtggtggtagtggtagcggtgatgataatgataatggtgatgatggtagtgtggtgatgatggtgctgatgatgatgctggtgatgatgatggtggtggtggtagtggttgtgatggtaatcgtggtcgcaatgatgatgtggtggtggtaataatggtggtgatggtggtgatgatagtgtggtgatgatgatggtaagtggtgatgatgatggtggtggtggtatggtgaagtggtaatgatagactactgtattccactcctgaatttagaatttattgataaataagatatagagatcagactgatggaagccataatgtaagttttgttactgaaaaataccacctggaagttacttggagaaaaatgagtaggaaggcagagagaacatgaatggttattttaatacattccattccagagtttggagtgtacattctttcctttccaggttagcacgaacagtgaacatgaaatgttgccttttaacacaataatgaggattttgtggttaatttagcagttagtgggtaaatcactgacgagtctgattagtgagtatcgtggttaaaattgtaaagcacaataaaatctgacttctgaggccacatcgattagaacagggaatgtcagaacaactgcagcaaagttagtgagtcaacatgtagaatgcatttggagtcacctgaaaatgatggcagtgggaatagaaaagagaacatgcatgacacacacaaaaatgccaaaatctctagaacttggcaactgactactaaggcttatgagagagagggaggagtttgatgcctggaattttaatcctagttcacttagaagtggttacagtagggaaaattagaagagctagttgtggtaaaaagctgagttaatgcagaattcactttgggtaggtttagttgttcccatgagggatgaaaatccattcaacaactatttgctgaacacttactatgcacaaaccacataaggaaggtgtaggaataatttggagtttaaaggcaaaggacattaaatacatactggctgttggggacaaggcattcattttgaaatggaatttctggtatgtatatgcttttattaacatttttattgcaaagaaatacatgcttaccatagaaaaatgagaaaatataggtaaaaaacatataattgagttcctgaaatagttgtgatgtccatttatttgtatgtatatatacatctgtacataaatagaattgtatttttataaactttaaaaacacgtgttaatgacatagttggggaaaatctacatgcattctaacaagtaaaacagcatacagttaattcagagaacaactggagtgcatggtgcttagagtgggagaataatgagcaataacgctgagaggggattgaaatcacatggcaggcagagactgcatctgtgggttatctctctattgcatcatttcttagttacgggtctttgggaatgatttttttttttaatgttacattttcccccactgctaggcttacttttgtgcataatttgtggtttgagaatacattgatggtattttcccttctttcagttatatggctatgcaacaactgcagatggctatgcaccagaatatccactccctttgatcatcaaaattgaagatgataatgataacgccccatattttgaacacagagtgactatctttactgtgcctgaaaattgccgatccggtaagttcacattttattgtagcatgacaagaagactatttgacatttcgtaagtattataattaaagatgtttacgttttatcattgcattttatgcattttctggtatttctgattacatacactttttttcccattaggaattgatgttatatgacattgctattaagggtggtaattgactctgagcacactttcttaaatttaagcatattcatatgataaaatattatacatttttcccttttatatcatgattttataattctggcagcatttatttgactaaattctctccagggtggggttgttgctgaagttggtgtttggtttaccaatgcatgcttagaaagtctggagtgaaggaaatattgctcaattttgccattaggaaaagttgttgttcagtataaaagggactatacccagaaatccatagagaatattacaggggatttacacgtgggccagggatcattttttcttccaacaaagtaagaggttattttttcattcattcattcattcattcagtggttttttaaaaagtgtcatttaaggatatatagaagcctaaatgtaggaaaaattcaacttttccttcaaagcaagaaaaatactccaaaaaaagtgatgtaatcaaacatacaggaatgtctattttatggtgccaaggaatttttttttaacagacatttgaaattcaaaggatttgacttttgtaggctatgtatgtgtagtaccagtttatattaaaatcttataatatcagtgttgttttcctgaattctctttattaaatgactgttgggtattagctttcattttagcctagctttgtaaccagcgtttaggatgatggcaattttaggaaaacactagatttttgcttccattgaattccttattaatattttaaacacaattatgtagaacatttttaaatgcttgactttcaaggatatactacataaaacgttctagttttatgaggttatatacttctcaaaggaaaacctttctgtgctcatcttgctacccacatatagaaggcagctaattgatacataaagttactaactggttagattagtacacaacagatctgaatgtgcaacagacaaatgccattcatattaaatataaagatattttatatttttaccatgtacatatgtgtcacaggtgcgtttatgaaacagtacgtaatttgaatctttataaagtttcaatacattttcaaggaaccagaaatatatcatggcatggaaatatcgatctgataaataaaacatatacattgccttttttggcatatcttccaaacaaaatgaaaaaaaaaattaaactgatttgatgctatgtgcagccaagtctgtgacccaagactactaaggggtataacaagactgactactttgttttaaaatgttgcaagaacagttgttatttcctgtggcctcctccattctgtttccatgtacatatgtgtgaataatattgctgtttcacaatactaatgcaatgtgtctaatactctcatgtctggactatgaagcttgtctaaatgatacatagactactccctatgattttgtcttgcatatattaatagttatttgtatacattaataatttatcacatttattaaagtacaaagcataaaatatttgttattacatgaaaagatgtggtattcctctgattaactttatcaagttgggttataaaagaggcaaggtatgcagagaaggtcccattcaaaaatggtccatgaacacttatatgccattggtgagaatgtaaattagttcagcccctgtggaaagcagtttggagattactcaaagaactaaaaacagagctactatttgagccagcaatgccattactaggtatatacccaagggaaaacaaatcattctaccaaaagacacttgcacttgtatgtttgttgccacaccattcacaatagcaaagacatgaaatgaatccacgtgcccttcaatggtggattggataaagaaaatgtagtacacaaatgccatagaatactatgcagccataaaaaagaataaaatcatgtcttttgcagcaacatagatgcaactggaggtcattatcctaagcaaattaacacacaaacagaaagctaaataccacatgttatcacttataagtgagagctgaacattgggtacacatagacacaaaaatgggaacaacaaacaatggggattccaaaaggtgggagggaaggaggagggaaggggctgaaaactacgtattcggtaccacattcactacgggggtggtgggatcattagaagcccaaacctcggtatcgcacaatatacccctgtaacaaacccgcatgtgtacccccaaatctaaaattaaattaagttaaatttaaaaatagcccgtgaacttagagagaaagaatttcagaactactgtttctaagggtagtgtgggaactgttctcatctatgtagaatatgaatcatgttattcacaggggccacctaactgaagttcccgagtaagggaggcttggagacatttagaacagtttcacattcgtcaacttaacagtagaactaatctacttgtggtttgggggagaatttgctacagcaatgccttgattttattttgtttataattcaattatatgagtagaaatttttgacacttttggatttatctaaacaggaacttcagtgggaaaagtgaccgccacagaccttgacgaacctgacactctccatactcgtctgaaatataaaatcttacaacaaatcccagatcatccaaagcatttctccatacacccagataccggtgtcatcaccacaactacaccttttctggatagagaagtaatgatgattaattaactatctagtcattgaactacatttaaactgagaatgaactcccgagagaagttgcaatatggccagtctggcctcctttctcagcatgcttctgtaggctgcggttagggcttctctggagatgtcctcggtccttagagatgttgggaaagtaccatatattagacagggcctcacttgaaatcactaacctgatttgatttgttgatgataaaattgctttacatttattttatttttgttttaaaaaatacttttatctggctccaatatgcttaactttttaaattcataaagtttgttgtagcaactttgggttcacagcacaatttagtagaaagtacagacgggggccaggcgcggtggctcacgcctgtaatcccagcactttgggagcctgaggcgggcggatcatgaggttaggagatggagaccatcctggctaacaccatgaaacgccgtctctaccaaaaaaatccaaagaaattagccgggcttggtggcgggcgcctgtagtcccagctactcaggaggctgaggcaggagaatggcgtgaacccgggaggcggagcttgcagtgagccgagatcgcgccactgcaccccagcctgggtgacagagcgagactccgtctcaaaaaaaaaaaaaaaaagaaagaaaaagaaaatacagacggttcccatatactccctatccctcccaacacacatagccttccctgctatcaacatcctgccccacggtgttatatttgatacaactgatacatttatgttgacacatcattattacacatcattattacctaaagtccatagttctcacattgtggttcactcttggtgctatatattctatgagtttgaacgaatgtgtaaagacacacattcatcattatagtatcatccagagtggtttcactgccctaaaaatcctcctattgaggattattttgcttctgtagtgcttctcctattgatgccttcttctctcttaattcctggcaaccactgatatttttactgtctctatattttgcccttttttagaatgtcatatagttgaaatcatatagtatgtaggcttttaagattggcttctttcatttagtaatatgcttttaaatttctttcatgtctttttaagtcttgatagctcttttctttttagcactgaataatatttcattgtctggatgtaccagtttatttacctactgaaggacatcttggttgttttcaagttttggcaattataaataaagcagctttaaattttaaaatgttacattagacacatcacctttccattgtaccaatcagccaatatcttgttctgtactttatttttttttaacaaaattatacgtaaaaggaatatttgggccaggcacagtggctcacacctgtaatcccagcactttgggaggccgaggcaggcagattgcctaagctcaggagttcgtgaccagcctgggcaacacagtaaaaccctgtctctactaaaaatacaaagattagctgggtgtggtggtgggcgcctgcactcccagctactctggaagctgaggtaggagaattgcttgaacctgggaggcagaggttgctgtgagccaagatcatgccactgcactccagcctgggtgacagtgagaccccatctcaaataaataaataaatatataaaagaaaaagtaaaaaagaatatttgtacaataatcgtgcctaaacaagtggttgtgagaattgcaagttataggaaataaaagtgttcattaatgtagttttttcctttttttcagaaatgtgatacttaccagttaataatggaagtgcgagacatgggtggtcagcctttcggtttatttaatacaggaacaattactatttcacttgaggatgaaaatgacaatccaccatctttcacagaaacttctgtgagtatacctctctattcattcatctagatttatctactttttcaaaaaacatgtctagaatttggtagctctgtgagatcacaaagtttgacagtttgatttaaataactactacttacaaataacatagggagaaaaatatgatttctgtacaaataattgaagtactagttatttctggatgctagggaaataaccatgctcttggctaccgaagagcttcttagccctagacgtagctcatgtgttaaacttttattttattttattttatttttttggtgttaagctctgctaccagattccttggcattaaatctttatgtagggtgaaggaggagaggctctctctctggtgtcctttacatttcaacttcttaagatgagtaaggaactagcctacggagacagtagtacaggctggctcacaactccaaacaagctcttcctgtaccatgagtaaacttttccttaggcggtaaacaataagagatatatataaatatatatatgtgtgatgtgtgtgtgtgtgtacacatatatatatttatatttttatgacaatagtttcaggaaatggttctcctttcctgaacttttgataaataacctttcattttttcattaacttattccagagcacaagtcaaagaaggaaaaacctgcaagtacagtgatagacatgttcatgtaatttcttacatgaatccctacaatatatgaggatatattttacctcatatttcatatgaggaaatagaaagtctgttaagtcaagatctcatactaataaaccatatacaaggaataaccaggattcaaatctaggtctattacgctccagtgtctatcatcctcctatatgaattcaccttctatctctaacagattcaatttactacttcttttagtctttaatatcttatgcttttgtaataatatttttgtggagggctattgtttaatgtctcaaaaaaaaaggaaaacttttctgctaaaggtttgcaagtgaatcaaaagtacatttggaaacactggtgtgaaaacaattctccagaaataagaagccaacatacgtttataattacctacaagtactgagtgtttaatatattaacataagacatttattaagtgtttactgtgtaaaaatgggagaggatagactgtaaatattgtagaggtgcagagaagagataaatctgaggtctagaatgattaggaaaattatctcagagaagttcagaagataagacttggggtagcctttgaagaatggaaaagatatgaaaaggcaattcaggaggaaagaactaagctacgcattaaatttgtaaaatgtttccccatatagtgagggcagcttttcacatcactttatttatttttttctttaaatacgtgttttagaatataaagctacattgtcaaagttgtaaattgataataataaggggcaattctttcagtatgttacagaagtagaagaaaacagaattgacgtggagattttacgaatgaaggtacaggatcaggatttgccaaacactcctcactcaaaggctgtatacaaaatcctacaaggaaatgaaaatggaaacttcataattagcacagatccaaatacaaatgaaggagtgctgtgtgttgtcaaggtaaacaaataaaataatcaggctatgctttaaaatatcctaactcacgcactgattttaagagataattcttatatgtatatgactagactactgcagtgcaaggccaaatgatttatattggtttatataaactttgttgtttcttattctcttaccctaattttctctcttagaagaaagtcatgtcaggtacaaaactcattgttctctatatgaagaaaaccaagacagagaaatattgaatactgaaccagatatttgctttagaaggggtcttagacacttacttgtccacatttcttttttataagaacacaaaagaagaaaatggaagaatcactatttgaaatcaagcctcaacttttcaactcctttcatgttcatagtacattttatttttacctctctatgatgtattctgtaaaagagactattgaactaaatattcagcaacttttcccattaatccccctatattccaggtagccattgctttggattttttaaatttaattgcaattactggtttctaggatgattactttaactggacctaattcttttttagtccatctatccatagctctcattgacttcttgcatagcttcattcattaatttcttagagacagtttaagtcctcagaaggttcaggcagacattgtgttctcctgataagatttttagaaaatattctttaattattgtactgtctactttttctttctttatttctttttcttttcttgttcttaggttttttcccccttgatatttttttcaccatttaaatgttgttttaggattctttctaactattcattttaggactgtattagtttgttttcacatggctgataaagacatatccgaaactgggaacaaaaagaggtttaattggacttacagtttcacatggctagggaggcctcagaatcatggagggaggcaaaaggcacttctcacatggtggcagcaagagaagaatgaggcagaagcaaaagcagaaacccctgataaagctatcagctcctgcgagacttattcactatcacgagaatagcacaggaaagactggcccccaagattcaattaccttgccctgggtccctcccacaacaggtgggaattctgggagatacaaatcaagttgagatgtgggtgggacatagccaaccatatcaaggaccaagcgctttcatcaggaactaaacagcctgaaatataatgtgctttgaaaaggtgctgttaaatatcattctatcttttgagtcaggcatagagtaactgctgtattatagccaaatttctatctaattattgtatatacttagtttggaggcaatttagttgtcactgttatcccatataataagcagtaaagtaatttgaattttttcatacacttatcttgcatttctattaatatttaaacttataatgaaaaaggccgaaggcaagatcttccaaaagaaaaatgagaagaaaaatgggttgaatctgagaatcaacaattttgcatttggcaatgtttgtcactttaggaagctaattgttggtctttaactgtattagacctaactttaggttacattttaaatgtaaaaatgatattcctttgtaggaaaatttgaaattagaagtcttatatataatgttatatattgacttattaaagtatgcttatttaacagccattgaactatgaagtcaatcgccaagttattttgcaagttggtgtcattaacgaggcacaattctctaaagcagcgagctcacaaactcctacaatgtgcactacaactgtcaccgttaaaattatagacagtgatgagggccctgaatgccaccctccagtgaaagttattcagagtcaagatggcttcccagctggccaagaactccttggatacaaagcactggacccggaaatatccagtggtgaaggcttaaggtgatgtacttttcaaaaagctccttaattttaattgtgatgtaaattgtttttaaagttatgaatgttttatgtatttttcaaaatgacagattttaagatcatgtcccttctttgatttgaccgttcatatttgatttctaaaaattaggtatcagaagttaggggatgaagataactggtttgaaattaatcaacacactggcgacttgagaactctaaaagtactagatagagaatccaaatttgtaaaaaacaaccaatacaatatttcagttgttgcagtggatgcaggtgagtgccattttctacagataaaatataaatatacgacatgtttttaaggaaaccttgtggtgaaatctgtttatttctagacaaaacataattcaagcaatgtttgcatttttattgttcatgttattggatatcacccagtttaggcttcagtgcatctataatgcaaagctatgaggtagtgaatggccaaagcttaaggcttaattatatcacaataaatttaaatgtaattacatcacaattaaaattaaggtctaaggtttcaaagatgatctatatattattaatttctgctgaggaaatggtggcatactcaaggatcaccgttttttttcagaagtacaggtttagatacattatgatttgagcttgctgaaagggttcaacacacctaaaacagttgggttcaaagtaagtttgttctgagcttctcttaatggagaacaaatcatttatcctattttataaagcaatggtcaaacaatgacttaagtcttttatggtgatttgcaatcttttaccaaggtcaattttagaatcaattctgtaaagaatgtcctccaaatatagtaaagtagtgatctggaaattcttttgaacatacaaatttctatcagtaaaccacttgttagtatgtttaaatatatatttataaatatgtttttaaatatttgctatcatatgtatttttatatacatgtactattatactaatgtatacatcataaaaatatacaaaacatattaaaagaggatgataaaaatataagtagaagctacactcttccattttatcatattgatgacaaatttaccataaattttggcaaattgccataaataataaagataaatgaacttgggcttttataacatagcctattcgtttgactacctgcctaatccaagaaggtttccactctttttacatgcatatgctggatgttcaaaacaaactagctgatacaatgctatgggttttttttttcctgtgtctattgcatttctttagaaggaatggttgactgtattaataaatacatatgaaattccatggtaattaatataagttggtagtagtgaaaatgttcatgcttatttatttgtccctttgttttttttttaataacaaaatgcaaacaatgtgttctcagatattatacccctacttttttctatgatggcaaagaagactttatgtttactcatttattccccaactggtggtttgtctattaagttctaagtattagacaagctgacatggaaattaagaatgttaagataaggccaaattcttacacgatatcaactatagaattattatagtttcacaagagattctatgatgtgagaactttcctcaaaaagaatgtatgaatattatcagaagtggcgatcagttaagacctgctcagattaaggatgaaagagaagagattacagaaatgcagaggcctaattttttaaaaataaaatgctatctggagaggagaaaattatggagaacaaagtatttaaaaagtaactttgttttttggtgctaaaagacaaagtctgtaagcacagtgaatgtagtgtagaaaataaaaagcaaactttaacaaatctacattccagggccgtagataacctgggtgtgtttaataaaaaagtaaagataaggatgttacacattttagtgaaaaaccatatagtgatatgatggattttgtttctttgaactttaatccacacacacacacacacacacacacacacacacacacacacacattttgctctgatgctcatgattattcctggatgatgatctaggtattctacctgtcttagaatccaactttctttcttgtgtcaatcctctgtcagtctggctgatgtccctgctgtcagtcgagaaagcattgttttacataccttccacctagagtagcattgctcctcctgtctgaaattcaggccccttaacttcttcaaataaatggcaatgacaaggtttgtgattgtttccattagtctggattcagttcttctctaaataccttttgaactggggataacaattatcatatatggtgtggcttctgtagaaaaggctgctttcattgtttctcatgtatattctgttctcctaacaagcttaattatgagttcaattttgtataaagaccctttttctttgtaaatcgtccctttccaagtatctggcagaaaatgtggtatacatatgcacagtgcaggtgctgatatttgtcattcctttgttgtttgagagtcctatgaatctccacgttatacatttcactgcaaaaagctttacaattctagggacataattagcacttgggaaaactgattttaatgtagaaaattgagattaaacatttattaagtgcttctttatttttcccttctgtaagaaggattttcttaagagaacaaatatttaagggttgtcatgtacaagtggcaaacattttgcatgtatagtccaaaaagaacatgaacaaattacaggaaatcattaggaggcatattgtagcttaataattaaaaatttaaatcttttaacaattaattttaaaatttatagagtaggctgatttataatacagtgattctagttactgaaacatttgagtagcaataaaaaacgactgctttccagaattgctgttgaagtattatgaagatttttagttaacccaagatgtactttctagctctgtgattggtgtttcttactcatttatacttgatgtttgcttatgtgcttaatttaaagtaaattttagaagtaaataaacacaccaatgacttcatcatgctcagctattatcagtaattacttatttttggctgtttacctcttcccaggggtaaaataaaaacttaccatcaacctcttgtaatttttgatatcttctaagacaagcttgtccaacctgtggcctgcaggcagcatgcagcccagcgtggctttgaatgtggcccaacaaaaattcataaactttcttgaaacattataagatttgtttgcaacatatattttttagctcatcagctatcattggtgttagtgtattttatgtgtggcccaagacaattcttctgttttcagtgtggcccagggaagccaaaagattggacacccctgttctaagaccttctcagctttgtctttgattgccttccatttaaatcatttcaagcatctttcatctgtttttatcaacatgcttaaagcagagactgtaatagaaaatagtaagttatgggataaatgttggttgaatatgtgattaaataaatcttgatttgcgttactataattaccactttttttggatttttaaagtgtgttttcttacgatttttctataaagagaaaggctttctgcttaaattttaaaaggtgaaattatagtatatatatcaactcatgtgtagtgtatgcaactaaattttttactttataaggcctctttttcatattattcatttcttagtttgctgattttaaagttattacttatattcaactttatttgctattttctggcagtctcaaagtatttatatgctattgcaaatttcttcaacaaatagctatatctctcttttatttctggatatttttaaatttgttcaggtagttttaaaataggcataaatagtagttactttatacaaacaattagtttaaaagtcactgaataaattaattttgtagttattcaacagaaaaaattcttttgaaatacactacatgatatgacttagggttatttcaaattaaaaagaaaaataaattatatttgcatgggagttatagtagtctttatgataaattcaacatacatgtttcaaaatgtggaccagtatttaaagcaaaaacatgaaaaattacatcaattacctttctgtttatttcaattttgatatcttatcatttattgtagtttattatccttttacaaatggtcggatttgacatgtttctgaacttcattatctcttaaacacaaataatgggcactattttaactaaaaatactatgtgtgaagtcttaggccaataatagtggcaatcaacagatgagtacgagacagttcctgttgtcaagaacatatgaattgcattagggtagagatgaaaacttatttttctggcttattcaattaaatgttttcaagtataaaaataggaactgcattatgttcaatgtgtcagtattaagttatagttagctgggaaatactgggcaaatcactaggctctcaaggtgaatacaacttactatgctacttttgcagttcagtgtgtgagccaaagtattagcaaagagttctgagaaagcactggaatatggctaccattgtctgtggaagtcacgagtttcatgaggacgtgacatttaagtagattcttgaagataatagtgtgctatctggcaaagaagaggagaaaagtattcctaggagtggcaaccgaatgctacaaagcagacaggaaggggaacacttagtgcatttctagagaagttttcaaggtttgggaaaaaagtatatgatgcaatggagaagctgagaaagtgactgacaaccaaatgtaaagtgtttgtattctaaggatgaatatatgcgcttcataaagaaggatgtaagacatctgttttattttcaacaggtcattctgtagtgaccttcctcataatctcataccttttagttttgaaaagcatctgaagaaattatctgatccagccctagtcttcaaagaaaagtgacatgtccctattttgtagtcttggtgtctgaaatctgggaagcatgtatgcgaactcaagctcagacagctagtagaaagcagatgtcaactgtgtattttataaattgttgaaaataaatgcattttcatgtgaagaaataacctatttttaattaatcttagttggccgatcttgcactggaacattagtagttcatttggatgattacaacgatcacgcacctcaaattgacaaagaagtgaccatttgtcagaataatgaggattttgctgttctgaaacctgtagatccagatggacctgaaaatggaccaccttttcaattctttctggataattctgccagtaaaaactggaacatagaagaaaaggatggtatgtaatcatgctaaattttatagtcaatacggacttcagattggtgatggttctttcaccttagtttatcataataaatacacatttattttaggaaattattttattaaccctaaaaacaacaatacctaatctttaaaaaaaattagtgccattgtggtgagcttagactcttgttctgaatatcttttaagaaaacatataagtccctttttaattaacatttgagcaacatgttaagtacagattagtttaatatcagcataaagcaacatcaattacttttctggctcttctgggaaatcacaaattcaaaaaaaaaaagaaaaattcgagtttttattctaaattgattcccttccactgagaatattgagtaggaataatactgccatctaaacagccaatccatatatattctgtcttttttttccctaggtaaaactgccattcttcgtcaacggcaaaatcttgattataactattattctgtgcctattcaaataaaagacaggcatggtttagttgcaacacatatgttaacagtgagagtatgtgactgttcaactccatctgagtgtagaatgaaggataaaagtacaagagacgttagaccaaatgtaatacttggaagatgggctattcttgctatggtgttgggttctgtattgttattatgtaagtatattaagtatcattatctagaatgtgttagctaaaattttatctagtatttttaaaacatggaagttttttatattaatagcctttgggaagtgtgttcttttaaaaatattgtatctattttatgtcttggggctctgagtgataaatgtatcagtaacagcagattaaatttaaagtcagtttcagaggtggtagccttagttcttcaataattatctgtgagacattgggtaaattatttcctcctttttgaactcatttttccatgtgtaaaatgaagaggctgggtaaaactattaagattccctccatgtaaaataatatagtctttcaaccagccatgtttatgtagggaatacatacatacaaaaagaatttgtgaaaacagagctattccaaaatttactcagatatttctgttccatattattaatgaagtgatttagcatcatcgtaagacttccgtgagtgaaaaatggtcatatgagccactgaggaaaagcaatacaggcaaaggatgctaagattttgcattgtgcaaactgttatttggaggtacaaaagtaatagaaatattgcccacgcttaattaagactgcctttttctctttctttctttctgtttctctcttcttttccttttctttttctttctctctccctctgaccccaaagaacccatttgcatttacaaacttttcctataatctttactgtatcctaattcattgatctgagtttcagattaaattggatattcctcttagcactttattagttgatgtacatttttgaaaccagacaccaattttatgtaattgcctttcttgtttgtatttatgcctaatgttcttagtcttgttattttaagccctttaagtgtgttctgtatgattttaactactaatgatgctatcttaaatatcagttagatgaagttaccatttcaatgtagaagaaataaaagacacatataagttaattctggacctgggaagagagctattattaatctctctaagctacaaatagtataaatacatttttaaaatattctgtttttaaatcttgtgacctgaagagctcaatttgtggaatgaatttttgagacatatgcaagaagactttaaaaaatcatgtaatcaaatgatttaatgtctgtgttttactttgatcttttttgctttttaggtattctgtttacatgtttctgtgtcactgctaagagaacagtcaagaaatgttttccagaagacatagcccagcaaaatttaattgtatcaaatactgaaggacctggagaagaagtaacggtaaatcagatttcacatccctttgaattgtacggtgaacaaatgatgacagattattactcaacaatgtcaatgataatatcactaatgtttattgagcacttactatgctaagcagagtttcaagtgccctcagtgttttaaatcatttaaacctcccaattctacagggctagggctgtcacaacaaactgagtgacttaaacaacagacaagtattgtttcacagatctggagactagaaatcagagatcaaggtgttggcaggtccgtgctccctctgaaggaactggggagggatctgttccaggactctctcctagcttctgccaattccctggcttatggcagtggaaatcaaatcttcatatggcgattctccatgtgtgcatgtctgtgtccaaatttcccctttttataaggatactgattatattcgcttagggacccactctaatcccatataacctcatcttagctaattacatctacaatgaccctatttccaaataagttcacattctgagttactgagggttagggcatatgaatttttaggggactcaattcaacccatcacacctatgatactattattctgattttatgtatgaggaacagagaggcacagcaggcaagtgatttgcctatggtgaaaaaaaatgaaaatgaattgttagtttccatttttcaaattcactttatcactctcactttacttttaggaagcaaatattagactccccatgcagacatccaacatttgtgacacaagcatgtctgttggtactgttggtggccagggaatcaaaacacagcaaagttttgagatggtcaaaggaggctacactttggattccaacaaaggaggtggacatcagaccttggagtccgtcaagggagtggggcagggagatactggcagatatgcgtacacggactggcagagtttcacccaacctcggcttggcgaagtaagttccactgtctttgaggtcatattacatggaaattaaatgctagttataaatcagaatttcccaaaagttttactcctcatatacctggaattcaacatcttttacctgttggattatcatagatgtggatgtctggtttaaacccaaagataaaaatgatctttgaaaattcacctttgaaaatacagtttacaaaactttatctaggagtgccatatgtagatgtgtttacaaaggataaaaggttcatagcctcttccctagaaattaacaggaaaaccagctggagtgaaatatttattatacaggaatgaatggatcataaattataaacatttctcagtgtgcttgagttctttgtgtggttatgaagtcctggctatcaaaatcaaccagataaattgttgagcttttattttgagttttagttccttgttttgttttatgttcagattaatcagtataggtttgatattagccagtttaatatattacactatcacagttatatagtagtgtataaacataggaatcatagcctatattggttttcctcaaatacgtgaagaagctacaaaggtaaatttcaaatatacatgttttgtgttcaaatgggaaattataaatgtgttgcgtgatatatgcgtagtcttaattttttaaatgtgctcactagaagcatttatttatttgctatattttaagagtgactataatacagaccaatcctgtgcattttttatatataggaatccattagaggacacactctgattaaaaattaaacagtaaaaggtaaatcaaagacatcatttttctgctaatatgtttaggtgttttttaaaaaataataaaatgtgctcttttttgatacagaaggtgtatttgtgtggacaagatgaggagcataaacattgtgaagactacgtttgttcgtataactatgaaggcaaaggttctctggccggctcagtaggttgctgcagcgatcggcaggaagaagagggactggagtttctagatcacctggaacccaaatttaggacattagcaaagacatgcatcaagaaataaatgtgccttttaatagtgtaatatccacagatgcataagtaggaatttattacttgcagaatgttagcagcatctgctaatgtttttgtttatggaggtaaactttgtcatgtataggtaagggtactataaatatgagattcccctacattctccttgtctggtataacttccatgttctctagaaatcaaggttttgtttgttaattctcttttatatgcatgtatatattgcccttttcacgactgtactgtacaccttcttgcaccttttatttgcaaactgatgttactttttgtgctgtggaagagcatttgggaaagctgggtattatagaggccaatgaaagatgaatttgcattgtagatgtacgaattaaatatgttcttcaaaatcttggggagaattatgttcttagaacatagttggtgccagataattgcattctctccacctgagtggtttaaaaaggacttttaagtattcttcagtgcaatcttcagttttgtgattaagttcatttctcttttacacttttgtactcctcagagcagtgctcccagcattgttttctttcaggatccttcagagctcagtccctggacctctgcccatgtggatttgttgttaggtcactccaacttctagggttcttggaaagataaggaccagaacaagctcatagcaaattgaggggcagagattttatgaagattacatgagaagatttccatgaaagaattgcagccctgaggtccatgggttgacttatgctcacaaatatgtttcgtttgctcaacatggtttactactaacattttaaaaatataaatactttagcaaaaacattcactcttgagtttgacataggcctgccttatctgtggttgccacctgccatctccaagcatttggacaactagccctgatgcattaggctgcaactctgatatacagagactagcaccttgaatatgccagaaattgaattaccatctgtattagaacttaagactcagcctaaatttacagttactttaagaaaatgggcagtcagaattagggactagaatgtatatgagaaacccccactctactaaaaatataagaaattagccggacatggtggcgaatgactgtaatcccagctactcaggaggctgaggcaggagaatcgcttgaatccaggaggcggaggttgcagtgagccgagattgccactgcactccagcctgggcaacaagagcgaaactccgtctcaaaaaaaaaaaaaaaaaattgaaatcaattacagcaacacttaccaaacatttgtagaatgatgaataaatgaacgcacacattcagaaataattttgaatgtataacattttaataggatagtatattttattaatctaaaaagaaactatatatttaaatagcattttcgtagtcatttgtggcaaactctataagtctataaacaataacagtatggaaatttctcatccagaaaaaacaaagacttaaaaaaatctattaactagatattttctaactagttaactatttttaaaaatgagtggctttttaaaaaaattttgtgactagtcttctaattctcagttccaaattaaaggcgcttcttgatatgaaattggatattggatcagaagaaaaaagtgattttaataaatcagattttataaggtatccataacatataatttttataaccattataaaatatttttgtggtcatgcaatttttgttctctgatgtacaggttgctctgataatatcagttctaaaattttaaaatataatataaatttggacatttatcataaaaagttacattcttgaatgtaggtacaaaatgttcttggagtaattaaaaatcattaactgaaccttaactttaattgtacttttatgttcagatatacattttctttcccataattaagcaagtgaaaagaaatatgaagacaaacgaacatatgtaagttaaatttcagctaatgatttttagttactccaagaacaatttctacctacattcaaaatgtaataattaatatccagaggtagatagctcagtcagcaagagaagatactccaaaagcatttgaaaaattattagaaagtgtgagaaataaatttgtattaaacagttttggccatttaaaatattttcaaaatatcattagagtttatctcagagaaactttgactgtcttttggtttacttaggcaattcaaaatcattctctgcttactcccaaaattaaatgttaattgtatgtttgataaaatatgtgacactctatcagattgcttacaaatttcatttgttaataaaagattgcatttcatggatttatttcataaaacttaattgtcagttaataagttaatagttatgactggtttttctagaattaaatcagtattgaggaagatatacagttaaattttcttatcttatttcagatctcaaatatttcatgtgaaaaaatttcatgagaacaccagggtagatgaaaatcaatgtaattttataagtgagcttcattagacatgtcctaattttactgaacttctgcttactcctgtgtttattaaaagtatttcatacaacttgacatctatgcatatatttactttcagaaaagtcatatgctgtgttatttagaaaatgctcaaaatagatgttttagagtcaaagatttttattatcacagaaaagccctctttttattgcatggtagttatgaaagttctgtactagttgaaaaacctaaatgaaattaaggtaatgaaacaaacaatgtatattgctgcatttttctactctcttttatctgcttttctaataaatctgaaggagtgttgcatttgactagacactgcatttgtctttctgcttttgtagaaaagaagaaaataaagaagtatagcagaagaaaacgttactaagaatggatagattcttgcatattttatagggcccaataaaattaagttagcgtaatttttcaaaactcttcaaaaaaatgtttacataaaaaataaaaatcacattatattacctcaaatccttactaccaaaaccaaaataactttttaaaaatagttattttaaatagactaatttaagtgtattagaaggattataaaaacaaatgtgtgaagtgcatttataatatatatcttatgaagttaagtcttttattattttaagatattcacttcttaaagtaagttttttgat

SEQ ID NO: 12441 - DNA, 15077 bp, Human
ctgaggcaggagaattgcttaaacctgggaggtgcaggttgcagtgagccaagatggcgccactgtactccagcctgggtgacagagcaaaactccatctcaaaaaaaaaaaaaaaaaagtgtttgctaagtaaatgtcttaaaaaaataataagcttgtcattgagtaagaaagttaagttgcagccaggcatggtgactcatgcctgtgattccagcactttggtaggcccaggtgagaggattgcttgagggcaggagtttaaggctgcagtgagctatgattgtgccactgcactccagcttgagttatagattgggaccctgtctctaaaaataaacatttttgaaaagctaagatgcaaaaatattgtcacctgcattggcaagaccctatagatgtctaggtgtgtctggtttcatgagcatagaaaactatgggacacatacttagtcgtcaacaggattgccagaggaggaactgtgtgtgtgtgtgtgtgtatgggggaagggggaagggagtaagcaaaataaaaatatttaaagcctcatgattattattattattattttcgagacaaagtcttgctctgtcacccaggctggagtgcagtggtgtgatctcagctcactgaaacctctgcctcctgggttcaagcaattcccctgcctcagcctcccgagtagctgggattacaggcgcctgctaccacacccggctaatttttgtatttttagtagagatggagtttcaccatcttggccaggctggtctcgaagtccttacctcatgatccacccactgcggcctcccaaagtgctgggattacaggctcctgctaccacaccggctaatttttgtatttttagtagagatggagtttcaccatcttggccaggctggtctcgaactccttacctcatgatccacccgctgcggcctcccaaagtgttgggattacaaggcgtgagccactgcgtccagtctcttgattatttttatgcagtcattaaactatatacatgcatatgtatagagaaagtttcaatgactaaaaataaggaaaccaagaaagaacttctctatctgccatggggccagggtcggggcaccccagcagtgtgtgaagagcagaagtccagccaatgacagactcttcccaaaacatcacttgcttatttcgaaatcaaacaatttctcataaatattttctcccaatgctgggaagagggagaggggaaggaggtacggaaactccatcaatcatttgaagggctgccttttatcagactgattttccgtagtgggttgtttgcagcttcctcctccccagttctgggcctcagctgtcaaaaggatttcaccatgcaactttttcatgctagcagttggggccaagaagctaatagatgggaaaaagctctgaaaactccaggacgacaaataggtgtcctcctcacagaaaaggattactgccccaccatccccaggtggccctcaaatccgttctctaaacggcagcagctgtttagaggtgtccaccaggtgtccgcagctttgtcatcctatccctgttcggggcagagactgagggctgctgacccggaccggctattttgggacgtgctgcggggggccttgggaggttggtgacgaaaggagtgcgtgcccgctaagggaggggacgccccggagcgtacactcataaacctggtcccgaggcctgcccctcaccaggatggtgcacgcggaaggggcggctttttagtggcgcaagggggctggtcggtggtagtttggggcggtgctgattgatggcgggcggggcggggcggtgctgattggcggggggggcggggtgaggcgacgctgcgctgattggctgggggcggggcggggcgtctcccgcccgggcctagagcgctgccgggggcgccgggactatgtcgcgggcgcggagccacctgcgcgccgctctattcctggcagcggcgtctgcgcgcggcgtaacgacccaggtcgcggcgcggcggggcttgagcgcgtggccggtgccgcaggagccgagcatggagtaccaggtatcaggcgggccagcgggccagcgggcctgggcgcgacgacacgtgggcctgcgctgagccgcagaacatccgggctccgctagccgagagggtatcgggagccctggactgggggactcggggggcggaacatcctggaggctgggggtggggacagggaccaggaagttgggcccgggccgccggggctgggaattcggagactatagcgtccccgccccgggttgggaagtgggaagtggcacaggagctaggatccagaagcccagaggctcagcggtgcttctggagttccagtgatcccggagtctgaaccggcagtgagagtggggaaagagggtagggaagagactcaggaattcaggcttgaaagatccaggagtattgatctgggggtgggctgtccaggattcagaagattggggatccaagtgcctggatttgggggagaggcaggaatcaggggtagtggagggccccagaacctggaaaatagaaaatgtccgcgggcgctgtgtcaagagccggttgccctagaccagaccctgatgccagtgaggcgggtggcactggtttgatgagggtggagcctccaaccagccttgaggtcctgagggtgggaggcacggaatatgaggcctaaggggaatgaaatagcacccccactcccacttccattgtgaaccctcctgaagccgtacctacctgccttcctggctgagtgacccctggcacacccctcctccctctgagttgctcctctgtgggttggaatgtggaaccccagagtcatgagggttggggtggagcttcggggaactccagaattcgaataccccaaccttctgtagttctggccccgctctggcagggagcaatatagcaatggaccccattggagagaatgagggcaaaggcccaggagtgaagtcgggggagcctgggcaggaagcaaggctagcccgttagtcatgccaccttctttgtgtagcactccctgggtggggctgaactgccccagactcccatttttgccagagctggaaagatgccatactctctgttgcttaacctacaggctaggctaacagtgctggcatggcaggcgggcctggtactggccttgttgccctggcttggccactggtctgctggctgtctctgtgcctgtggaccctgagtgagccttaacctactatctgggcactgtggttgccaggatgccgtgcgcatgctcaataccctgcagaccaatgccggctacctggagcaggtgaagcgccagcggggtgaccctcagacacagttggaagccatggaactgtacctggcacggagtgggctgcaggtaaggtagagagggcctgtgaccacctcccacccccatttgtgattcccgtagctgaggcagggaccttgtctgtctgtcccaggtggaggacttggaccggctgaacatcatccacgtcactgggacgaaggggaaggtgaggggcaggaccctggggtagggggtctattaagtggctggtggagtagagcctgcccagacaatcccttttctttcaagggctccacctgtgccttcacggaatgtatcctccgaagctatggcctgaagacgggattctttaggtactggcttgtggggggatgtggtgtctgtgtcccaatggaccctggggggctatggaaccagccagtgcttcaggaccagggtcacccccaggaggtcagctgcatgtctctctgcccagtgtttattcattcaataaacattcagttagcacttaccatattggcccatgtttatggcaacctttaattttttttttttttttgagactgagtctcactctatcgcccaggctggagtacaatggcacgatcttggctcactgcaacccccgcctgccaggttcaagcaattctcctgcttcagcctcccaagtagcttggattacaggcacctgccaccacaccaggctaatttttatatttttagtagagatggggtttcaccatgttggccaggctgttctcgaactcctgacctcaagtgatccgcccacctcggcctcctaaagtgctgggattacaggtgtgagccacggtgcctggccttaattttcataattaaaaaaaaattggggaaggggcagcaactttaatgtataaactaaatatgtagcaggaggtccagtgtggtggctcatgcctataatcccagcactttgggcagctgacatgggaggatcacctgagtctggggaggtcaaggctgcagttagcagtgatcatgccattgcacttcagcctgggcgacagagcaaactgctatcttaaaaaaaaaaaagaaaattacatagctggaatagtcagatggtcagatgtctctttaataacttaaagtccaggttgagtgtggtggctcacaactgtaatcctagcactttgggaggccaaggtgggaggatcactggagctcaggagtttgagaccagcttgggcaacgtagtgagacttcatctctattaaaaaaaaaatgaaaagaaaaaattttaaagtccatatataactttaaaatcacatagagatatttatcaattagtatgtctttagagtaaggagaaaattgccttgcaagggcttaaacgataagggtggcttgtgccatccacgttaaggtctcctaggcgggctgcagataggagcccttctgcttggccactctccactgtggctttgccctggggcagcgccccctcttggtctcacttgtctagacttacacaagaggatggccaggtggaaccgggatcactcttcctgtgccacgcatgtcttctaagcccatcaccacgaacttctgaaatcagctgcctaaggtcatttcaagccgatatgttttccctaaacagttcttgttcaaataaagagatggagaggaggacttactacctgagtagctttgaggattgaaacataaggcaccaacctgtcttctaaaatcactttttgggccaggcgtggtggctcatgcctgtaatcccagcactttgggaggccgaagcaggcagatcacttgaggccaggagttcaagagcagcctggccaacatggcgaaaccctatctctactaaaaataccaaaaaattggctgggcacggtggctcatgcctgtaatcccagcactttgggaggctgaggtgggtggatcaccagaggtcaggagttcaagaccagcctggctaacatggcgtaaccctgtctctactaaaaatacaagaatcagcgaggcgtggtggtgtgtgcctgtagtcccagctacttgggaggccgaggcatgagaaacgcttgaacctgggaggcagaggttgcagtgagccaagattgcaccactgcactccagcctaggcgacagaacaagaccctgtctcaaaaataaataaataaaaactacaatcatttttgggataaaaacctagccttcaacttgggcccacatggccttgagggccagcccagggctgcagcttgaacattggttgtgggctttgtctctgagagctgtaagacagatgacattgtgggacagatgtcagcagagtgactgattggtatgggactgttggagcccatagaatgtgcaagaccagcctgggtgaggaggctgtcttagttgagaccaacgtggtgaatagggtgagccaggtgcagaggcctggagatagaagatggggaggactggggggctacagatagtccggggggatggggcaccaggaacaaaccgagggacacaggagagatgaggcacggaggccagtagcatcagtccctgcagggtgggggaaggccaggacgctcgggaagggagtcctgatgaccccagctgtcccggcagctctccccacctggtgcaggttcgggagcggatccgcatcaatgggcagcccatcagtcctgagctcttcaccaagtacttctggcgcctctaccaccggctggaggagaccaaggtgccgcatgcaggagggctggcgggtgggtatggttgggggtgctacgtgttccagcaccccatctccccagagaaggggctgcatgggctctgggccctgacatgtccctgtgccacaggatggcagctgtgtctccatgcccccctacttccgcttcctgacactcatggccttccacgtcttcctccaagagaaggtgtgtgccctctccctagaaccctgcatctgaggccttgggaacgggaacctcagcaggcctgggggctccctgcttccatgcggcctctgggcaccctcatatcccctgccatgccctctggtctttgacaggtggacctggcagtggtggaggtgggcattggcggggcttatgactgcaccaacatcatcaggtgagcgcagttgcttgggacgaggggtggcagccaggagcacagcctcacctgccgcctggtggctcagggcagggcctcatggccttttcctcccctgcaggaagcctgtggtgtgcggagtctcctctcttggcatcgaccacaccagcctcctgggggatacggtggagaagatcgcatggcagaaagggggcatctttaaggtgaccaggcagactgggggaagggagagacatggaaggcctgggagtctacgttttcatcctggcttcactgtgtgactggaacaagttgagtctcctctccagactatttccccattgaaacgtgagggatggctgggcatggtggcttatatgcttgcaatcccagcatttcaggaggtcgaggtgagaggatcacctgagatccggagtttgagaccagcctgaccaatatggggaaactctgtctctactaaaaatacaaaaattagccaggtgtggtggtgtacgcctgtagttccagctacttgggagactgaggcaggagaatcactcgaacccgggaggcagacgttgcagtgagccgagattgcgccacagcactccagcctgggtgacagagtgagacttcatctcgaaaaagaaaagaaaagaaacatgagggatgagagacagtggtagcccagacccagggatgtgggggccagagataggagtgtggaggatgctaggtagccctttctctctccttcttccctccacagcaaggtgtccctgccttcactgtgctccaacctgaaggtcccctggcagtgctgagggaccgagcccagcagatctcagtaagtctgattggaatggggcagcggcagggtgggtttgtgtccctcctgtttgaggaggcactgcatcctctggggcctcagtttgcccatctgtgcagtgaggacgctgggccagctgccaggcctgctggaacacatctcagttctgggagcagggcttggtggctgggggaggggagagatgcaagggctgacgtggtcagggagggcctctgctgacccgctcctgcctgtctcccctagtgtcctctatacctgtgtccgatgctggaggccctcgaggaaggggggccgccgctgaccctgggcctggagggggagcaccagcggtccaacgccgccttggccttgcagctggcccactgctggctgcagcggcaggaccgccatggtgagtgggcagctgagtgggcaggcaggtgggtggcacctgtggagcctgcctaggagggtcccggacacacttggtctcacacaccccgcaggtgctggggagccaaaggcatccaggccagggctcctgtggcagctgcccctggcacctgtgttccagcccacatcccacatgcggctcggtgagttagaccttcctgcccagctgggaccactgcgtgtgtctgtgccccttcagattttttttttttttttttttggttttctgtttgggagataagagacaatttgaagtggtgcttaagagaaaggactctgatgtcagcaaacctccctgaccttgagctcatgaactctttctgagcctgtcttctcatctgccaaagtagatgatgataggagccactgccacgggctgtggtggggattcgctgaggtgacatcactaaggtgctgagtgcagagcctggccaatgtgggataaagtgccagccagtggtagctgctgtcactgtcactatcatcatcatcagaccctgaggttctggaggatggtgatccagtcatctgcttcttgcctcccccaaagctttcagcacccagcaggtgctcatgctgttaagccccttcagcaaatggtgggcccgctgtgtgccacgcctgttatcaagggcaagtgacaaggtcctggagacaaaccgacctcgcatcacatcccggccccagctaagggctctcaggctgtcaaacgggaatagcaggccctttcagggttgcctgaaagattccaccagatgagacagccgaaaagcccaagccattgactggtgctagtaaaaagttcctgggctgccggggtcctgagtgttgagggcgggcgcagcctgcaggggagaacgggctcaggagtgtgtgtgcggaattgaggacgggggtgggagagggcctggaggactgccttgctgccctcccccagggcttcggaacacggagtggccgggccggacgcaggtgctgcggcgcgggcccctcacctggtacctggacggtgcgcacaccgccagcagcgcgcaggcctgcgtgcgctggttccgccaggcgctgcagggccgcgagaggccgagcgggtgaggggcggggctgggggtggggccggggctggcccacgaggaggggcgggatcttggggaagggcggggcggggtcgtggggaagggcgggggcgggcccatggggaggggcggggtcgtgggcggggacgggattggtaccgcagggagaacgggcggcgccctttgacccagctcctcacctctgtcgcagtggccccgaggttcgagtcttgctcttcaatgctaccggggaccgggacccggcggccctgctgaagctgctgcaggtgaggggccaacttgggggtgggcggcaggcagtcctgaagccctgggtctggcggtgtgaccctggggggtgccaatcccctcccccttgagttgtattgaggattagatgtgacaaggtgcctgtgctggttctgccaggtgctgcagggccgtggggaggccagtcataggtcattactcatattcccgcgtgtctagactcaagtccaggcttaagaggagggccagatcgtggctaaaggtgtagactctggactcgcttgtcatgcccctttaggcactagcatatcaccctggacgagaagcggcatttccccgagcctcagtttgcctctccgtaaaatggggttgctgctaggggcacccgcttctcaggtttggttgaaggagtcattgggcctttctctgcttggggaaactgaggctgcccaagctgtcagggctgaagtggcccctaggtatcatctcccatttcacagaccaggaggctgaggctgtatccagaacctctcccatttacccacagcctttttccagcctggatttggggccccctcactatctgagtgaccttcagcaagtccccttgccctgtggccactgttcccctgtctgtacagtaggttggggcttcgctgctcaggccacaggccaggcagggtatactgaggcagatgggggcagggtgctgaagtaccttggctaggtttatacagcatcattctagttgtcagggaggctgcatctccagagatgtgggcgcagggggccatatggaagttggtggacatcctttcgggggtctgacaccaagtctttcccttggccttctagccctgccagtttgactatgccgtcttctgccctaacctgacagaggtgtcatccacaggcaacgcaggtgagaggtgacaggcatggcccctggggatgagcaggggtccctgaggtagacagtgggggcttccaaactggaggtttggggtaggaaataaatttgttttactgtgtaagaacactttagtgtacttatactcttttatacaccaaagtatactttatttaattttattttaaaaaatttttggctggccacggtggctcacgcctgtaatcccagcactttgggaggccaaggcaggcagatcacgaggtcaggagattgagaccatcctggctaacatggtgaaaccccgtctctacaaaaaaaaaatacaaaaaattagccaggcgtagtggtgggtgcctgtagtctcagctactcaggaggctgaggcaggagaatggcgtgaactcgggaggcggagctggcagtgagccgagatcgcgccactgcactctaggtctgggcgacagagcgagactgtctcaaaaaaaaaaaaaaaattaatttttgagacagagtctcactctgtcccccaggctggaatatagtggcacaatctcagctcactgcaacctctgcctcctaggttcaaatgattctcatgtctcagcctctggaatagctgggattacaggcgtgtgccaacatgcccagctaagttttatatttttagtagagacagggtttctccatgttggccaggctggtgtcaaactcctggcctcaaatgatccacccacctcagcctcccaaagtgctgggattacagttgtgagccaccacgcccagccagcattttttattttatatgaaatagagtagaatagaaaataccagtgtacgttgcacagagtaagggtaggtcctgtttggtgaagattagtctgttccaggcatatgtataagtatgtgagtactgagttgcagtgtaaaatgtgttttttaccatgtatcatgttaaaaaaagtttgaaatagtgtaaaaattacagatcccaggctggacttggtggctcacacctataatcccagcactttggcaggaggatcgtttgagctcaggagttaaaagccagacctcatctctataaaaaaaaatagaagaattagccaggtgtggtggtgtacacccgtggtcctagctactcaggaggctgaagtggaaggatcgcttgagcctggaaggtggaggctgcagtgagtcatgaagtcgtgattgcatcactgcactccagcctgggtgacagagcaagaccctggaccctctctaaaaataaaaaatctccagtcctcacatcagtctggttggggagagttctggaatctgcattttttttttttttttcttgagacagtctcgttctgtcactcaggctgcccaggctggagtgcagtggtgccatctcggctcattgcaacttctgcctcccaggttcaaatgattctcctgcctcagcctcgtgagtagccgggactacaggtgcacgccactacacccggctaatttttgttttttgtttgtttataagatggagtcttgctctgtcgcccaggctggagtgcaatggcttgatctcagctcactgcaatctccacctcccgggttcaagtgatactcttgcctcagccttccaagtatagctgggattataggcgtgtgccaccacacctggctaatttttgtccagctaatttttgtgtgtgtgttttttttttcagagacggggtttcaccatgttggccaggctgatcttgaactcttgacctcaggtgatccgcccgcctcggcctcccaaagtgctgggattacaagtgtgagccactgcacccagcctggaatctgcgtttttaaccagcatccccagaaataactatgctcacctggtgatggtccccagctggatgtacattttatagatggagacaatgaggccagagtggggaaggggtgcctagtgggcaaaagctttggagtcagactgtctggctctgcctctcgtgaccttggtgaagtcactgaacctgcctgagcctcagtttcttcactgtgtgcatggagaaggccactagccgagactgctggcctgatgacgtaaaaggcttggtgcgaagcaggtgctcacggtgcacccgcccctttctccacccctgtcccttactccctctccccttcgctgataggcctttctctgtgccccacagaccaacagaacttcacagtgacactggaccaggtcctgctccgctgcctggaacaccagcagcactggaaccacctggacgaagagcaggccagcccggacctctggagtgcccccagcccagagcccggtgggtccgcatccctgcttctggcgccccacccaccccacacctgcagtgccagctccctcgtcttcagctgcatttcacatgccttgcaatggatcagccaaggccgagaccccatcttccagccacctagtcccccaaagggcctcctcacccaccctgtggctcacagtggggccagcatactccgtgaggctgctgccatccatgtgctagtcactggcagcctgcacctggtgggtggtgtcctgaagctgctggagcccgcactgtcccagtagccaaggcccggggttggaggtgggagcttcccacacctgcctgcgttctccccatgaacttacatactaggtgccttttgtttttggctttcctggttctgtctagactggcctaggggccagggctttgggatgggaggccgggagaggatgtcttttttaaggctctgtgccttggtctctccttcctcttggctgagatagcagaggggctccccgggtctctcactgttgcagtggcctggccgttcagcctgtctcccccaacaccccgcctgcctcctggctcaggcccagcttattgtgtgcgctgcctggccaggccctgggtcttgccatgtgctgggtggtagatttcctcctcccagtgccttctgggaagggagagggcctctgcctgggacactgcgggacagagggtggctggagtgaattaaagcctttgttttttaaagaaatggcaaagccttcgactgacccttgaccccctgctccctcagcagagacggagggaggggctgctggtggtcagggacctgcactgtgtagagggagcctggctgtgtggcctggaacaagtccctccctccctgtgcgcctcaggtggcctgtctgtgagatgagaagaagaccagactgaagcctgttcaccatatgccaggcagtgctttctgcagacccccttgcagagaccttgtgatggagaattatacccatttgacagacgagggaactgtggctggtttcaagaagccatggaggccgggcacggtggctcacgcctgtaatcccagcactttgggaggctgaggcgggcggatcatgaggtcaagaggtcgagaccatctggccaacatggtgaaaccccgtctctgctaaaaatacaaaaattgttagctggacgtggtggcgcatgcctgtagtcccagctactcgggaggctgaggcaggacaattgcttgaacctgggaggcagaggttgcagtgagctgagatagatagatagtgccactgtactccagcctgggcgacagagcaagactccatctcaaaaaaaaaaaagccatgggacctgcctacagtcacaggccaacaaggtggcaggtccaggatttgaacttagagcagtcgagggcctgtgttcggaaccccagagtgagagtgtggatggggcctcctggtgtttgctttcttgcagcctagaccctggggtgtgctgtcgagtgggtgaatggcagaggggaactggctgaatgaaaacctgctgtgccctggatgctgctactgttcaggatgccacccctgccaccaggccagcccagtgggggccaactacaaaagcagccctgtcctgtgccctcaccccaccctggctttgaatgtcactgcccttctcccagcccaacccatcactggtttcatggtctgatttattggtggtgaatacacaggggcaggcccaggacaagcagcttggctactccccctctgctggctgcccgaccggcagagggggctccatgtggcaggagctaggctcccaacgcccactgttcttgccaccctctgggctcccaggctgggctccgctaggctcctgtctcccctgccagttagttaggcaagttcaggtgtggaggccgcagggatagatccaggtggctctgggctgggccctcttctcttcccagcggggaggtgctgttggcctggctgggctggcctgaatctgtttcaagttctcccttcctgcccagctcagttcaccagtgctggatccaggttcaaatgacagggacttgggtttttacaacagcgtggcaagtggtctgtctcctgggcagccatatcccagacccactgggttgaaggttctgtggggtggagggaccccaaggtgttccaagccagtggctgcactggcagcaggcctctgagagggaggcgggaagggtaggcgcggagagcaggctccattctgggtcgagtggaggactggctcccagggtgagttcacaccagtgctcccagctggcggctgctcagtctctcctgctgggcgagcgcggggggccggggctatgccatgctgctggtggagcagggggtgctctgggtgctcccgatgctgtggttggtgctgctgctctccgaggaggccggggcagccaccgccaccacgggctcccgcttgctgggggaacctgggagcgggagcgggggcaggggcggaggtcagggtcctggccagggcccctcaatccctcagaggcttcactgggctcccccgggtggatggaggggcccggcatgctcactgtgggggcctggggtactcacgcgtgtgcgagtagatgtaccagagtgcagcagtgagcagggccccgatgaggaaggcaccaaaggtgatgcccagcacggcgggcaggacgaggcctttgcttgtgcaa

SEQ ID NO: 12442 - DNA, 27491 bp, Human
  misc_feature (1)...(27491): n = A,T,C or G
gcaaccatcacctcctggattcaagcgattctcctgcctcagcctccagggtagatgggactacaggtacgcgccaacacgcccggctaatttttttttgtatttttagtagagacagggtttcgccatgttgcccaggctggtctcaaacgcctaacctcaggtgatccacccacctcggcctcccaaagtcttgggattacaggcgcgagccaccgcgcccggccggccacaacttcttaagaatacctacctatctgattttcgcccctttcctatgatgctgaatacctatctgatttttgcaggaactattttctgtaattttgcctcaaattatgcagttttctctttggacatttttacctattctgacagctcctgctttactctttccattctctttcttggaactagctttttcttttaacaaactccttccttcatcacaatcatcccactcatcatctgacactattttgagcactcctttactttctctggtgatttaaaaaataacgttcagccagatgcgtggctcaatccagtaatcccaacactctgggaggcgtaggtgggcggatggcttgagtccaggagttcccgaccagcccgggcaacacagcgaaacctcgcctctacaaaaaatacaaaatttagccgagagtggtggtgctactcaggaggttgaggcaggaggatcgcttgagcccaggaggtcgaggctgcagtgagccgtgattgtaccactgcactcccgcctgaatgacagggcgatactcagtctggaaataataacaatagtaacaatgttcagcttaacctgtgatgagtgccttgacatcatctcttcatgaagaagatccaccaaaataaaatggttacaattattagccctacaatacatcaaaaaaaaaaagaaaagaaagaaaatctgtccctggcttagccattagccaccaaatctgtgtgttcaggtgctctgtgactgaaaatcttgccctcgacctgggtctgagttacattctgaggtttgggggcttctcacaccacggaatttatcacctgagcaacttcaacctgacaaatccctcctaacgccctgctctgagacccctttaggcggtctccggagtactcagtgtaccttttttttttttttttctttgagacgtagtctcgctctgtcgctaggctggagtgcagtggcgcgatctcggctcacgcaagctccgcctcccgggttcaagcgattcccctgcctcagccacccgagtggctgggactacaagcgcgcgccaccacgcctggctaatttttttgtattttagtaggggtttcactatgttggccaggatggtctcgatttcccgaccgcctgatccgtccgcctcggcctcccaaagtggtgggattacaggcgtgagccaccgcgcccggccttcagtgtactactttccttattttattttttgagacagcgcctcgctctgtcgcccaggctggacgcaatggagcagtcacggatcactgcagcctcgacctcccgggctcaagcgattctcccgccttagcctcccaaattactgggaccacaggcttgcgccaccacgccctgccatcggctctcatttccttttcccatcctagtcttcaatcaggcgtcctttcggcgcacatttcagtgtcctgcggagctcaccagtgtccttcctccagggcctcaggggcagtcagagggatctttcccgccgctccactccctcctcctcctccccctccccctatcccctcccctcccctcccttctcctctccagaaacgtcctcgcttgtccgcctccaccgcctcccccgccagccgtgtcggctctgctccgcgcccagccggccaaccggcggctcagctctggcgcgtcacaatgcgccgtcgcggccccgcccccggacgccggacgcagaaactccgccctgccgcggtccttgcgtccttccggctccgtcgtggaagcaggactgcgccgcgtcttcctcaaggtggggttcggggggccaccgaatcgctgtcacgccggcaggtagcagggggtggggacgcgggctccttgggcttctgtttcctggtgtccagggcaaagggctgagccgggcagtagggcctagtcggggcctggctcgccgggagcaggagggcttccggcaaagccgcgtgcgctcgacgggcaggcgctgaggattggggccggcagcgcgcctgaccccgcccctcgtaggctccgccccgtgctcgcaggcgggggtttccatggtgatggtcaacaagcctcaactgcctctgctacaactgccaagttccccgcgtcccaccctcctctaggtgctccaagggaccaccggggtgcctgatacgagagcgggagtgtagagactcggaggccgaggtgaggggcggccgaagtctccgaggtcgaaggccgcacacccgggacctagcggggaccgggtccccctgggggtggggacggggggtgggatttgagattagggagactatccgaagtccagggccccgtacccggactacctggggactgggcctattggggtggggatcgttgggctggggctgggatttgggatcagggaagagcgatctgagtttaagcgccgcaaacctgggaccgagcgaggactgctcataatgaggggccgtggcgctgagatttgggtgacgggattcgaggtcgaggggcccgtacgtgggaccggcaagaactggacccactgggatcgggagacgcagcgtcggaggtcgagagccgcacgcccagacagtggtcccacgcggtgagcaccgcgggctgagattttggagtcaggaaagcgcggggaaggcacggacggccgggtgcgttagtccggccccctggcggggagctggcgactgccggagggctctgaaagtgagaacaggcctggcgcagtgggaggcccagccgggaggatctcttgagcccaggagttcccgacaagcctgggcaacatagactgtctctactgaaaagtaaagaaaaaaaaattagccacgtgtggtggcgcgcgcctgttgtcccagctactcgggaggctgaggcgggagggtcgcttgctctgaggtcgaggctgcagtgacagtgattgtgccactgcattccagccgggcgacggaaatgagaccttgtctcaaaagaagtaataatagtaataatacctgagtaaaatgaaagccgcgcgctcacgtggctgcaggcgcctgagagttgcacaagacttccttgtggggagttggctccgccctcctcccacgcccggttcccgtagccttagctctcggccccgggccctttttcctcctcggctgcgccgcgtgtcctcggagcgcggtccctgtattggtctcctgctcctagaggtatcgtgtttgtatttggggtgaaaatctgactcgtgcgcgctcttcagcttagtcgtccttttttttttccttttgtttgtttgtattaagtattttcgtcgattccgccctgctcgtaggaaacttgtggacggggcccggctcctgctgcgccggctgcccggctcccccaaccgcagagtcgtggaccagggttttgaggagcaaggcacccgactcgccctccccccaaggccgccccgggcgcgggaacccctccccctaggcgcctgggacccccgctcggctccgcgtgtgtcccggcggagggtggaaggagagccgagctcggccattgcccgcgggcggcccggggacgagctgacgcgcctctttagttctcgaaactgctcgcgggcgctgggggctcgggccggccatctgcgtggcgggacgcgaggcgcgcgctggcggctgcgcgcgaagggcaacgggcggcggcggcggcttcccggaaccgcgcggggcgggccctgcgccggggtcagggccacagcctcaggcggcagggagttctgaaagcgtagttttcagtcgttccgtcccaaaagtcatcttaattcttccaaaaatacacgcatataattctttctacttagttatatttttaaaagttaaatacgtggttgtctctgaattcctagtaagatgaaaatttcttgggttctccaggtaggtgaaagataccttaagtgctattcctgcaaagtgactcgttgctctcacagaatttataaactataaaataagacattactactttaatgaatattaagagagagattgctttattcctaagcaagaagatcttttcccttgtaggtattacattccggtgtgcattctgtagattagagtcattatcggccgggcgaggtggctcacgcctgtaatcccagcatttagggaggccgaggtgtgggaggatcgcttgggccccagagacctaccccgtctctataaaaaaatatgtattattttttgagacagggtctcactttgttgcccaggctggagtgcaatggtgtgatctcggctcgctgccgagatcctcctgtgctcaacggatcctcccacctcagccgccgagtatctgggaccacgggcactctccagcacgcccggcaaatttttgtattttttgtagagatggggtctccttatgttgcccagattgattttcaaacttttgtgctcaagcgattctcacgcctctgcctcccaaagtgctgggattacaggcgtgagccatcgtgcctggccacttttttgtaaactgccaagttttctgttaagggtagcgttataaagctttattcaggtaaaaaatggaatttatttaagggaaaagactgagtaaatagaaagttacttctcccacgtggccagaaccttggaaagcctggaggcaaatgagagcccggtgggggtagatgcctgcaggggctgcagaaatgtgacaggccctttccttggaggtgacttctctaattccctctcccccactgagctctggttctctgctcttcgggagaaccacattagttgactcttactaggtcctagaagttttactccattttctaattacatgctcaggactactccagaagggcttgctattagccccatgtttcagatgagaaaatggaggttgggagaagtcatgtgtccagggacacaattgggacttgggacccagtcccaactgggtcccaagttggaccgggacacccctcccctgccagggcccttgccctgtcttagttgccctgagctacggttcttgtggagggcaacagggtgggcagagggagaactgagctcagccaagaccaccctggcttattttacagcaaatcccagaccaataaggtctttattaataaataaatccgcagtatttctaagaacttttaaaacctaaccatgatactgctgtcatgcctaaaaatacattccaaaatatcaagtatccagggtttaagtgtttctgtattaaatttttttttttttccgagacggaatcttgctcttgtcacccaggctggagtgcagtggcacaatctcagctcactgcaaactccatctcccgggttaatgccattctcctgcctcagcctcccgagttgctgggactacaggcggccgccaccatgcccggctaattttttgtatttttagtagaggcggggtttcatcatgttagcagggatggtctcgatctcctgacctcgtgatccgccggcctcggcctcccaaagtgctgggattacaggcgtgagccaccgcgcccggcatgtattaaatattttaaacagctggttggtttgagtcaggatccaaagtcacaccttatattttgtagataactttttaaattcagagcagcactgtccaatagaaatataatgtatgctataaatgtaatcttatattctttagtggtaaaaggaaacatgattcattgtattaataatttaacctaatatatatccactactattttgcatgtaattttaaaacactttttcatttctccatgatcttgactaaaataattaaaaacaaaatcctgtgaacttgtcaaaatccagtgtgagttttacacttacacatttcaagcgtggtgaatggatgctgtgtaagtgatcatctagaggttcccctttcttaaaaggctccatcccccgttatatttgtcgggctgtcttgcagcattccttccccacacttcgcatttttctgattgtttttccgtggtggtctttgagtgtctgttctttatatttcctgtaaagtgatagttacctctagaggtagtttttggttttggttttatttttgtttttgagacggagttttggttttgttgcccaggctggagtgcaatggtgtgatcttgtctcactgcctcctgggttcaagcaattctcttgcctcagcctcctgagtaactgggattacaggggtatttttagtagagacggagtatcaacttgttggtcaggctggtctcaacctcctgacctcaggtgatccacccgcctcagcctcccaaagtgctgggattactggtgtgagccaccgcacccagtctggaggtagttttgattcagatgagagtttttggaaagaaaacttacttgaggtgctgtgctccaaccggaggcacatattggttggtatcttctcttttgtcatgttacagcagctattaatgatcattatgtagatccattattttcttaaatggttttcaaattagtgatattttaataatcgattccttttcatttattagcaggaatactttttcatgtgatcgctctaagatgtacttttgtttttgttttcctttttttttttttttagagacggattctcactctgtcacccaggctggagtgcagtggcaggatccaggctcactgcagcctccgcctcctgggttcaggcgattctcaggctcgtgagcagctgggattacaggtgtgcagcaccaccacgcccatctaatagtagagatggtggagtggcagggggtggggggtttcaccatgttggccaggctggtctcaaactcctgacctcaagtgatccacctgccttggcctcccaaagtgctgggattacaggcgtgagtcacccaccacgcccagccctccacatttttttttttcgagaaagggtttcactttgatgcccacactggagtgccctggtgtggacagagctcactgcagcctcaacctcctgggctcaggcaatcctgcctcatccccccaagtagctgggattacaggtgtgtgccacatgcccagctatttttttttgtattttttgtagagaaggggttttgccatgtcgcccagggtggtctcctgagctcaagtgatctgcccacctcggcctcccaaagtgctgggattacaggtgtgagccactatatatggcctcagttcttccttgacataaattcagcttagcatttctcataaaacattaaaaaagtacctctatactttgtctccattgatacatcagtatgagaaattgcagtgattgagtttgaaatgatcaactacacttgcattcctgaaatccaacttggtcataatatcgctttatatattgctggattaggttgactgatacttggtttggacttttgcatctgagttcttgagtgaaattagcctgtgatacttgattaattgtaaaactcttttggaaatgaaaaaatcaattccaagttcattgtagatgtaagtgtaaaaatttagagaagaacatcaacgctttgtaagttcagataactatatgggctggggctaggaaaaagatctcttgaaaatgacacaggctgggcggggtggttcacacctttaatcccagcagggccaaggcaggcggattgcttgaggccaggagtccaagaccagcctggccaatgtggcgaaaccccatctctactaaaaatacaaaaatttgccaggtgtggtggtgtgcatctgtaatcccaggctgaggcaggagaattgcttgaactcaggaggtggaggttgcagtgaaccgagagtggaatgatggtttgagctcaggagttcaagataagcctgggcaagatggcaagaccctatcttttcaaaaacagaatttttaattagccaggtatgatagcgaacacttgtaaagacatagaggatgcagtgagttgtgattgcagtactgcataccaccctgagcaagaaagcaagaccccgtttaaaaaaaaaaagccatcataattaagaaaaggcatgacagattaagactcctattagatttatcctaacggtatgcctcctgttagacaaaatgcttcacctaatacaaatacagatactcttacttactgttatatcccgataaatccatcataagttatttgattagaatagtgccatctaatagaattatgatgtttatgacaaatacatatcttttctaatttaagttggtgttagataccatatacgatcctcttaaagtacatagaattcagaagttagttttcttgtgatgtttttgtctggtttggtaacacgttgtattagtatgctagggctgccatgcaaagtaatacagactagtaacaaattttctcacggttatggaggctagaagtcttaagatgagggtgttgatagggttggtttcttttcaggcaggagaaataatgtgaatagtaggaattccagaaggagaaaaagacacagatggaggcagcaagagaagcgataaaggattagaagtgaattttcctggcttaagatccctgtagttcccattaggatattttgaaaagacacagcacaggcgtgtgttggtaaaactcctaaagtatagaggaaactgctttggaaaaagtatgtcctccaaatctcttatcttctcccccattgtttctgttttgatgtttattctacttcgttttcctttctttgaattcattactaacttttaaatttaaaactcagttttagttccagaaagtttttttttttaagttttgtaatggagtggtatctgaagttgctctttttttcctgttaaaatcattatggtttttgtctagcacttcttgttccctgaaacctgaggtgtggtatgttatttctgggtgccggagcccctcttctgtaaattgtcatgttcctttcctccttccatctctctgttctgcacaattcccccaaggcagaatgcagtggtcccctgggcagcacagctcagggccagcagtctcagctcagggcctgctgcttggaacctgactaaggtgtcatgtttccatggaggcttcaggaagaattcccatcccaaggaatgtaccttcctcagggggctgaggataccccacaggcctcctttctctccagctccagggtttgactatgcacctatttaggggctgcttgctcaagggagagaggtacaggaggtggtctgggaaaaacaaaattgatcttcctatcaattgtatttttgtttagcggaatctatacacacccatttctttggatattatttccagttactccagctaatccaaataatgatatttgccctcagttaagaacagattttatttttaggaacagaagtctagtagcagttttgctttttattaacgttttaaggaacatttaccttagatatcatgattcttgggcatttgcaaaatgcagtcaatatcaaacagcaatggttgcttgttttatgatcggtcagaatttgtcccttatattaatttcagtacaaacagtatagataaaatttatctaacattacattatactactcttgatgctttttagtaacacagcttttgagaaatgaacgctgagggaagcagtgtgttatccccccagacttagctacagcaagtaagtgaaaggacctgatagatggtaatggaaaacagctttcctgttgcatgcagatcaggacagatcccctttggtggatataaatgtagtaataatggagtaaacatttaaaatgttaatatatgctccatctgcagcttctcagtcttttttttttttgagacggagtctcgctctatcgcccaggctggagtgcagtggtgcgatctgggctccctgcaagttccgcctcccgggttcacaccattctcctgcctcagcctcctgagtagctgggactacaggtgcctgccaccacgtttggctaatttttgtatttttagtagagacgaggtttcaccgtattagccctcctgacctcgtgatccacccgcctcggcctcccaaagtgctgggattacaggcatgagccactgtgcctggccacttctcagtccttaatagcttttaggatagctctgtgtattgaatttggcacgttgtgtgaattgggttagaattctcacacttcagatacatgtgcccctgaaaagttaagtacaaatgtgtgcgttggtgcatttttttaaatggaattagtgtcttgtatcataattcttgagttcatgacagcaggaagtacttaagagtgactgaataggaattttataaaattgctgggttggaagatacttttgaggccattaaacccaattttcaatatttccaacagaaaaggaaaacatccataacaaatatggtctatgatctgctcacatactatataccatgatggggaatttttgcccccaagatgcatcttgtgcttctcatgtggtgaacagacacgagcagcagaagctgtgtcctaaaatttcttcaatctaaaggattcaccacgaaataagaatatgaatacaaagcatccagcaccaaaatgtatcccagtaaagggctttggtaaaaaatataaataatttgaacaagtgtccagaggggagataatgtacagaaggaaaaaagaataatgggcttttaacttcttttttttccctcagtttttatctttttcctatatagagatgggagtctcactatactgcgcaggctggtctcgaactctcttgggctcaagtgatcctcccacctcggcctcccaaagtgctggagttacaggcttgagccactgctcctggccagcttctactttaaacctcagctatttatcaaggaaaaaagaatttcccttctttctacatgaaattcatcactcagtgttcccactcacccatgctcctgtctgtttaaatgtcacttcctcagaaccccaatctgagctaatgcctattttctgtttttcgttcattctaaaatttgtcatcatatatttgtacatttcttgatttcctactccactgttactggacccaccaaggcaggaactgtgtctctttaccactacagttcctgtatcttttaggtgcgtagtatttcttggtgagtcagtcagtctccagactcagtcatttttctctacattacacattctttcacattcttctcccaccagtcttcctagacttgtttcattccttcccatcttgtctccatgtatctcttcccaccattcattttccagatagcatctagactgttgtgttaaaaagcaaaactcctttcacaccacattccattaaatgccttcccactggcctttgaacaccaaaccaggcctttaaggctatgtcatctcctaccattgatctcagacctagctgcagttgcacaatacaacccctggctcaagtcttctgcacacattgttccctcacaggcaggaaccctatggtgactgatcaataattaaaacttgccttgggccaggcacagtggcttatacctataatcctagcactttgggaggccaaggtggatcagttgagcccaggagttacagaccagtctgggcatcatagagagaccttgcctctactaaaaaattaaaaaaaaaattagcccggcttggtggcatgcacctgtggtcccagctacgttggggaggctaaaggtgggaggatcatttgagcccaggaggttgaggctaatgtgcctgtcacacagattcaacagttactaatcatggacagttattctccatctccccacctactactttgtggacaacttcaaacaaatccaagccatcacaaatatttcaagatggatttctaaaacttaattgctttattttataacataaccataattctgtgggttcttttatctggctggaactattctgaggtaggactggctcatttgtccttgtagtttcccacagtctacatcactatatgcagtatgttactgttccctgtaattcgtgttatttagtaagtgcattctaaagacttgctttctctcagttttacaaacagttgtattagccgggtgtggttgcatgccagtggtcccagctactcaggaggctgaggttggaggcttgcttgagcctgggaggttgaggctgcattgccatgatcgtgccactgcattccagcctgggcagctgagccagaccctgtctcaaaataataataattctgttaaaaacgtaaaacaggccgggcgcggtggctcacacctgtaatcccagcactttgagaggctgaagtgggtggatcacaaggtcaggagttgagaccagcctgaccaacatggtgaaaccctgtctctactaaaaatacaaaaattagccagggtgtggtagcgcacgcctataatcccagctactcaggaggttgaggccaggagaatcgcttgaacctgggaggggaggttgcagtgagccgagatcgtgccattgcactccagcccgggcaacagagcaagactgtctctcaaaaaaaaaaaaaaacaacaacaacaaactccaaacaggccgggcatggggctcgcacctataatcccagtactttgggaggccgaggcagggggatcacgaggtcaagatatcgagaccagcctagccaacacggtgaaaccacatctctactaaaaacaaaaactagctgggtatagtggcatgggcctatagtcccagctactcgggaggctgaggcaggagaatcgccttaacccaggaggcagaggttgcagtgagccaagatcatgccactgcactccagcctgggtgacagagtgaaaactgtgtctcaaaaaaaaccaaccaaacaaacaaaacagtcaaacatacacaaaagtagaaacaagtgtaatgaaactctatgtatacatcaggagctttaataaaaattactagttcatagcacatcttgtttcatgtatatttccactttccacgtaatctgaaacattcaagaaatcaggtatcatctgcaaatatttgtggctctaaaaagggtcttttaaagaaataaaattacagtataatgacaacaaaatttacaattctgcaatataaaatgtcactgatcatattatcgaaattgctttatagttgttctccagttcatttgaattaagattcagaggtccacaaaattgcgttagttaaaagtttaggaattgcgttaaaaaaattttttttcaaagattttttttcaaaatctttacgtgtgtccatggtcaaatgtacaaaccaaggtacgtccgctagttccattttagaggcggcctcccagagaggggctgtgtctaacttgctggcttctcttccactctgcactgcccgcccttccccgtggctggcactctggactttccccaggtcgcgctcgcgcctggctcccttcgggagaactcggagaaatgtcttcccgccgccctgactctctccttcccccacttcctgcctgggcccagcgcgcgggccacggggccgcacctgcaggcacgcgtttcccattggtgacatcttggcgggcccggcaatggcacttcctcctctgcaccccgtgacccacgtccggctgccggtcttggatcacgaggcctccgcttcccggactccggaccccgcgcctcctcggggccgacgggccagtccctggcgtggtgagccgccgcgcgggcgccccggccccgccactccagtcccggccgccccccccaggtccctttccgccgccccggtcgctcggagacggacgcagacctacgagcgcctcttcccttccctcccttcagccgcgctcggcccgcgggtccccgagctcccgcctaggcagcgctagcttggcgggccgggggagcagcccccaccccaccttgccgtcgccctcgctctcgccctcagggccccggaagcccgccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggaacgtcgccgtcaccttgtctcggggcatcggcgctgcttcccgccaaaacacgtttaccgcgcgcccgggcctcccaccttgcggaagggaccccaccaccacttggatttctgttgcaggttgagaacaaaaacatgcacctggagtttccccggagccctctgcgtggttgagcttcggtggaatttcggggctcttggctgccagccgcgcttgcctggtagcaacagaaaccagtcctgctcgcctccgtggtaagtctagagcatgaaagtccgcgggcccggccgggtggactttggtttgagagtggaactaagtgagtaatgggggcggcgcggccagacgcgctcccagcctcctggcgagagtgctgcccggtttcccgggggcacgggagtgtgtctaggaggggaggccaggatccttcctcgagtcctgtcctgaacaaaagaaaacgaggtgggtggtgcttgaacggccctgtttactctgcagatagccgaactggtaggactccggcgcgccctatttatcttgattggctctgcctgaaggcaagcgttaatcccgtccaacctgtatcactgcgaagagctcgttcgggagcgctttttggaaatgcagattcttagcccccacccagatctgttttagggttggtgttttaattatctaggtggcccccgtgcaagctcgatctgaaaacctccgggtccagtcacctgggggagctgagcagccctccccgcccccagcgctttcttggcgctgcggacggggagaccagactcttcctctgcgtgcgttggcggtgcgcagtggccgtggtctacaggcttacagcggctggtccattggggtaaatgggtgtacgtgggtctggttgccagcttgtgcatgtccccagagacgcctcagggtgttggtctgtggatcacgcagggataaacaagggcataagtggatcagatcattaagatgactgggttccaccctttagatccttgaacaagtcggattgttgaagccttttgaaaacctgattccagagtacttgaaactgtttcacccctgaataggtttcctaataaatgtaatgctttccatttgtacacccccccaatagtgtcttaagtaataatcactggaagtttgcaagacaaggcagatttgattatcttcatgttaagacaacaggttcagcataattagctggttttactaattccacatttccaaaactcaagcagcttagttctcagaattccatagccctcagcccgtgtcctagtcctttggggcagcgtttttactgggatgttggtgatctagtgattatgatgtatgttctagtgaagcatatttcaaagaagttacccaataaaactgaaagtgtcttttggatgtgtctccacactgcttacagaggggttcctataaatcagactgaacaatttctagcaagcacccttgctccttgcccatgctatcccagtgaaagaggggtcttaaggtcaagtcccctgtggttgtcacttctccccccacccatctccctcccaagtgccctgcccccgatatttaaatttcctcccagcacttagggtcctcagtgtacaaacttagaattgggcagaggcgggcggatcacctgaggtcaggagtttgggaccagcctggccaacatattgaaatcccatttctactaaaaatacaaaaattcgctgggtggggtggtgcacgcctgtaataccaggtactgaggcaggagaatctcatcaagagtaaatctcatcaagatcaataaggcgtttcccttttgttgtgctctgtattgccctgtgaaaagataatacttccaaaatgctgttaggtggatggggtgtgagatttaatttaaacccacgggctatataaagggcttcccagctgtttctgtccttacctggagttctgatcccagagccagtgcctaggatctgagaccacacagccaatatcgctctgttttttttttaggacatttcattaccatccagaagtgtctcccactgaaggcatccgtggttgtttttaaggtaagctattttaagaagagccccttttcagctgcagtatttatatttgttatactcaaatttgtttagcagcctggagtgaaaaaagttttgtccctaacattaaccttgagcaggacaccacagggctcttttcagcttgagttttagttaatgaaaagccttaggacttctgagaaatggaacagaaaaccaattctggagtaaaaataagcagtaagtgttttaagtgtacacatgtgttttggaaaggaatggtctcttcgccttgccttcagagaggaagtaattttgcttctgaaacatttcctgatgcaaaacacttatgacatgtaaaagattaggcattttaagtaattcttctatgaaatgtttttattttttatgctgcttgtatgtctttttcagcctagccaggccactgccttcttgaggaaggtgttgacccccctacacatgggcaacagttaatcctggctaatcttggaccagctgggtcaagtctgtgctgaggatggggtcatggtggccaacaaaacaggcacaagtttctccccagtaggctcctattgtgggtttaagacccctttaacaacacaagagtgctgtggttagtgtagagcatgagacttaatttggataatgagaagacctttgagaaaggtggtgtatttgagcttagaccttaaggattagtgggatttaggtagacagaaggttgaacagagtatatttggggagagaattaaccatgagtgtcaactatgtgcgtcacatccctgaaggggcagagagcttgccacattccaggagaaaaaaggaagtgatgtgagcttaggtagaagagtgttgcaggcaaaagttgcaaggcctgagggaccccattgggcctgtggtccttgttctgaggtcagtgggaaaccactgaggacttggatgcaggacagtaatgagttttaaaagtacacgtgagccgtagatgggattgcagtaaggcctagccactgtgcttggaaaacttttttttttttttgagatggagttttgctcctgttgcctaggctggagtgcagtgacgcgacattggctcaccgcaacctctgcctcccaggttcaagcgattctcctgcctcagccttcctgagtagctgggattataggcatgcgccaccacgcctggctaattttgtatttttagtagaaacggagtttctccatgttggtcaggctggtcttgaactcctgacttcaggtgacctgcccgcctcagcctcccaaagtgctaggattacaggcatgagccactgcgcccggcctatgcttggacttatttaaaagatatatcggtaatctggaattggctgtttgtacatacaggaattagaataggagaaataacaatatgaggtacagaaagaaaatgacaatttgataactcccattacaaagaaaagaattactgagttcataggctgccattcaacgtgttaggaacagggtagagctgtgaggcacctttattgctgaggaaatggaagagttgaataggatttagggatgaggatactgtggagaatgggatcacccaagggagttgagttgattggatttgagggcttgggagaaggtcaaggattactccagtttccttctagagcctctgggtgcaggtaggggcagtcatgttgctattggagtgtgacagaagagagaatgtgaggtttagttgtggcacagaggagaacctgtggagtggagttgtgtctacccgtctaggcttcagggagccgaagactgggggtttgtgtatctcctgaccctggagatgattatggagaccctgggagcaggtgagtccactgagaagaggacttgggcccaagcctgattccctacagttaatggttaaggaaggactcagagactgtctaaggaattaactggaaaaccaacagtaattgccaacaggagtgaaagggagaggatttccaggaaagaatggttaagtaagatgaagataaaaacatttgctctttttcttgccatggagatctgtatagtaggatcatgcagtttttttgtttgtttttgtttttgagacgagtctctgtcgcctaggctggagtgcagtggcacgatctcagctcactgcaacctctgccttccaggtccaagcgattctcctgtcccagcgtctggagtagctgggattactggcgcccgccacgacgcctggctaatttttgtatttttagtagagacggggtttcaccatgttagccaggatggtctcgatctcctgacctcatgatccacctgcctcagcctcccaaagtgctgggattacaggtgtgaggcactgtgcccggccaatttttctgtatttttagtagagacagggtttcactatgttggctaggctggtctggaactcctgacctcaaatgatctgcctgccttggccacccaaagtgctgggattacaggcgtgagccactgcgctcaacctaggtgtccaccactatgctcggctaatttttgtatttttggtagaggcgggatttcaccatgttggtcaggctggtcttgaactcctggctccggttatccaccctccttgacctcctaaagtgctgggattacaggcggtgagccaccacacgtggccttgatcatgcagttttaatggaggggagtggaagtgacagtagaggccttttgacaagattttgctgaacaaatcaacaagtagctagaggcaaagttggcacaggggaggtatgacatgattgggtagaactgagcatgtttaattaccaagtagacagggctcagtggagaaaggggaaaaggaaaaaaagaagaaagcatggctccggggtatgtgaggttggacccagagcagagctgttgttcacgatgtccgctgtaaggggcccactacgtgcttacaaactcctggactctgacttgacttcacaaagtccacttccaagagtaatgtcaaccagctggagaggaggtgagagtctgtaaggctgccccagacatctgaagggctttggacaagcagggtgctggggtaggacagtgggcgatattgagggcccgcttactctatggctgttcactctgattttcttttttttttcttgtgtggtgggtttttttttggagttagtctcgctccgtcacccgggctggagtacaatggtgcgatctccactcactgaaaactccgcttcctgggttcaggtgattctcttgcctcagcctccgtagtggctgggactacaggcgcccaccaccacgtccaggtaattttttttttttttttgagacagagtcttgcactgtcgcccaggctggagtgcagtggtgcgatcttggcttactgcaacctctgcctcccaggttcaagcgatgctcctgcctcagcctcccaagtagctgggactacaggtgcccaccatcacgcccggctagttttttgtatttttagtcgagacagaggttttgtctattggaactcatgatctcaagtggtcccacccacctcggcctcccaaagtgctaggattataggtgggagccactgtgcctggcctcaccctgatttctacagtatttcacaacttgggggcagcattagccaccagagaacatttgggaatgtctggagacattcggttgtcagaactggaggtggagggtgctactggcatctagtgggcagagaccagggatgcagctaaacatcctacagtgcctgggcctgcctccacaacacaaagaactgtctggtccaaaatgtcagtagtcctgaggctgagaaattgtagcttagaggcaccgtttcgcctggctgtgtgcagctgagccactcagtacatccatggagtagtcagatatttgtttggaatcttccagagctctggttttactgggcgcgtacagttaagaagttcattgaatgaattccatgtattgtgaggaaggaatgtaaaatgatacttgctctaagctggattatgaagaatgaggagagaaagaggctgtgtggataaggaagccaaggtctctacaaaggagggggatagcagttgtggtggagggagtaggatgtgattaggtggggtttcctgcagggaatggtgaaatcattggaggtaggagtccaggagaaaatggttagtggattatggcttcatctcccctacccggaacgatggctggacctaaggctaggaacagaactcgagggaggccttcagatacttttcatgagtgaggagcaagaccagggtatggtcaaagacaaaaggacaggcggtgcctagcctgacccagtgttgggaatggaattgcataagaagcccccacctgtaattgagctgtcccagacccattatcccaagagacacaatacaaacttgccctgactctccaaggaggagcttctgaactgttagcacagaattccctccgtggacaggagaggaagaatctgctgtgaccttgctctgccagatcagcatgttgcagtggccatatgcaggggatttagataaggccctggggaggcggagaccattacttttctaaggtggaggctaaaccccagggtttgttgcagacccaaagcacagtttgagaattggggataggatnnnnnnnnnnnnnnnnnnnnttgagaattggggataggattatttatgcccaatcatttgccgttcaggattattttataaaagttgatggagtttatgtacatagtcaataatttgaggtgggcaatgagcaatccaggttaggctccccttgactctcttcccagaggcttccatgttccactctcattagcaagggtgacatcttttagttaggctgtatactttgaaagcccttgcattccaaatcacagttcgtgagtaaatgccgagtgtttggtcttggtgatgtgttcaggatatcacatactgttctgtttcatttgtgccattatgcttgttattgggagaggagacacatcttgttatctttataatctggtgtagacacaggtaaatttgaaagatttacacaattatccttttagacgttgtcaatttgaaatgatgaagcactgtatgataatatgtcattatctgcaatggctacatcaaactttaaaattactaattttccctgaagctagtgcagttgagcatttatttagtatgaatttgcttttccttttcttaaattacacttacctttactttttgtctgttttttaaattgtggggttttcttatggagcttttttccccacatgatgagcccatatttcttgaaaaggccaccagctatatctattatgcttgatgtaaaatgacactttgaaacattcgatttccagctgtgcatggtggctcacgccagtaattccagcactttgggcagctgaggtgggcggatcacctgaggtcaggagttcaagaccaacctcgccaacatggtgaaatcccgtatctcctaaaagtataaaaaattagccgtgcgtggcggctggtgcatgtaatcccagctactcaggaggctgagacaggagaatttcgtgaacccaggaggcggaggttgcagtgagccgagacagcaccactgcactccagcctgggcgacagtgagactcttgtctcaaaaaaaaaaaaaaaaaaaaaaattccatatactcctatgctctttttgagcgtcacccttgacagtgttcatataaaaatacgtctttggccccatgatactgcagtgtttttcttgcttgtgactatgttatagaccctgctgtctaggtcagctgctcctctttctcagaagactgccttccagtgtgtggttggccttactctgagtttggacttcaggtgccatgtaccaccctggtgggaagggcatttctcagccctcttgcgattgccctttcttcccgatgccctcttccagatcttcagcacaaggcagcaattctgctatattttatgtgaacctgtgaatcatctgatctggtttctccatttatttgcagtgcacataactaagtctgctggtgaatttgtctgcttgtctgtatatgtcatcagtttggcctcatacttgactggtatttagtttgaattgacaatttaggagcaaaatcataactccatagacagtggaagccattgctgtcttgtatcctggcaacattactgctgatgagaacactagaaaatcttaccctatgttgtggtttaaaaacagcctgctatgttcccatcccttatttttactcatgaaagtaaaagtatcctaccatagacaagcagatttactaaatttactattttaccaaatgtaaggcgtatagtttaggaggaacaactcaggagctcttataggtgaactgccacatattatcatgacaaatatgtggaataaatataacaaggaaatgcccttgctctaaactgactgaaacttacatttctctgtgttcaaggcaccacattcacatgcatcgtcctgtcttgtaaactcctgatttgtttttcaaactgcctgtgactgataatgtaattttttgagagacctggagttaactcttagctctcaattgtatttggtatatttcttaatgtcttgctacctctctcgtctgtaaaatggggaaaatttctgttgcatactaaataaatttttcttttttttttttccagccacaaaaaagccacacccaagatcacctgacacccaccctgacaagtgtccatgatgctgggccctgagggaggtgaaggctttgtggtcaagctccgtggcctgccctggtcctgctctgttgaggacgtgcagaacttccttctctgactgcacgattcatgatggggccgcaggtgtccatttcatctacactagagagggcaggcagagtggtgaggcttttgttgaacttggatcagaagatgatgtaaaaatggccctgaaaaaagacagggaaagcatgggacaccggtacattgaggtgttcaagtcccacagaaccgagatggattgggtgttgaagcacagtggtcccaacagtgccgacagcgccaacgatggcttcgtgcggcttcgaggactcccatttggatgcacaaaggaagaaattgttcagttcttctcagggttggaaattgtgccaaacgggatcacattgcctgtggaccccgaaggcaagattacaggggaagcgttcgtgcagtttgcctcgcaggagttagctgagaaggctctagggaaacacaaggagaggatagggcacaggtacattgaggtgtttaagagcagccaggaggaagttaggtcatactcagatccccctctgaagttcatgtccgtgcagcggccagggccctatgaccggcccgggactgccaggaggtacattggcatcgtgaagcaggcaggcctggaaaggatgaggcctggtgcctacagcacaggctacgggggctacgaggagtacagtggcctcagtgatggctacggcttcaccaccgacctgttcgggagagacctcagctactgtctctccggaatgtatgaccacagatacggcgacagtgagttcacagtgcagagcaccacaggccactgtgtccacatgaggggcctgccgtacaaagcgaccgagaacgacatttacaacttcttctctcctctcaaccctgtgagagtccatattgagattggcccagatggaagagtgacgggtgaagcagatgttgagtttgctactcatgaagaagctgtggcagctatgtccaaagacagggccaatatgcagcacagatatatagaactcttcttgaattcaacaacaggggccagcaatggggcgtatagcagccaggtgatgcaaggcatgggggtgtctgctgcccaggccacttacagtggcctggagagccagtcagtgagtggctgttacggggccggctacagtgggcagaacagcatgggtggctatgactagttttgttaggaacatttgagttacttcaatcattttcacaggcagccaacaagcaattaagagcagttataatagaggaagctgggggacccattttgcaccatgagtttgtgaaaaatctggattaaaaaattacctcttcagtgttttctcatgcaaaattttcttctagcatgtgataatgagtaaactaaaactattttcagcttttctcaattaacattttggtagtatacttcagagtgatgttatctaagtttaagtagtttaagtatgttaaatgtggatcttttacaccacatcacagtgaacacactggggagacgtgcttttttggaaaactcaaaggtgctagctccctgattcaaagaaatatttctcatgtttgttcattctagtttatattttcatttaaaatcctttaggttaagtttaagctttttaaaagttagttttgagaattgagacacaatactaatactgtaggaattggtgaggccttgacttaaaactttctttgtactgtgatttccttttgggtgtattttgctaagtgaaacttgttaaattttttgttaactaaatttttttcttaaaataaagactttttcacaatgactggcacagattactcagcaaaagatagcaaaacgggtggttgaagataattcattttaatcgtaatgtattttagtgtgaatttaaaaatttcatacatcaaatctatgatctcccttatattcttatgatgaggctaaataaaagtctaataaaaatgttaaatatgtgaatggtggaaatggtgactagcagcacacattctgggaagcatcaaatagacacacggccccagccacctgcaacttatgtgcactgttgtaaaccattcagaattttcctgctaggcccttgatgctggagtcacatctgttgatagctggagaactttagtttcaagtactacattgtgaaagcaattattttgtttctagtttttataaaatgctgatttaaacttttttttttggtcacgctcctgatttctgtagggcgcatttgttaattaggttatgacaggatacacattatcaagcttgagacccattttcaaattgctatctaccttggcaacagcaatgttgaaattcaggcagctctatatatagcatacagtattactatcattttaaaccttatgctaaatacaaaccatcaggactttaaaatgtggagtttatttaaaaccattctgtgcaaaaatgctatctaccattgggaattcttcaactttattttcccacttcactagctgtataatgtaacctatatgttatgattttaccaatattaagggtcttcattagtatcttaaagagtaaataaatgctcttggtaaaacccctgagagctgcattaaaaattaggtctgtgaagtcttcagccttttctagcctcattgggcttcagaggctcaccttaggtacagcccttcgttccagtgttctgcatgcttatgttctgcatgcttggatggcctgatgtgagggcagcagcatcaccaggaatggcagggtacagggacgcagaaagaggcactcggaagactggcatgggggaaacctagggagaactgtccttgctgtaaccctgatctgggatctctgcccacccatgggcctaccatgcttcaagtgtcagcactgcatggggaaggagaggcctgtaggtgagggagacccacagaaacaggtggagtttccgctggaaatggggctggaatgccatgaagatgagacctcagatttcgtagagtggtggagattcaaagagtaccttcacaaccctggaagtctatgctagatttaggatgcatgggtggaaagggctccaggggatgggaaagggaatgtgttagatgacctgacatcccaaggtaacaacataacatggacagcaaaacatccccttgctccaggattgttaacttttgttggggagggacaagtctctctctgatgcccaggctggagtctagtggcatgatattggctcactgcagtgtcagcctcccgtgctcaagttatcctcccacctcagcctctcaagtagctgggactggaggcgcacaccgctatgcccggctgatttctgtattttttgtagagatggggtctcactatgttgcccagactggtcttgaactcctcagctcaagtgatctgtattcttcagcctcccaaagttctaagatttcaggcatgcaccatggcacccagccatgcccatttgttgctacacacagccgtgcccatttgttaatactgtccatggctgcccaggtactacagcaggcagagagatgggtagttgtatcagagaccacatggcccacaaaacctaaaatatttactgacactacaggaaatgtttttcaacctgtggccttgggcatgactagggcattccctgcaaggtaaaagtcaagatactgcatcttgttatgttgtagaaccccaaattcaggcttgcgtacctgatgtgtagctgatgccaaacaccaagacaaaggtgcttggagataaaggtttatttgatttggccaaggtgagaaatctgccttaacaaaaagaagcagcgtggagtttttttgtttgttttgtttttttagagatgggggtctccctatatcacccaggctggagtgcagtgactttgagagagtctcaaagtgctggggttataagcgtgagccaccgcgcacagcctcagcatggaagttttgacctccgttttcaacctgggccagttcacccctccttaggcaacgtggtggtcctccactcctgggaggtcatagcgaggccgaacttgctgcagatacccaatcgacatagtacactacagcctcggccttccaaagtgctgggattataggcataagccaccatgccaggcatggggagtttttacacagctagagactaagggaggggcagtttcagagaaccgaggggggaaaa

SEQ ID NO: 12443 - DNA, 11858 bp, Human
tgatattaatattccacagatattacattactgaggcacactaggctaaggctgacaacaccaaatgctggcaggaatgtggagcaacaggaacaggaattcgtggctgatgggaatgcaaaatggtacagctactttggaagaaagtgtggcagtttcctaaaaaactaaacatactcttaccatacgatccaggaatcatgctccttggtatctacccaaaggagatgaaaacttacgtccacatgaaaatctgccgatggatgtttatagcagctgtattcatcatggccaaatcttgaaagcaaccgagatgtccttcagtaggtaaatagataaataaaccatggccatcctgaaatggaatattattcagtgccaaaaagaaatgaactacaaagccatgaaaagacatggaggaaccttaaatttacattactaagtgaaagaagccaatttgaaatggctacatattgtacaattccaacgacatgacattctggaaaaggaaaattatggaaacaggaaaaagagcagttgttgccaggggttagggaagggggattgactaggcagagcatagaggacttttacagcaatgagactataatggtggatacacatcattatatatttgtccaaacccacagagtgtacaacaccaaaagtgaaccctaatgtcagctatggactttgggcgattatgatgtcaatgtagcttcatcacttgtaacaaatgtgccattctggtggatgtgtggggacagggggcatacggaaaatctctataactttcctctcagttttgctctgaatctaaaactaccctttaagaagtcttcttttaaaacaatttacaaagcatgaggtgatacagatgtgggagtttggctcctgtctctgcccaactctgtgacattcgataaattacttaacatgtctctgtttcagtttcctcatctataactgggaaaaataacacctgtcttatagagttgccatggggatgacatgaggcatgtgtctcgttcatatcccatgctcagtgaattagtagcagcagccactgtgtgtttgtgtgtctttatccctcctgggttaatgagctccttgtgggcagggactcacccattctgtaaccaccccatctaacacactgcctggcacttgggctccgcagaagtttgccgagtgaatacttagtaagccctaacctaggcttttctctctggtggacatttgggttgtttctagggtttttgctatgaataaaacacatttcaaagccctttgtggtttttttggtttttgtttgtttgttttttcttcgtttgatctgctgactctgtgaagcaggcagaaaggggatatttgctcttgtccacaccctggtacagatggaataactgtggctcagggaagtgaagtgactcctatgggacacagtgcaaatcagtggcaataattagaacccctgaccctgcctcccttcctttagtagatctattttccttctagctaccgccttctggatccatggcctctccaaaactagaccatgatggtcagcctgacctgagagcagcacctgcacgcagagacccatgttgaaggtggtgagctgccagctaccagatggccctctgaaaccccagggaacctagcaccttattctcaaatacatgagggcttgtattttcccccaggaaggagcttcttaggaaagagccagcgtgccagctttgtttttctttcttcttctttttttttttttcctatgagggggtgaggagccaagctctgagttgtccaggaggagggactttggctaaaaatagctatggcgtgtggtttggatcaacccctagtggtacccaggactggggaggggagggggatgctctggagctgtcgccagactggttgccgtggaaacaagagaggagcaggggagcctgggaagtagggatgacacagatagcaagtcctagtcagagctgccgctacatttaggagaaacagcggtgtctgcggctcccacccttcggggggcccgtggggggggcggtgtcaggggcatggacgccaccccccaggggtctctgctgccggctactctcctctccacgtgctgtgagttgagttgcgggggacttggggtttgggcccctatttccaaggcaagtgggggtttgggaggagctggttcttgggggagttttcaccaggtctctccttccaaaaaatgagcccccttactccccagctctctagagggaggaagaggggcccaggaaaagtggtattgcaatcttctgcaaaggggtcatagcatgcacaagaaatgaggagtaggttggaggaactgaaattcttggagggaagatggagaaatcaagtccttgatcttgagatagaggtaacaatttcacacttttccttcccctgagaaaagtgcagtcccccactcaggaagacaggatgtgggacacattcaaaataaggtttacctagatccctggggcaatggagagtgagagagttctgggggtgatccgacatcggggttccttccccatccctgggcagagagatctgtctaggcaagccgactgggggtcagattacctaagaccctgagagaacatctggaagcccacctgggactaaagctaggataatgggagcagggtcgttttctgcatgacctggggtctctgagccagtcaatgcttactcttcctgaggacatctgagcttcaggaaaggaaaaggaagcccattgttgggggcaggggaaaccctaatcttccattgccatggggctcttggaccctgtgtcccctgactccatggacaataaatgcagggggtgcccctaagctcaaagccatttcattttgatttctcttcctaccttctctaccccaagacacacaaacacacacacacacaccctctccagagtgctgactgcagaggacctcaccccagaacataagatgctggagtgctaggtttagagtcacatacccaggcagtttctccccaggacctggtcaaccatccaggccatctgtggttcctatggcacactcctccatcccccacccactagccagcccacgtttccgtggagtgggaggagaggatcattcccaggaaagagaagggaaggtggaagagtcccaaatcctattctaaacctttccctgtatggtccatatctcctagaggaccctgggtgctttggggaagggctctggacctctctcagagcagattgcagctcagagagctcctcagaggcaagcatgtgaagaaaaatcaggtgggcttcgcttggaatgtgggctttggggcatatggcaggtgggggcggggctggtgttaggatagtccatgggaagtaagaggctgggggaaaatataactagagggagtggggaaataaatgtgggtgcttagtgcttcacctgatctgattccatgtctctcatgaagaataggatcccagagggatacgagcctaactctttataactctgggcttcctttcccaggcttctgtgttgggatcttccagttcccctccccatttgcaggctgtctccactaggagaaaaaacccaagggaaatgaggctggcccaagagcagcagtgatcgtgggtaggtctcagggaggatttctagtgggaatttcctaatgttccacccttgtgcactggagggtttccactgactttccacagctttcatttctttctcgtttgtaagcatgttgaggggagggaatggagcggagtgagtgaggtccaaggagggaagaatgagaaagactgtgtatcagtcttggggtgaacttcaaaacagcctgcgaggagagccattggtggctgcactggctacagctggggaagggatggtggaagtccttagggcagggagggctccattacccgcctgcccccctccccaaaaagcccccagtctattgatttcaggaaatcactagggggatctgggcctgggtctttggccccggggctgcccctgaggtgctgcacaccccagctggaggtgatggcaccaaaatatctggtacctccttcccctgaaaatcatcgtggaacttgcacagttctatccagttcaggtacatcattccatttgaccctcacaactttctgagcctggggggcagttagggctgaatgtgttattcccagaaatagaggccaggcaacacgaagggactcgcccagggccccccagggctcggtgctggccctgatgccccgtgcctccccatctcccgaggggccactcattcggcaaacctttattaagcccctccaggacccccgacgccgcctaggcgcccagcgacgcgcggcaggtggcagcagctcgggcccccgccgcactccaggcgcccgcagcgctcgccctgacgcggccgccatggcgcaggagaacgcggccttctcgcccgggcaggaggagccgccgcggcgccgcggccgccagcgctacgtggagaaggatggccggtgcaacgtgcagcagggcaacgtgcgcgagacataccgctacctgacggacctgttcaccacgctggtggacctgcagtggcgcctcagcctgttgttcttcgtcctggcctacgcgctcacctggctcttcttcggcgccatctggtggctgatcgcctacggccgcggcgacctggagcacctggaggacaccgcgtggacgccgtgcgtcaacaacctcaacggcttcgtggccgccttcctcttctccatcgagaccgagaccaccatcggctacgggcaccgcgtcatcaccgaccagtgccccgagggcatcgtgctgctgctgctgcaggccatcctgggctccatggtgaacgccttcatggtgggctgcatgttcgtcaagatctcgcagcccaacaagcgcgcagccacgctcgtcttctcctcgcacgccgtggtgtcgctgcgcgacgggcgcctctgcctcatgttccgcgtgggcgacttgcgctcctcacacatagtggaggcctccatccgcgccaagctcatccgctcgcgccagacgctggagggcgagttcatcccgctgcaccagaccgacctcagcgtgggcttcgacacgggagacgaccgcctcttcctcgtctcgccgctggttatcagccacgagatcgacgccgccagccccttctgggaggcgtcgcgccgtgccctcgagagggacgacttcgagatcgtcgttatcctcgagggcatggtggaagccacgggtgcgagcaggcctggggaggggagcggggttggcagagggtgggcgggaccgaggaaggcaggggcgagactaggggccaggggagctggggaggatggatggaggggctggtggaggatgagacagtgaggtgagacaggggtcggaggcgggagtggaaccgagcaacgccgcagaaggccaagagaaagcttggaggaattctccgaaatggcactggcgtggggccctgggcccagaggaatgtgtcacttggaatagggacagtaataatagctagtgctcgcccagtattcaccctgtgtcatgcgcagttccaaagcactttctacctctgagtcgatttaatcctaacaagaaccctctgaaggtaacttcttgttattgtgctcactttttagagatgagattgctccaatgagaaattaaggaagttgtccactttcctaagccaataagtggccatgcctggattggacacaggcaatgtggcttcaatgtttagtggtcccgagttggaaggaggggttaggttcaggggttttctcactgcagtcaggttcaggcccctggaatttgacggtgaaggttttccattgcctgagttatttctaggccggatcttgaggggagtttaatacctagtctcacttgtacctcggtttcccaattcatccatttccactgacaagggatatagatgatgttaccttttctagctcttttccaaaaggaactggcaactcatctgtgatgtcaataagtccaacccagacctacacagtgaaggctttgggagcaggtgaaaaaagaccagtgttacaggagtcgcaaaggaggtcacttaggacttgagatctagaggatagatgaggatgaggaaactgcgggtggaggaccaaaggcccactagggggcgccgcagtccctcctctgacgccagagctgctgatgctccctgccggcttcgctgacaagctggtgccttcagatcctttccctggcccctttaggctgagactccgcttcacaccccaaccccagctccgcatcactgttcccattcctgcttcaccccgactctttcctcttcccccactcaccccgttccctttcctctctctccagctgtcactccttttctgccagtatctcaggcaggcccctcaccctccagggaagttgctgcccggccctcttttctctttgtacccccagccctgccctctcctcctcgaagcccttctctccccagtgtcccttatgcctctttctcttctctcccactggatactttctattccaacttcaccgaggaataccaatgtctcagcgccaggctttccgagttgacagccactctccggttagctaatgttcactcttctgtttccccttgttccgagatggatatgggttgggggcaagaccctgtggcagaaaggagaatgacctgccctgaggggtgcaccagcccaacaggaagataggacacaagccccgggcagggaggaccaggacagaggagatgaggataggaatctgtctgtttttctagagagataaagctggaaaggatggtaatattttgggtgagacagtcaggattcaaaacgcttttgaaaagcaagaataatgagccaaaacccagcaagatgacatttaaaatgaataaatataaaattctacatttaggctttaaaaaaatcacttatgtaagcacagcatggaagagcactggtgaaaaaagaactgggagttttagttggctacagtcttgatgtcgtagcaatgtgatgcagcctccaaaatgattatgtaatgttatcctgggccctattagtgaaagcatcatggccagaagagagagatggtgcgcgctctcttatgcacggagcaggccacagttggaaaatttactatactcaaaatgcttaaagggccctccttggccattctggcttgtaatcaaaaaagtagagttctggaaaaccaggtcaaatgaggaatcgtggaggaagccagggatgttaagtcaagagagaaaacatgagggaatctgagactcctgttttcagatactcagaggactgtgaagtgggaggggaatgaagccaagagttggaaatcccagggtacaggttttagctctgtataaagaacaacccaactattagagctatcatacaaaggagtgggccctttatgaagtggtgagctatcaatcctgggaggtaatcaagtataagctagatgcccattgttagaaatgctcctttggggagccctgtatggagtgagaagttggactagaggatccctaaggttagtttcaaggttaagctttttttggttggcatcaccaaatgacaggaggggaaaaaagagctggacattaagaggagttggggcaaatggagaagacacgagggagctgggtaagaacaggagctagggagggggggaaatggactggaccaaagggaggtgggagcccttaggaaggaatagaagggagggtgctgggagtagggttgtggaatgagaagaggagagggaagcctggagctgagattccccctgaccggtgcccctcctcccaggaatgacatgccaagctcggagctcctacctggtagacgaggtgctgtggggccaccgcttcacgtcagtgctgactctggaggacggcttctacgaagtggactatgccagctttcacgagacttttgaggtgcccacaccttcgtgcagtgctcgagagctggcagaggctgccgcccgccttgatgcccatctctactggtccatccccagccggctggatgagaaggtggaggaggagggggcgggggagggggcgggtggggaagctggggctgacaaggagcagaatggctgcctgccacccccagagagtgagtccaaggtgtgaccagcttcctccagacccctgtggcagaccgggggccagacacagatacatggggaactgcatatcggaggtggtggaggaggaggaggaggaggaaggcaaagcccctggaaatgtgctaaagttggaaagtccccgtcccccagaacctcaagtctagaaaccagtatggaagggaggggtcctgatttcagggaaatggagggtggggccgggtgaaaatgccagtctgtgtttgaccttcacatttgttcatgagtggatggatggacagaatgatggacttttgggggttggatgggaagatggtagcagataaagacagctgacagatacatagatggaccagtagacaactggtccactcagggctgccactaacctgtagaacacccctgtgcaaattttaaaaaggaacccttttcctccagacagatacagccccaaaccagggtgcatggcttggggagcagagtataggatggattgcagtccccagtcacctcttctgccagcctccccacatatggcacaactgtctaatgacacggtaggccaagctgaagtgaaggagaaaggagccggaccaagatgggcacatgaggagggtgccctcctagctccaccctcaccaggatgaaggcgtgcaaggggctcagcaaggtgtgaatgaccttagtccgcaagttcagggaagcaggcagagcggggaggtgcctgagctggggcctggagaggggcctgggaaaggaaaaccagggatagctattttcttacagtggagtgagatcttacaggtatcaggcacaggcaggaagagagagagagaggttctggggaggaagggccaggagagagatctagaaagtgggttcactagagctgggaaacagggagcccctaggaaagcagtgtgtccttggggcacagtcattcacatcactgattgggtgccatgtggagtggacattcaaaaacctggttcctgtcctcaaaataaggggcacctgggaaaacagaggaatctacctgtggtgactgaacgagggataattcaaactgacaacctgtgcagtcccgtggagggtaggggagtgtgggtgatcagaaggctggggccagtgtaaggcatagggaatatgtaagtcaggagttagaaatctccagtgtgcgttggaatcacctggagggcttggtaaaacacagatttttgggctccactccaagggtttctgacccaagaggtggggaccaaaaccatgcattcctaagaagtccccaggtcatgctgctgttgctggactgaggaccacactttgagaacctgtgctctaagtgaatacttggaagtcgtttcaggacatggggcatagaaactgaggagtagctgagaggaagatgaagagaagctgagaagaagctgaggatcctcacaggagcagacagagaaatgtgaagggtggggttttatgtgtgggaaagggacccgaagcccaggctgaagagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccacacctctcctcgccactgtcaccactcagggcaccactgtacagtgcaacaagtcaggagacctaggtcctactcctgacacttgctaattagctctatgactctgggcaaatcgcatatctgggcctcagtttcctcatctgtaaaaatgacagcaaactcgtaatgctcaataaatgtttaaataacaactgaaggaggcctgccagatgcctcttaaggtgccgtgcaggtaagaattttaggatcagagaatccttaggcaagaaaattcatgaaactcctggggcactggaggaggggtgaagctgaagggtgggagggaggagaccccagggtaggtacaggcaggtgaagcgggtatatgcaggtgtagtgggtatatgcgggtagagggtatatgcaggtacagcgagtacatgtgggtgcaatggctctgtggacacacaggccctcccctgactgcctgttgtcccagcctgagtatcagttgtgttctgaggcttctattctgctgctatgggtcagaaggaacaacaatttcagccccagggcctagtgggaggagtcaggtccaagactagcctgaccaggagaatgagacgtgggaagagttggggaaagtctgggaagctcagaaaaggcactgcccctggaggcccatgccctttaacatgggagaagctggtgcgggggtgaccacaggcagctggaacctaccctccttttctatgcttccctccccaagtaggagtccaatcaggagttgtctcagccccgacagttcaggctgcagatggaacccaggtgtcccctcctggggtgggtggcatggcccatggaggccagatggtgtttgtggtgggaagagaggcctgggtcatccagaataggttgtcaatccccaaccacctccctactatgcaccctgagcgttttacagtctcatggtagggaagacacagccaagcctgctttttataaaacaagtttattcacattttagaaaaactaattccaggacaggaaatggcctccctataggatccctaaga

SEQ ID NO: 12444 - DNA, 41696 bp, Human
  misc_feature (1)...(41696): n = A,T,C or G
tggctgttagattatttttccacagttttcagaagtggatgaggccattagaatcttgagtattgcccatttccttatgtgtgcctttgactatagataaaatagatgcatgacaattatttataagttgattgatttttcttgtcatttaaatcatcttgaataatagagttggtagagctatcccatttttgaaattattttgttttgtcaataactttttgttaccagcatgtacacttgcattgttgactctccatataatacctttaaaaaaattttttttgtggtaaaatatgcataacataaagtttaccatggtagttttctttcatttgttttgtttttgtttttttgagatggagccttgctctgttgccaggctggagtgcagtggagcgatcttggctcactgcaacctccgcctcccgggttcaagcaattcccctgcctcagcctcctgagtagctgggactacaggcgcccgccaccacgcccggctaatattttgtattttaatagagatggggtttcaccatgttggccaggatgttcttgatctcctgacctcatgatccgcccacctcggcctcccaaagtgttgggattgcaagtgtgagccaccgcgcctagaccatggtagttaattttaagtgttcaattcagtgaccttaagtgtgttcataatgttgtgcaaccatcaccatgttgtctaaccattagcactatctgttttgagaacttttttttatcatcccaaattagaattctgtacctgtcaaatagtccccagtaatcctccctcccccagcccctggtaatctgtagtctacttttcgtctttttgaatttgcctattttaggttcctcatataagtggaattatgtggtatttgtccttttgtgttggcttacttcatttagcataatgttttcaaggttcatctgtgttgtagcatgtatatacaggttgaagcatccgttatccaaaatgcttgtgaccagaagtggtttggatttcagattttttttttggattttggaatattcatagatacttaactggttcagcatccctcgtccaaaaatccaaaatcagatggagctcagtggctcatgcttgtaatcccaacacgttgggtggccaaggcaggaggatcgcttgagcccaggagttcaaccagcctgagcaacacaagaccctatctctccaaaaaaaaaaaaaaaaaaaaaaaagatgaaagaaaaaaaaatccaaaatcaaatgctccagtgagcatttccttttagcatcatgtcaggctctaaaagttacaggttttggagcattttggatttcagatttttggattaacctgcattaatgctcaacctatatgaaattttattcctttttatggctgaataatgttccactgtatgtatatactacattttgtttatccattcatctgttaacagacacttaagttatttccacattttgggtattataaatagtgctgctgcgaacattggtgtacatgtatctgtttgagtccctgtttttagttattttggttatatacctaggaatggaattgctgatcatatggtaattctgtgtttaactttttgaggaactaccactgttttccacaatggcatcaccattttacattcccaccagcaatgcacaaagatttcagtgtctgtatccttgctaacacttattttccattttttgagtttttttgttttgtttttttaataatagccaatcctaatgggtatgtggtagcatctcatggttttgattttattttcctgactattgatgatgttgagcatcttttcaggtgcttagtggccatttgtccgtcatctttggagcaggaacaatgtcttttcaagtcctttgcccatttttaaattgaattttttgttgttgagttgtatataacaccttttttgaagtaaaaggtgcactgtaataatccagactgtgtttctcccttctcaggattcctacaggaagcaagtagtaattgatggagaaacctgtctcttggatattctcgacacagcaggtcaagaggagtacagtgcaatgagggaccagtacatgaggactggggagggctttctttgtgtatttgccataaataatactaaatcatttgaagatattcaccattataggtgggtttaaattgaatataataagctgacattaaggagtaattatagtttttattttttgagtctttgctaatgccatgcatataatatttaataaaaatttttaaataatgtttatgaggtaggtaatatccctgttttataaatgaagttcttgggggattagagcagtggagtaacttgctccagactgcatcggtagtggtggtgctgggattgaaacctaggcctgtttgactccacagccttctgtactcttgactattctacaaaagcaagactttaaactttttagatacatcattaaaaaagaaaaccataaaaaagaatatgaaaagatgatttgagatggtgtcactttaacagtcttaaaaacaatcgtgtgtatagcatagaattgcttggattggataaacagtggcattatatattttaaaaaataaaagttttgaaagattgaagaatttgggcattacagttctcttaaatctgacaaagctgcataaaactattaaaataatcattattatgctattttatattctatttctttgagggtttagttttccaaaaactacatattaagcaaatgaatcactcagtggctatgtcatataataacgagttagcctagttataagaagtttaacattttatttaagaacattgttacagcatgtttactgtatagtctagtaatagaggaaaagacatttgggtgggtggtagtggtagtatttttatagaggagttaccaaatttcagctctattatccaagtttacccagctaatggtgttcggaaccgggaatttgagccaattctgactctgttgtctgctctgctccttcttttgtgctgtgtctttgaaagtcacctaaaattgtgagggaatgtaatttcaccccaaatttagagtttatgcacttgttatattgaaaatgattaacatgtagaagggcttttaatggaataagtggtgtagtaacttcagtgttgcctacctagaaatcaaaatctttctagttgtccactttgttttttgaaaaagtaatatgaaaattatgttaatgctttaattcaggtttttgtaaaatattttttatctttacacatttaacatacgtttctaaaattatagtctgttatatagcactttgggtctagaatttttcagtagtttctgttttactattatgatctacctgcatattaacctattaggttatagttttactatacttctaggtatttgatcttttgagagagatacaaggtttctgtttaaaaaggtaaagaaacaaaataactagtagaagaaggaaggaaaatttggtgtagtggaaactaggaattacattgttttctttcagccaaattttatgacaaaagttgtggacaggttttgaaagatatttgtgttactaatgactgtgctataacttttttttctttcccagagaacaaattaaaagagttaaggactctgaagatgtacctatggtcctagtaggaaataaatgtgatttgccttctagaacagtagacacaaaacaggctcaggacttagcaagaagttatggaattccttttattgaaacatcagcaaagacaagacaggtaagtaacactgaaataaatacagatctgttttctgcaaaatcataactgttatgtcatttaatatatcagtttttctctcaattatgctatactaggaaataaaacaatatttagtaaatgtttttgtcctccttgagagggcattgcttcttaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgcaatctcctgtggaccaaaatgtcattatgtggtacatgactgtactaagaaattgatccatctatattccatcaatttgtttagggctttttctggttacatttacctgtgagcccagaaaaccagttttgtagaaattaacttctgtaatgctaggagttaaaaaaaattgctgaacaacttttacattgttaaacatttaaaaacaagcgttctagaagtttatcaaatttcataaaggtgcaaaaatgtaaatgtaaatcattatccagctaatatatatgttgtatttccctagtaggagagcatatgtacctcttcctagttatacaaatttgatatatagtaaagaaacagtaaattctacttcaagtcattttgggaggattaaaaactgaatttctctagtttgaccattgtacagatttatctggcaattttactaaaacctgatttataggttaaacttggtgtatatcatatatcactttactttagaggaattaagatttcacataaatccatttccaggttccaaagaccaggaagaggcttggtttttgtttttctttttactgtcttcacagtctccttgacttttcttaggagagaaggtactgagaaaacatgattctaatatttattattttttcttccaacattttcttatgaaacattttcaaatacaaaattgagttttatttaaaacatttgcaaatatactacctagattctaccattgttgttttatatttgctttacttacaacttttaaaagatgctttttataccactgaacattttagcttacatttcacaaagaaaagaaaaaatttaagagactttgcataatgttttaaggggttgcagtaaagaagtgcttcttatattttcttatgcatacaaatcagctgggcttattaaaatccagattctaattcagaaggtttaggtggggaccgagtctgcatttctaacaaactcctaggtggtatttttcttggtacttggaccatactttgagtagaaaagcagtagaggacataaaaagagtcttgttagtcccactttgttgctgtccacttctcatttgataatatcctaaaatagctttgtctcctttttggtggttgtatgattactacctcagaagtactaattgattcttgctatttgaccttaatactttaatataacacagcattcatatttgatcagaaaactatctggcttccttttataagagatttttaggttttatacagttttgtggccttgggtttttttgtttgatttgtttttttgaaggtatataatatgtaagtagataaacaaatttgatttgtagacatttttatgtggatcatctaattaaaaatggagggatacagtatgaaagaatacttgtacttcttaacagagcactcaacctttcttttacatcctgtttcactgatgttattatgtaatttatgttgctaaactataaattagatatttaatttctgttctttgatttccttttattattaaatggacttgttgatttgcctagaaattaatttgcctttcaaaagtcttattaatcttcctccgttgaaattaatttgatatttgcatgcttctggaagactttaaagagctattccgagtaactgtagagattataaaatgaaatatgggaattttaataaattttacatctccagttactggtgaaaatgtcaagtcctcctttctgcagagtattttgttactcatctgttattcagcttatttatttatttatttatttatttatttttctttctttcttgtttttttttttgagacggagtcttgctttgtcgcccaggctggagtacagtggtgggatcttggctcactgcaggctccgcctcccgggttcacaccattcttctgcctcagcctcccaagtagctgggactacaggcacccgccaccatgccttgctaattttttgtatttttagtagagacgggtttcactgtgttagccaggatggtctcgatctcttgacctcgtgatccacctgcctcggcctcccaaagtgctgggattacaggcatgagccaccgcgcctggcccttatttgttttttaaacaaaattagtgtgcatatccttgttgtattttatcggcaagttgttttatgccctaacttttggggtcttgatcatgagcctaaaacacgtaaacacccaaaaagaattatattccggttaaaggaacaaaacattcatttagaagttctcatccatgtaaatcagaggctggcaaatattttctgtaaagggccaagatagtaaatgttttaggctttgagggccacaagtggtatctgttgcatttttttttaattatgaccctttaaaatgcaaaaatcgttgttagcttgtgcatagtataaaaataggctggccgcatgcctgtggctcatgcctgtaatcccagaaatgaggtgggaagccgaggtgggcacaccacctgaggtcaggagttcgaggccagcctggccaacgtggttgaaaccccgtctctactaaaaatacaaaacttagccaggcgtggtggcgggtgcctgttatcctggctactcaaggggctgaggcagtagaattgcttgaacctgagaggcagaggctgtagtgagcccagatcaagccagtgcacaccagcctggacgaccgagnnnnnnnnnnnnnnnnnnnnnnnnnnnnnnnnnnnnnnnnnnnnnnnnnnnnnnnnnaccgagcaagactctgtctcaaaaaaaaaaaaaaaaggctgtggctgcatttggtccattggctgtaatatgctgattcctaattctctgggtaactttagtgtttgattagctactagaagttaggttaaacttttgtattttacaggctaactttaataatcttaaagtaaaacttaacatagttcatggaaaggaaatagaaattttaccctagtactcttttttttttttttttttttgaggcagagtctccctctgtcacccaggctggagtgcagtggtgggatcttggctgattgcaacctcctcctcctgggttcaagcaattcttgtgcctcagcctcccgagcagctgggactacaggcacgcaccaccacacctgactgatttttgtatttttagtagagacagggtttcgccatgttggccaggctggtcttgaactcctggcatcaagtgatcctcccatctgagcctcccagtgtgctgggattacagacgtgagtcactgtgcctggtctctagtatttttttttttttttgagacggtctcactgttgccaggctggagtgcagtggcgcgatcctggctcactgcaacctccgcttcccggattcaagcgattttcctgcctcagcctcctgagtagctgggactatgggtgcacaccaccacgcccagctaatttttgtatttttagtagagacggggtttcaccatgttggccaatatggtctcaatctcttgacctcgtgatctgcccgtctcggcctcccaaagtgctgggattacaggcatgagccactgtgcccagctgtactttttaagataagaattgcagggtatatatttttaccaacttaataacttataattttaaaaagctaattacttggctagaatataatgcgttacatattctttacactcagttcagtccatatctgaaaggcaaatagaattattttctgctagtacattgtgtagtccctatgttcctagtgtataaggactgttacctagttcacatttatctgggttgttgacagattttcctggtccctttggacagtgcatggccatgttggcaaaagctgtcaaaattgaaacattgacaccatgagaattgtgtgttttccagtctgctaaaatcaaaagtgggagggttcagtaaggtgaataacagaagcagagttttcggggtatctgttactcctcattcggcttttctgctctctgggggtctcaatttaaatataatgtgaaaattagttttacgaacctaaaaatgttgagtgattcatttcctggttttgttgttaatttctagatatttaaattaattgttagaagaaccccgttaaagaatgctttgcaaaacaacctccttatgtgctatgtctctgtttaatagtagttgagtttgtgtacatgagatcaatattttgaactatagctttttatgagttaaaaattgacggaacagttactgtgcacttgctgtgcaccatggtagtctcccaagtagtggtttttctgcatttcaatagtacatgagataggctgtgggtggcaaggtttcttgagaaagtgagggatgcacagttgggttttagaatacatcttgttcctccatgcccttccccaccaaaaggctggtagtcttgcatttgtatatagttagggtatttgatgtgttgcttccttgacagagttttgcaagaatttgcagatttaacaggaacaaaaacttacttaaaacaaaatctcttagtaaaagcatagtctagcaagatttagaatgatactttggctaacagtactttctctatatggagtgctttgtttccatagcctcacaagtatgttttcagataatagttgagttgaaaatgttgtcaatctcttgattttaaaaaatttactatttaaagttgtatacttttgttcctacgtattttcagttgttcttaaagtttaataagtgacatttgaaaatgggtatatgtgtataaaaacaaaagtaggctaggcacggtggctcatgcctataatcctagcactttgggaggctgaggcaggcggatcacaaggtcaggagtttgagaccagcctgggcaatatggtgaaacccccctctactaaaaatacaaaaattagctgggtgtggtggtgcatgcctgtagtcccagctactcaggaggctgaggcaggagaatcgcttgaacccggaggtggcggttgcagtgagccgagattgcaccactgcagtccagcctgggcggcagagcaagactccatctcaaaaaaaaaacaaaaaaagaaaaagttaaaaaaacaacaaaaaacccccacaaaatgagtatatgtggcaacaagtcctattctcaaaaaaattattgtgtgctagttaagagcttaatgagtagccagtcggtattaaatatctgtttcagctatattttatctttaaaaattatctacagattttggaatgtgaaaaactagtgttttgtttcataggtatatactgtaggcattttaaaaataagagccagtgccagtggtttacagtgtacacaaggataatgttctcatgttctcttgatgtcagtatgactttaaagcatattatcaagaaataactaagtctgaaaaactgtggtaaataactggtactctaaaacctaagtttcttattactaaaaataagaaatggtaaaagtcaccctgtgctgttaattatatgagccactgaggtcctgacactgaattcttggtggtggataataatctcttctttttaattattggcttccaattctctctgcattgctggaaacaaaaatcatatatttcactattggtggtggggatgctgtcactgaaaaagtagacacattcatattgattttagaaataagttaaaatcaaaatttgcttctgctaaattagtagaggaccaatactgtttttctccttcatagtatgttttggtacttctacattgacattataacttttttttttttaaacagaaatagaagtttacattcttagaaaatttatgaaaatatgagcttttacctggtttgtgtgtgtgcgtatatatatacacatatttttaaatttcttacattgattttcaaattgaaagagaaccatttgtgaaagtatcttaacagagctcatgctttacattttacatgctacaaagttattttagtgccttaaattatttatgttgcttattaatgaaaattttggatacataattttttcaagacaaaggtaaaaataataaaccctttccttctgaggattaatgataaatataaactttaaaacgattaaaaaaatttttttagagacagggtcttgctctgttgcccagactgaagtgcagtggtgcagtcatagctcaatgaagcctcaaactcctgggcccaggcaaccctcctgcctcagccttttgagtagctgggacttcaggctcatgccaacatgcctaatttatcttatttttagtagagatgaggtctcaaactcctggcatctcttgccctctcaaagtgctggtactacaggcattagtcaccacacctgacacttaaaatcttttatatacaggtgtaagtgggtatctaacttaaagtgccaacgaatgtagttgaaagtttgtagttggcttagctaactagttaactaaattgattccattaaaaataagactgctcttagaatataatgatttttgttattcattaaatataaatatatcactggatagtatatgttaatgacttgagatacgcattttaacatataatcacgttacttaaatgcctgcctttgaactgaaacttaacattatgaatttaaattaaagtttgactttagaggtaaatttctgtactttactaaagcagttcttaatatacttctgagatttctaaaaattagtgtgccctaaagaattgaggtgtgtttttcttaactactgtaggcagtagatgtacagatgacttctgcatgcaaaaattaagccctagccattggtttacttcaactaatacttagttgccaattctctgtgtgtgattgaatttaaaactacaaatggtactggtgatacattaactttttaggtgctaggtccactttgttacatttggttcagtagaaacattgatgttaccaatctcagaaagctaaaatatgtatgccaatccccaaattaggtaatttattcttaattttaagataaaagaatagaattcccttaaaattaaatgtggagtaaaatataccagctttaaaaaatattcacctttctgttagaagaatgaacataatattacatcttttaatttgcactatatatagattaatatttctgtgtatttctctgtgcccctactttgatggtatgcttttctgaacaaactagcagcacagttaactaagcactttgccccgtttgatgactgcctaattttctagattggaaaatattaaaaacttttatctccatatggccaatatatgattgtacctgttgtcatagctctcctatgtttaagcaagaaaaaccctattaagagtatttaaattagaatggaaggcacacagccagtatgattgaacactgttctaaaaattatttttaagacttgtagtaaggccaggtttggtggctcatggctgtaatcccagcccttaggaggccaaggtgggcggatcacttgtgctcaggagtttgagaccagcccgggcaacatggcaaaaccctgtctctacgaaaaatacaaaaatcagtcaggtgtggtggtgcttgcctgtagtcccagctatttgagaggctgaggcagggggatcacctagcctgggaggtcgaggctgcagtcatgatcgtgccattgcactccatcctgggcaacccagtgagaccctgtctctaaaacaaaaaaataaaaaaagaacttgtagtaaggatacaaaatgctcctattttgtgtgtgtcctttaattcatgatgtttttatattatggtaagcagctctcatttaagattttaataatgtaattaaacatgtacagaagacccagtctcagcttcacttgtataccctggaaatagactgaaaggtgttaaaatttaaaataaaactcaaggttccagtttcttgactcacctttgagattcttttatgtttttgttgttttttaacaaaggtttcacgtccatattttaccatttttcttctcattctcccctggaggagggtgtgggaatcgatagtatataaatcacttttttcctaagtcaaagaagtaatttaaagctaacttcagtttaggctttaattccaggactagcaaactaaaatggttgcattaattgacaaacagatgctaatacctgtgtttaggcttgtcataatctctcctaattcctaatttaaaaattttaaaatttaattccattagaaaacaaaactgacttttaagaacaaaccaggattctagcccatattttaaaactgcatcctcagttttattcaaacagtctgatgtctgtttaaaaaaaaaaaaatctcaagctcataatctcaaacttcttgcacatggctttcccagtaaattactcttaccaatgcaacagactttaaagaagttgtgttttacaatgcagagagtggaggatgctttttatacattggtgagagagatccgacaatacagattgaaaaaaatcagcaaagaagaaaagactcctggctgtgtgaaaattaaaaaatgcattataatgtaatctggtaagtttaagttcagcacattaattttggcagaaagcagatgtcttttaaaggtaacaaggtggcaaccactttagaactacttaggtgtagtattctaacttgaagtattaaaagataagaaacttgtttccataattagtacatttatttttaatctagtgggaattaattataattgagacaattttgatggctgtagtagactaatctatatttggcataaagtctaatgatttaatgagtcttaagtaaactaaatatttggaaactgatatttacctttgtttttaagggaaaagttttgagataatcagcagcctttttttttttttttttttttttagtagggagaaaaagatatgagctatagtagacagcagtaatattgaatggcccagaaggtgggaaaaagccactcttaaatgtattttttcttttggatattttacaagcaaataataacttctgcctaagttcgccatctcagtggcatcagcagcacagcactttcttatcccagtgagaaaccggggaattttaggatgactcctaccgccctcttttccccctggtttggaagtatccacaaattcctgtgacgttacattctgtgtcttttatgtcatcattagttcaggcccctatcatttcttgttggactgttagaacctcctatttggtttaccagttgctgccattattcattgtgaaaccggagagatacactttaaagaaatgtcattgttggccgggcgcggtggctcacgcctgtaatcccagcactttgggaggcctaggcgggtgatcacctgaggtcaggagttcaagaccagcctggctaacatggtgaaaccctatttctactaaaaatacaaaaaattagccgggcgtggtggcacgtgcctgtaatcccagctacttgggaggctgaggcaggagaattgcttgaacctgggaggcagaggttgcagtgagctgagaatgcaccattgcactccagcttgagcaacaagagcgaaactctgtctcaaaaaaaaaaaaaagtcattttagctatagaataaaatctcatgttccacatgtgttgcagatagtccttactaccttcccaccactccagctcttttttggtcttatatctaaaaacgtcatcttgcctgaatttcttttgttcttctataaataaataccatgttatttcctaccttcccttgagtcttggctcttgtttggaatgccagtatttttatccctagtcttactaattagctaacactctcatgattccccagtctcctactctctaaaaacctttctttaaacccttagactaggcatggagcccttcctgtgtattcccagaatactattcttaactattatatgcttcccatgttatgttgaaataactaacctcttctgtttcattcctatattacttgacagcaaaatcttagccagaattacatatttttaatctttgcacacccattgcctagtaaggttcctgggacatagtaactacccagtaaatatttattgcgtggaattctcattttcgtttctaaacccgtattaaactctgtcttgctcagaaaatacttcactaggtatcataaagttcatggcagagcttaagctttggatgcatattgtttgtaatatatcatgttcttaagaataggcaataaaattacagttttcaaaaactactacatttattatatttattacaagttggtgttctttattacatgaattttaggtatttcccaaaagtataaaatatacatttgaatagtagactcaatcccaaaagatactacgtggtgtactaatctactaaactcagaaacaaagcatgactggcattaatttttgttgaaatttatgaactctgaatgtttttgaatatcattctgtaaagcaatattttgcaattaaagcaattttgcatgttaaattttaccacaacctctaaaatattgcaaatttaacaatacagtttgaaaagttacacattttaaataacagtaccatgaccagatttaggtggtggttttaattttttattttctcctcctattgtctcaccattagatgattttaaaaatagaattgtttagagtaaaataagtgttatgctctaatttatatttaaaatgaaggtttaagcacgtactattctaaaatttctaatttgtgcaaattatgttttatacagtgactgtaggtgaatgtcacaattgtttgatgtgacgaatccttgtttttcagtacacgtggaagtaattcatataaaagagaagtatacttggtaattaaaaatttaaaattaaatacaatttaaaaaaaaatttatttgacaagctggctgtggtgtgtgtgcctgtagtatcagctgcttgggagcctgaggcaggaggattgcctgaccccaggagtttgaggttgaagggagctatgatggtgccatggcactgtagcctaggcaacagaaagagactccatctcttaaaaaaagtaaaaataaaaaaattttggcacagggacagtggctcacacttataatgccagaactttaggagtccacagcacgaggattgcttgaggtcaggagtttaagaccagactgggcaacgtaatgagaccccacctttaggaaataaatacataaataaaaatttgagaatgataaacatatataaattagcttttcttagtcctgaaaaagataatgttatgtgtatgtgtgagaatgattagttctcatatgagaaaaaaagaattcattgctctgtgtaggttgtgacatttccttcacgattgaaattaattaatttttttttattacttatttatttttaaaatagagacaggttcttgctgtgttgcccaggctggtctcaaactcttggcctcaagcagttctcctgcctcagcctcccaaattgctgtgactgtaggtgtgagccactgcactgggccaaaattacttaattttaacaagatgatgtagagaggagagttcattgcaacataagcctagaatctttgtcagaatcttaggaagtaatgttttcaaattctgtgttttcaccataaaatgtgtcttctctgtgtccatcacatggtttttcattgttttctgctttaccattttagtaccattggcatttttcttcattgtaaaagtagtagaaatggagtagattacataaggatgtgatcagagggaatttattcattcagggtaagggagttagatcctcttttaagattctatcacattctaagggtttatgattctaaactgtcaagtaaattgtcaagtgctggcaagctacagaataatttttattgtatcattggaaattttcccctctatatgtgttaaagagtttagcctgaagggatacatacacatacatatatgtaatcaaaccttgatggtattgtattgctgataaattatttcttaccacttttcctttctcctgtgggagaaacaaaagcatatgtttgtgtagtatcagtaatgatattagagagtgggaaacatcagtgagtgcagtttggggactttattggagactttcactagtgctcaaataaataatgctggtttttatcctactgtttgcttaatgtggactagcctcttattcccattctatgtttacctctcttaaaatattggtcacgctttcttgaattatagatctattaggaaaattcatgaactgtagctaattttcattgttcatgctccagatttattttgaaatatcgttaatcttagtagtacagtaaaggagaaataccacttaacattttttgtttttttttctttgagacagagtcatgctctgtcacccagtctggagtgcagtggtgctatctcggctcactgcaatgcacttcgcctctccgggttcagcaattctcctgcctcagcctcctgagtagctgggattacaggcacctgctaccacacccagctaatttttgtatttttagtagagacagggtttcaccatgttggccaggctggtctgaaactcctcacctcaagtgatccacccgtcttggcctcccaaagtgctgggattacaggcttgagccaccgcaccccgcccacttaacattttaaattaatttcaagataatatcacttgaatatttttacacatataatttttttaatacatttatttacacagtttataatatcctacaaagtgattacaatgagtaaaaacccagttttcattgttcctaaagtggcttgatttatacaacttaatgtgttgggtatttgtttctaagactccctctgctgtctaggtttggaagtattgtgaggttaacagattttctttttatagttactactcagttgaacaggctttaaaatacagagagaatcatattttttcttcattttttgcttttatttatatttttcttttaattggagacatgacaagaattgacttgtgtatggatcttgcataatttaagtactgcaggtttaaaatctactctactaccagtttgagagtgccatttttcacactgtagattattaggttgaaaagtattatggcttaaaatcgcttttagccattaaatttaaataaccttgctttaatcataaatagatggtggtcacaatgactaactgttaaactctttgaagacaggatatttggctttatatggcaagcttttgaatacaacagaaattaaaactttatgggatagaaagaatctcctccaaattggtaaactataagacctttcaaatgatttagctaatttctccacaaatctgaggtattagtgttttttttaaagtggtattctcctgtgttggggtcactttaaacctttttcttaatgataaatatatgaattgaaactaatcccttaatatatatcatttgaaaactgaaataatatgtttagatactgtttacttgttgataaattattggaataggatgttcgaatactgtttacttcttggtaaatttttaaatccaatggattttacgtaagtatagaactggagctcaaatactgttactgtgtgtgaagatatatgaacatagtttacagttgcatggcttatatctaaagtccagaaacataaggacaattaagtgtacacacacacacatgcatttggattttgatgacttaggtttgccaatgtggaaaaaatagtagcaaattaagttctcctgtgaaaaagtcgttaccttatttaaaattctgtgccattggttatccttgtcttttgtgaaaattagtgttcctgtttataatattgacaaaacacctatgcggatgacatttaagaattctaaaagtcctaatatatgtaatatatattcagttgcctgaagagaaacataaagaatcctttcttaatattttttccattaatgaaatttgttacctgtacacatgaagccatcgtatatattcacattttaatactttttatgtatttcagggtgttgatgatgccttctatacattagttcgagaaattcgaaaacataaagaaaagatgagcaaagatggtaaaaagaagaaaaagaagtcaaagacaaagtgtgtaattatgtaaatacaatttgtacttttttcttaaggcatactagtacaagtggtaatttttgtacattacactaaattattagcatttgttttagcattacctaatttttttcctgctccatgcagactgttagcttttaccttaaatgcttattttaaaatgacagtggaagtttttttttcctcgaagtgccagtattcccagagttttggtttttgaactagcaatgcctgtgaaaaagaaactgaatacctaagatttctgtcttggggtttttggtgcatgcagttgattacttcttatttttcttaccaattgtgaatgttggtgtgaaacaaattaatgaagcttttgaatcatccctattctgtgttttatctagtcacataaatggattaattactaatttcagttgagaccttctaattggtttttactgaaacattgagggaacacaaatttatgggcttcctgatgatgattcttctaggcatcatgtcctatagtttgtcatccctgacgaatgtaaagttacactgttcacaaaggttttgtctcctttccactgctattagtcatggtcactctccccaaaatattatattttttctataaaaagaaaaaaatggaaaaaaattacaaggcaatggaaactattataaggccatttccttttcacattagataaattactataaagactcctaatagcttttcctgttaaggcagacccagtatgaaatggggattattatagcaaccattttggggctatatttacatgctactaaatttttataataattgaaaagattttaacaagtataaaaaattctcataggaattaaatgtagtctccctgtgtcagactgctctttcatagtataactttaaatcttttcttcaacttgagtctttgaagatagttttaattctgcttgtgacattaaaagattatttgggccagttatagcttattaggtgttgaagagaccaaggttgcaaggccaggccctgtgtgaacctttgagctttcatagagagtttcacagcatggactgtgtccccacggtcatccagtgttgtcatgcattggttagtcaaaatggggagggactagggcagtttggatagctcaacaagatacaatctcactctgtggtggtcctgctgacaaatcaagagcattgcttttgtttcttaagaaaacaaactcttttttaaaaattacttttaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtccttaataaatttactttttataatcatcaccccttctctcactatgtaatcaaaatcctcttgctgtcaccattcggcgcacacactctactctctgagctctgccacctaatgccagagtgccactgccaccatcccacatgcatggtcttctcttccccctttcccccaacctacccttcttgggctcaagcaacttacactgcaccatttcctccctcctgggtaaggctcaccttttgttcccattccaaaaacctgtgccaccatttccttcaccctaataggatgccctcctcatcccctgctaggctgctgctgtgcacaagtccctacccccagaggccctcactgcatttgggctccagtatcccctgctgggctactaccttgccagcctttctctcgcccccaccttccccagatgcctgccttgctcagccccacgtaatgacttttggactgaattactctgataggcaagcaggaagcaacttttttttttttgagatggattcttgctctgtccccaagctggagtgcagtggtgccatctcagctcactgcaacctccacctccctggttcaagcaattcccctgcctcagtctccccagtaagctgggactacgtgtgcgcgccaccacgcctggctaattttttttttttttttttttttttttttttttgtatttcagtagagacggggtttcaccatgttggccgggatggtcttgatctcctcaccttgtgatccacccaccttggcctcccaaagtgctgggattacaggcgtgagccaccgtgcccggccgcaacttatatttttaaaataggcttttagatcagttttaagggttattttatagttaactagcagaaaatgtggattaaaattacagtaccatactcaattaaaaatcatgcgctacataatttaagttctcctgttaacttctgtttgggttgaaccccgaagtacaatagtgtagattctcattgtgacctcacctgcccctttaggcattttgcaaaatttacaccttttacaatttgaaaggcagggtgccagtgccttcatgtatttcatttaatctgaaatttttatacgtattagacatagaaactgcataaaatatgaatgtacaaattaaagtaaaatatacatctgggtacccatcattcaagttatgaaacaaaagtcttagaagcccccatgtgcccctctccaattgcttctccttccccatctctaccaagatagcctctaatgacttcctgcttattctctttagttttcccagcactcatgaacattgccctaaatatttaattttggcaatttgagcagcaagcacgaatctagcaaggaaaagggcaacaatgctgctgttaattaaagccaaacagccctagtctggctttaccttctccaggctttctggatcccttctagagaagttaatttgcaatgtcatgagtgaatactgggctcctcacaactgaagcatgtggaaagatcaaagtgtagaattgatacctgatttctggccaatacatagcaaaaatgggaaggaggaaggctattttctgctttaagctcaccaacgcccaacatcagctttcaggaataggttgaaaaagaagggtaaaaatgagtgtcctcagttggtccagtcagcacagcacagaagagagcaggaatttcatcaccacatggtcaagacaaggcaaataccggtaagaatctgagccaggcttgcctgggcataatgtcctcagattaaaaagatgatacaatggcagcagggatcttagtgataatagccatcaatgtgagtcatgctgcttgattctggactgactgctctctacatcaagaagcacaactgtggtgctggaatcctacttgaccatgctcccagaaattcctcttgcctatcctctatgttgattatcccattttctacattccaaagtgttccatttcctggttttatttttgtttctgtggagcacatcctaacttcttgaaaagggtacatggaaggtaaatgagaccctggatgtctaaaaatggctggctccctctatttgtttgatagcttgtctgagtatagaattgaaagctggaaataattttcttttcaacattttgaagtagttgcttgtctgtttgcttttaccattgctattaagttcaaagcagtcctggtaagtgatcctctgtatgtgatgtattttttctctctctccccagaaacttacagaatcttctccatgaagattttgaaatgttagtgatgtgttgataatggatttatttttatccattgtactggacactcagttggcccttgcaatctggacacttgtttccttcaatttgggaaaaaattttaaatgatttcattcatgatttcctccctcctccattttcttttttctcccttcctggaacttttattatttggatgtttgaacttctaaacatgttctcttccttttttctgtactattttccatttgtcttttttttttaagcatggagtttcgctcttatcacccacgctggagagcaatggcctgatctcaactcattgcaacctccgcctcctgggttcaagtgattctcctgcctcagcctcccaaatagctggaattacaggtgcctgccactaagcatggctaatttatgtatttttagtagagatggcttttcaccatgttggccaggctggtctcgaactcctgacctgaggtgatccactctccttggtttcccaaagtgctgggataacaggtgtgtgcctctgcgcccagccttttatttagttgtatgggggattttctcattttcttcttccaagtgttctactgagttgttcatttctgctcttcctggacagttaattttgaccactcagattgctctcagcatagctggagactactatagagatgttaaaaatactcaaaaattataatagagtagcctgggaatgggagtaggggctggagaccaggaaggaatcaaagatgcacaaggcaacctttgtggatagtggatatatttattgtcttgattgtggtgatggcttcattgtgtgtgtgtgtgtgtgtgtgtgtgtgtatgtatacatatatgtatatatacaaatctatataattagtatagatactatatagtatatagtatgtagttttcccaccacttagccctgttcttagacttttgctggcatttctattacttgcaaaaatatattaaaatatatattgacaaacagaggtagccagccatttttagtatatagtatactatggtatatatatctaccatatactacatagtatgtactatgtagtacatatatagttatgtactatatatatctactatatactacatagtacagtatgtactatatgtactatatgtactatgtagtacatactacgtagtatatagtagatatatatagtatatagtacatagtaattccttttatttttgtttctatggaaacaaaaatatgtatactatatattatactatatgtagtatatattatagcacatatatatctataaatatgcatatatagatgtgtatatatatgaaccaaatttatcgaattatactttgtaagtgtaattcagtgtcaattctacttcagcaaaacttaaaaaaataatagaaatgccagccaaagtctaagaacagagctaagagatgctgaaataacacatggaagtagaaatccatctaaaccacaaggctgccaattcgtgggtaggataggtgactctacctgtcctcagtcgatggctacacagaacttggggtatgcctctctggggaaggaaccctggaatatacacttgaatcaatgaaaaaatctgaaagacacttgccgccagcatagcagtgaagccatgaccttttcttaactgaaggtcatacatttactgcttttctggctcctctttcctagggaaaaaaatacttctacattaatacttgttaaattgtacttactactagttaatgagctaattcacataacaagcatattatgtaggcattttttctttccaagttcactgattcttgctttcttgaaattttctgttgttttacttcaaattgcttttctgcttgcttttgtctcttatcacttctgagctgttttacttcaaattgcttttctgcttgcttctgtctctatcacttctgagctttcttccaaagtctggtcattcttttctgtctactcttatgaatgaaaagacaaaaaagctttttagatctgtatacgtgggtgaagcatatagactctgggcttcacttagggtgctctgggtgggcctttactggggaacctctgatgtcactatcttggattgctcctcctgggctggtcagttcctcagagttgagtcttccagtcttctaaggataagaggaatgcgggccctgcatccagcattatgtattcctaaattcacttaactttgtttccagtgtgcttctctagaatgcctgaggatgccccagtccagggactagtattactttgtccagaaataaacctctagtcttctatgggagtaagggggtagagttacttagaggtgtttctcaaatagctttcatgtagtccacttccaatttcagggtgcgtgtttcagtgccttttgagaattctgcagagtgaattgggtttttctggtgtgctaagtcacattcattcacctgttttccagcttctgagttttattgctgttacctcctgtccccatttttccaatttatttttatatcattttactgtagatttagtagttttggaagggagtaaaattagatgagggtatttaacccactatattaactacttcattctttaaacttcctttttttctttggcagagagccattagcagcgtgaaataatcttactaagannnnnnnnnnnnnnnnnnnnnnnnnnnnnnnnnnnnnnnnnnnnnnnnnnnnnnnnnnnntgagaccagcctgggcaacatagtgagtgagaccttgtctctactaaagtaaaaaatattagccaggcatggtggcgtgtgcctgtagtctcagctatttgagaggctgaggtgggaggatcgcttgagcccaggaggttgaggctgtagtgagccgtgattgttccaccactccaacctgggaaaaattcattttgagaccctgtctcaaaacaaaacaaacaaaaaacacctcttcggaaccatgttcttttcacataatttaaaattaaatatacatagatgtaatttcgaattgcaaactataacctgtttaatgcctaacagcacagcttcatttaattcacaatttgtaacttgtgaaagctttcagggacctggcttaagttgtcctttttagttgttggtctttttacaaattatgtatcataaaacacttgcccagcaaaaatgtaactagtgtggctatggcaaatttgttcttctttgatatgttaacttatatgaattaatgcagtttatctttttttttttttgagacggagtcttgctctgttgacccggctggagtgtagtggtgcgatcttggctcactgcaacctccctctcccgggttcaagcgattcccgtctcagcctccagagcagctgggattacaggtgctgatcaccacgcccggctaattttttgtattattttagtagagacggggtttcactgtgttatccaggatggtctccatctccagacctcgtgatccacccactttggcctctcaaaatgctgggattacaggcgtgagccaccacaccaggcaatgcagtttatctttatgcagttgaccttgaagcatttaggtttactttagccactaagagaaataggtctccttgggttcacaatgtagtgaataaacaattttgagttcagcagggccctgaggctgctcctgaactctgcatgaagtcatggaggttactgttttaagtaaagagccaagagttaaggactaagagaagccccctattattctgaaaacttggatgtgtgcgctggatgagacagcggttgcagtccccattgatagttttttccccctgtcattctaggctaaggagttaggacttaaccagttccagttccaggctaatggaaaattgtcattttactgggggttatgtggtggccaaagttgttaatcattgttccccatggggtagatacagtgagagcttcagtaaagcctttcctctaaaagcccactattttaaggtaacttgggattactgaactatctccttaccccaatgaatcctaacttgagttgactgaggtgttttatcattaaacattagttttactgaaactaatttaaaaggaagccttaactttcatatcaaacagctatggtaaactgagtaagaactctgtacgaagtcgctattaaaatgtttttatcttgctaccaggatatggatgtaaaatgctaataactattacacaacctataatagttacaggttacaatagggataataacactttaacccacaaagactagcttagtcctactacttatctatgaataatgcatgtagtcaataacactggaagggatagagcattataaacttataattcagagatgagaaatggtgccagtaatttaaaagtatttcaggtctcataatgctaaaacagggtgtaggtatgccctacaattacagagaactcagtcgggcttgaggagaacagcctcacttaattgtagttttcctgtcggtgtaaggtgccggcgtttcttcatatgggaggagactgaaattctaaaggttgtgtggttagtacaattagtctgtgacctcgggaaactaatgagtctttggggcctcagcgatcttcatgttaaggaatattttagccaggaattgcttcattttcaattcttgttgagggcgctcttaggaaaaaggacgcgtacgctgcacagaaagtaaacaatagagcagaaagaagaatccgaaggtcattaatcttaaaataaccaaccctctggagccaacttatttctctctttaaattgccgaatgagccccatccccctgctggcttaaaccgcagaggcccaggcctcccaccgggtgtccgctgcatgaaccagtcgcatgcctgtttccttctcgaaaccctcacagaaagacccaacacactctaggaaataaaccgtcaacgtcaggagacgctcagaaccctcttcccacacccggtggtcctcgcccagagcatatttcgcctccagaccccaggatccgggaaatggaacaaaactccccggcggcggcactcacgcactttccggcacgccggagccgcaaaagcctcgaccgctacgactcctctgtccgtctactgcgaagcggggtggcgttgggggaggtgggcaacctgtcagtaaagggggcggggcgccggccggaagagcctccgcgcggctgcgctcttttcctggagctcaagtgggcggggcctgtcgtccgggcaacccgggagcgtttgtccacacaatttctgctccgactctgcggactactgcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacaggtaggagtcccaaaccagtttctgcaaacgggagatggtcaaagctgtcacacggtatcctgatctcgaatgttgctaagcttgaaaattggtcccaacctagtaactttcagtagtgatagacgttcccactaaattttcttattgcaacttggcggaaatgttttagtacttctccagcagttaattaaaagctaatgcaatttactctgctttgaaaaaatattttatgtcgtcttttgtgggaatatgaattgttttgtgattcaaggttctcatcctgcattagttaaatatgataaggcttctcattttgtttttctgcactcctcaactgccatgttttcagcaaggagacaggccaacatgtagctatgagagtatctctgattttcttaaatgtggtttccatcaagacattttctataattaaaaccagaggaagtggagaatgtaattacttatttaattcattaattaagggaaaaatgtggagtgcattctttgtacttggcactgggctagaagccaagaataccaagaagaacatgacgacaactctgcttataggatacagattaaacaaattaattacaatacagctttacaactgtaacaattgaagcatctaaaatggggtaacacacagttggaaatgatgaaatttcagtgaggggaaacaagggaaggagagtggtgcttttcaacctgttttaaagtataaatacgagttttccacatatggtgggaagaaatagggagtggaggcctggcgcggtggctcacccctgtaatcccagcactttgggaggccgaggcgggcagatcacgatgtcaggagttcgagaccagcctggtcaacatggtgaaacccagtctctactaaaaatacaaaaattagccgggnnnnnnnnnnnnnnnnnnnntgacagagcgagactccgtctcaaaaaaaaagagaaaaaaagaaatagggagtggagagcattcctggcggaatgcaaatggaccttaagtcaatttataattgctaataaattgggggaacagtaagcacttacttgttaccttccaatttgttacctgagtttcttcttcttagatccttctcccaatgtttctcaaagtgtggcccatggaacatttatttctaatgcacccggagtacttgttaaaaatgcagattccaggaacccactcaactccaaatctactgtattagtttcctaagtctgccaagtaaggaattgccacaaactgagtggttaaagaaaagaaatttattgtctcgtagttctggagactagaagtccaagatcaaagtgtcagcaggtctgtgatacctctgagggccttagggagagatctgttcagacctttcctggcttctagtagtttcttggtttgtggcaacaaaacttcattcttcacatggcattctccatctgagtatattaaaattattattatataaggacacaaatcatattggattaggggcccaccctattcagtatggcttcatcttaatttaactaataaaatcagcagtgatcctgtctccaattagatcaaattctgaagtactggggatcagaatttcaacgtatgaattttttttcttttttttttttctttttgagactgtctcgctttgtcacctaggctgcagtgcagtgtcaccatcatggcttatcgaagtctcagcctccctggttcaagcaatcttcccaactcagcctcctgaatagctgggagtacaaggcacgtgccaccacacccagctaatttttaaatttttttagacagggtcttgctttgttgcccaggctgccctcaaactcctgggctcaagtgattcttccactttgacctcccaaaatgctgggattacaggagtaagccagtgcacccagccaacatatgatttttttttttttttttttttttttgaggcagagtttcgctctgttgcccaggctggaatgcaatggcgcgatctcggcttactgaaacctctgcctcccgggttcaagcgattctccttcaagcgattctcctgcctcagcctcccgagtagctgggattacaggtgcatgccaccacgcccagctaatttttgtatttttagtagaaacgaggtgtcaccatgttggccaggctggtcttgacctcaggtgatccccctgcctcggcctcccaaagtgctgggattacagctgtgagccaccgcacccggacaacatgtaattttttgagcaatacaattcagcccataacatctactaaaccacagtgtaggaagagaagtgagcatacacacgtttagtccataaatatgcatttctaacaagcttcccatatgattcttatgccctctgaactttgagaactacttcactacatagtggctattatgacatataggagaaatgaggatatgtacttaccccaaacctgatttacattaaaagcacaagtgagaagtgacaatttgcccctctttaaaatatggctaattgagaactggagcaatgctatttacatattcagctgtttagtacttatttcacgatggaagtatgttaactattaattgatagaagctatgataaaaatagaatctatttgtaaaaattatatggcagcaaagtctctacttttctatctccagtgcctcagattgccttgtgtgtaaatcattaattaatatctaccgagtgaattagtgtaatatatgcactcttcaagaagatggaatctactgatatgtgttaaacttcagttttacacagtataatcttatgggttgaactaatatttcccatgtataactcttcaaatatgtaaagtgtcttatgttcacatgatctcctataaattccttaccagaaatctgataaacacatgagcctaatcaggaaagtataagtgatattattgtaactgtgagtcttttttgaaatcctgtgctttccaaaataatttccagaaaagaatagatctgccttaaaacacattgctgaatagaatcttcattttatcatagctttacctgctttatttatttatttatttgtttattttttgagtcttgctctgtcacccagactggagtgcagtggtgcgatgttggcttactgcagctccgcctcccaggttcaagcgactctcctgcctcagcctcccaagtagctgggactacagacacatgccaccatgcccggccaattttctgtatttttagtagagacggggtttcaccgtgttagccaggatggcctccatctcctgaccccgtgatccaccttcctcagccgcccaaagtcctgggattacaggtgtgagccaccacacccagccgcctgttttatttatttattcattttttggaaatgcggtctcgcttggctgcccaggctgagtgtcatggctcgctgcagccttgacctcccgggctcaagtgatcttcccacctcagcctcccaagtagctgggaccacacgcatgtgcttggctaatttttaaaattttttgtagagacggggtcttcctgtgttgcccgggctgatcttgaactcttgggttcaggtgatcctcccgccttggcctccgcgaatgctattacaggagtgagccaccgtgtgaggctactttgcgtgctttaaataactgattccctttctataaaaatcatcaatctaactttacggaaaggttatttctttatgagatcattcccacacttgcaaatttgacattagtgccaataattggtcaatgatttattgtcctttgaaccctttaaactagtgccttcttgactagtactctgtttagtaacagggcatttcattaaacatggatcattgattgtcctaagaaacagtgtaaaatctacatacaaaaaaatggttcagtaggtgaacttagtttttctatacttatttgtagttttgtctgaactctttttaaaaaagcattttattttgggataattttagatttgcaaagaaagttacaaagatggtacagagagttcccttatgccctttaccaagcttcttctaattttaacatcttacataatcatgatacttttgtatcagaattgtctttaaaattgatcaattcttttgttttccaacttttagggtcccaaagcaaaaaaggtatgtagaatttttttcaaaatagatagttatataatcacttacagtgtatgaacagaatatttacagaattataaaatatttttatagttttagtttgtagagtttactaagcttactttttagacattaatgcagtttaaatcatggaataatcctttacaacagtaggacgcatttcaaatttgacataagagagttctaatttcacaaatactcttaaaaatagcttttaatttttacttatgtctagatttggggctttttgttaattctgctctagaaaatgttggattaggaacccctttttcttcactctagatacatatataaaattttaattataaaatgtgctatggctttaaagtgaaatctgaggtaatacaactttaaatgggttgcatggtaacacatacttggtgggtttttttgtactgtttagaaatttgagttcaataaacaatgtaccattctatatgcctttttccagaatgcctttttctctctttactttgtagatttatactttaaattagagtttataatccattggctggcagtccaaatttaccctacagacatattttgtttgaccttagaagtgtttttttttttttttttaaatcagttgccaacctatttttatgcaacaatctgatttccatctattcttaagaaattggaaacctgataacattgggcctaaatagtcctgtaaggcaacaattggctgggctgaataacagctaccccttttaggaatgcataaaatctttgatttgccatagtcttgaccataaccaaacctcttagtttatttacctgcttggtcccaacagggatttgggtctggaatgcctgctttaaggcatatctcaaatgtcacttctctgtaaattttcccattgttcccttttacagatcaattatactctgtattttcttggttttgttttgttttgtattttagagacagggtctcactctgacacccaggctggagtgcagtggcatggtcttggcttactgcaacttccaccttccgggttcaagcaattctcccacctcagcctcttgattagctgggattacaggcacgcgccaccatgcctgtctaatttttgtattttttggtagagacagggtttcactttgttggccaggctggtctcgaactcttgacctcaagtgatctgccggcctcagcctcccagagtgctaggattacaggcatgagtcactgcgcctggcttatactctgtgttttcatagcacatgcattcgtgcatacctcaattataaccctttatcattttattgtaattatttataatggtgagcttttcatggtcaggagcgtgtcatatttttacatccataatgtttagcacagtgcctggcacatagtagaaattcattcaatatttgttgaatgaatatgcgaaaccccatttaatctaccacccttaaaaacacttgggctctttccaggaaatgtttatatacagtgtattcagtatttatacagttaaacatttcttcaagaaataccattgagtgccttctttgtttgcttctgtcagtcacttggacccatgaccaacctgatattcttttagaaactgtggatataactgaacaaaatttatgaaggctctggaagcattcaagcattctggagggcctgtgtgtctctgtaatcattcattgatttgtgtggacattcattttgtgctttagactatgaaatcttagaggcatcattttaaatccgaaaactcattgttttaaattaccttggtacttcatgatatacatgggtgggctattacgttgatagtattgtttctctgaaagaatggtgagattcttcctatgaaatttgaaaccaaacccagagaagaaatcgcttactttttttttttttgagacagagtcttgctctgttgccaaggctggagtgcagtggcacaatcttggcttactgcaaccttcgcctcccgggttcaagtaaagaaatcacttactttttaattatttcacttttaaatattgcagtttggagatgaggtgttctgtaaagggaatttacagtgtaggtaggaaaacattgaaggatatattttatactttactggttttttaaagttttcttaagggaaaattaatgaacacacatggtacaaaattaaaatagcattaaaaaattgaaacttttcttcaacccaagacatttgatctgccttcctagaaccactgtacatcttttcataaattttctaaacattaaagggcgcacatatgtacacacacagagaccnnnnnnnnnnnnnnnnnnnnttttacatttgaacattactgaaattgagatgtgtcttataatagtatcttacaatcattgtagtcctggattgacatccacttcttcaacagaagatgtttgcttctatctgtcagttgggcttattaccagtctggtactacttaaattctatgcttgagggttttggaccacaccaatggtatgagtcagactgcaaatccacatgaaccggcttgtggtttaaattctcaggaattttttttcttccttctaccagtgtcagagttgacatatgcaagccttctttttttttgctctgcattactgtgttgtgggattgtttgtctttccctatatccagttttatacaggtatcgcctttaactgccatcttaggcattatttccttttttgggacataataaatacatcttacatctgatgacatcttaggttcaatggagtaagtataccttggggacctttttgttttggcgtattgaaattacctcactctttttcatggctgcatcatatctcattgaaagtatgctacatgatttttatgttggccctattttttgctatcacaatcaaggcaggaatgaagatccttatatataagttcttgcaaacatggaagaatatttatttcattgatttagcagtgttcaaggcattaagtgaacagcagcaagaccaagttcctgccttcatgaagcttacattcaacttgagggtgggaagtgagacaggaatataaataatataatttcaggtagcttttaatacatagaaactaagaggtcatgaaaaaatgtggggtagggctgatgatgatgctatttcatataatatgattaaggaagtaaaat

SEQ ID NO: 12445 - DNA, 5699 bp, Human
cccgtcccgtcccactgccacttaacccacagggcaatctgtagtcatagcttatgtgaccggggcagggttggtcaggagagggcagggcccaggcatcaaggtccaggcatccgcccggcattagggtcaggaccctgggagggaactgagggttccccacccacacctgtctcctcatctccaccgccaccccactcacattcccatacctaccccctacccccaacctcatcttgtcagaatccctgctgtcaacccacggaagccacgggaatggcggccaggcactcggatcttgacgtccccatccagggctgatggagggaaggggcttgaacagggcctcaggggagcagagggagggccctactgcgagatgagggaggcctcagaggacccagcaccctaggacaccgcacccctgtctgagactgaggctgccacttctggcctcaagaatcagaatgatggggactcagattagcatgggggtgggacccaggcctgcaaggcttacgcggaggaagaggagggaggactcaggggaccttggaatccagatcagtgtggacctcggccctgagaggtccagggcacggtggccacatatggcccatatttcctgcatctttgaggtgacaggacagagctgtggtctgagaagtggggcctcaggtcaacagagggaggagttccaggatccatatggcccaagatgtgcccccttcatgaggactggggatatccccggctcagaaagaagggactccacacagtctggctgtccccttttagtagctctagggggaccagatcagggatggcggtatgttccattctcacttgtaccacaggcaggaagttggggggccctcagggagatggggtcttggggtaaaggggggatgtctactcatgtcagggaattgggggttgaggaagcacaggcgctggcaggaataaagatgagtgagacagacaaggctattggaatcctcaccccagaaccaaaggggtcagccctggacacctcacccaggatgtggcttcttttcactcctgtttccagatctggggcaggtgaggacctcattctcagagggtgactcaggtcaacgtagggacccccatctggtctaaagacagagcggtcccaggatctgccatgcgttcgggtgaggaacatgagggaggactgagggtaccccaggaccagaacactgagggagactgcacagaaatcagccctgcccctgctgtcaccccagagagcatgggctgggccgtctgccgaggtccttccgttatcctgggatcattgatgtcagggacggggaggccttggtctgagaaggctgcgctcaggtcagtagagggagcgtcccaggccctgccaggagtcaaggtgaggaccaagcgggcacctcacccaggacacattaattccaatgaattttgatatctcttgctgcccttccccaaggacctaggcacgtgtggccagatgtttgtcccctcctgtccttccattccttatcatggatgtgaactcttgatttggatttctcagaccagcaaaagggcaggatccaggccctgccaggaaaaatataagggccctgcgtgagaacagagggggtcatccactgcatgagagtggggatgtcacagagtccagcccaccctcctggtagcactgagaagccagggctgtgcttgcggtctgcaccctgagggcccgtggattcctcttcctggagctccaggaaccaggcagtgaggccttggtctgagacagtatcctcaggtcacagagcagaggatgcacagggtgtgccagcagtgaatgtttgccctgaatgcacaccaagggccccacctgccacaggacacataggactccacagagtctggcctcacctccctactgtcagtcctgtagaatcgacctctgctggccggctgtaccctgagtaccctctcacttcctccttcaggttttcaggggacaggccaacccagaggacaggattccctggaggccacagaggagcaccaaggagaagatctgtaagtaggcctttgttagagtctccaaggttcagttctcagctgaggcctctcacacactccctctctccccaggcctgtgggtcttcattgcccagctcctgcccacactcctgcctgctgccctgacgagagtcatcatgtctcttgagcagaggagtctgcactgcaagcctgaggaagcccttgaggcccaacaagaggccctgggcctggtgtgtgtgcaggctgccacctcctcctcctctcctctggtcctgggcaccctggaggaggtgcccactgctgggtcaacagatcctccccagagtcctcagggagcctccgcctttcccactaccatcaacttcactcgacagaggcaacccagtgagggttccagcagccgtgaagaggaggggccaagcacctcttgtatcctggagtccttgttccgagcagtaatcactaagaaggtggctgatttggttggttttctgctcctcaaatatcgagccagggagccagtcacaaaggcagaaatgctggagagtgtcatcaaaaattacaagcactgttttcctgagatcttcggcaaagcctctgagtccttgcagctggtctttggcattgacgtgaaggaagcagaccccaccggccactcctatgtccttgtcacctgcctaggtctctcctatgatggcctgctgggtgataatcagatcatgcccaagacaggcttcctgataattgtcctggtcatgattgcaatggagggcggccatgctcctgaggaggaaatctgggaggagctgagtgtgatggaggtgtatgatgggagggagcacagtgcctatggggagcccaggaagctgctcacccaagatttggtgcaggaaaagtacctggagtaccggcaggtgccggacagtgatcccgcacgctatgagttcctgtggggtccaagggccctcgctgaaaccagctatgtgaaagtccttgagtatgtgatcaaggtcagtgcaagagttcgctttttcttcccatccctgcgtgaagcagctttgagagaggaggaagagggagtctgagcatgagttgcagccaaggccagtgggagggggactgggccagtgcaccttccagggccgcgtccagcagcttcccctgcctcgtgtgacatgaggcccattcttcactctgaagagagcggtcagtgttctcagtagtaggtttctgttctattgggtgacttggagatttatctttgttctcttttggaattgttcaaatgtttttttttaagggatggttgaatgaacttcagcatccaagtttatgaatgacagcagtcacacagttctgtgtatatagtttaagggtaagagtcttgtgttttattcagattgggaaatccattctattttgtgaattgggataataacagcagtggaataagtacttagaaatgtgaaaaatgagcagtaaaatagatgagataaagaactaaagaaattaagagatagtcaattcttgccttatacctcagtctattctgtaaaatttttaaagatatatgcatacctggatttccttggcttctttgagaatgtaagagaaattaaatctgaataaagaattcttcctgttcactggctcttttcttctccatgcactgagcatctgctttttggaaggccctgggttagtagtggagatgctaaggtaagccagactcatacccacccatagggtcgtagagtctaggagctgcagtcacgtaatcgaggtggcaagatgtcctctaaagatgtagggaaaagtgagagaggggtgagggtgtggggctccgggtgagagtggtggagtgtcaatgccctgagctggggcattttgggctttgggaaactgcagttccttctgggggagctgattgtaatgatcttgggtggatccagggccagattctcagacggtgagagaaaagcctggaatggaaagctgctctgaggagtttctttcggatggtggatgaacagaggagtctccacctgagcaggattggaaagtgtcctatgcttttgtgccagtgcttctgaacacagcgcaagagctgcgtgatggacactcatcatccgaaagcatttcctgagagagaagcgtgaatctccccggaagggagacccagaagccactggccaggcacttttctgcctggctgggaggaccagggctgactctattaaaaaggcatcctaatgaggttatctcacgtgcaatttggccagtcgtaagcaagatttcgtgtggtgacaaaatgaatgaaaatagtggtttggatggaaaggtctgtgggagagaggaaaggagttggtttttgactcaaattctacgatctttgagctgcatctggctagggaaactcacatacccaaattttgaagttcattctctaagaggaaatactttactgaattttatggatgaaacttccctttttggttaattattccatgtcctattaagttgtatattctctgataagtcctggagaacaacaacaacaaaatcccagagtggtagagtctgggctcaaataatattagcaataacagccacctgctagccattaaacttgtaatttactccaggccctgagccaggtgcttcacttgcatggcacacactccaccagtcctagcggaagggtctaatcacacctactacacagatgtagaaccagaggcacgcaaggcttgggtatttcccaggatcacacgcctagtaagggacagggctggaaccggatcctggacctgaattcctgcagagcccatgttgttcccactcctcccagcccgtggcccacctcctgagtaatacttcctttctcttctcaacactgtgccgtatgtctctggtgacaaaaagaaggaccccgaggccagcgtactaaaaacaggcctggggaaggtgacagtgagaatgaaacaccatttgaggctggtgtgcactgggttccttgacagctgactctgccaaggtgtgggcatttctgtcagtcccagcactttcccgaattgcagtgagtttcccctggccacttccatgtgtcctgtctcactctggaacacgggttgctgaccagcttgtcactagtccccacagaacagcccagaatcacctgctcaccccatgacaggccacattccttttccttgtagaagtcctctggatgtcccatctctcacccaggaagctatgtgatatcaacaccccttttgaattcccatgggatagtgatgtttacacacctggttaccactctgcttatcttcagtacactgtccaagtgctttatgaatgtgctgagtagagtctgattcgccatattatctaagcgttcttgggatgtcgccatgaaattagaaggttttggaaccaccttgatacttgaaattggactttatcagggtgtcttatttggagtttacctctgagcacatacacagatgaatgctttaaaaccaaagcctccctcatgagtattagatgaggggaagctttggaaatcagtggaacaaacatctacttactgaactcctaaatccctggaggccctgattccttgaagacacttctgctct

SEQ ID NO: 12446 - DNA, 11665 bp, Human
acggtgcttgacacagtaaatctcaaaaaatgcattattattattatggttcagaggtaaagtgacttgcccaaggtcacatagctggaaaatggcagagccgggatggaaatccaggacttcgtgactgcaaagcagatgttcattggttagtgaactttagaacttcaacttttctgtaaaggaagttaattatctccatctcacagtctcatttattagataagcatataaaatgcctggcacatagtaggccctttaaatacagcttattgggccgggcgccatggctcatgcccgtaatcctagcactttgggaggccaggtgggcagatcacttgagtcagaagttcgaaaccagcctggtcaacgtagtgaaaccccatctctactaaaaatacaaaaaatttagccaggcgtggtggcgcacgcctataataccagctactcgggaggctgaggcaggagaattgcttgaacccgggaggcagatgttgcagtgagccgagatcacgccactgcactccagcctgggtgacagagtgatactacaccccccaaaaataaaataaaataaataaatacaactttttgagttgttagcaggtttttcccaaatagggctttgaagaaggtgaatatagaccctgcccgatgccggctggctaggaagaaaggagtgagggaggctgctggtgtgggaggcttgggagggaggcttggcataagtgtgataattggggctggagatttggctgcatggagcagggctggagaactgaaagggctcctatagattattttcccccatatcctgccccaatttgcagttgaagaatcctaagctgacaaaggggaaggcatttactccaggttacactgcagcttagagcccaataacctggtttggtgattccaagttagaatcatggtcttttggcagggtctcgctctgttgcccaggctggagtgcagtgacataatcatggctcactgtatccttgaccttctttctgggctcaagcaatcctcccacctcggcctcccaaagtgctaagattacaggaatgagccaccatacctggccctgaatcttgggtcttggccttagtaattaaaaccaatcaccaccatccgttgcggacttacaacctacagtgttctaaacattttatatgtttgatctcatttaatcctcacatcaatttagggacaaagagccccccaccccccgtttttttttttacagctgaggaaacacttcaaagtggtaagacatttgcccgaggtcctgaaggaagagagtaaagccatgtctgctgttttctagaggctgctactgtcccctttactgccctgaagattcagcctgcggaagacagggggttgccccagtggaattccccagccttgcctagcagagcccattccttccgcccccagatgaagcagggagaggaagctgagtcaaagaaggctgtcagggagggaaaaagaggacagagcctggagtgtggggaggggtttggggaggatatctgacctgggagggggtgttgcaaaaggccaaggatgggccagggggatcattagtttcagaaagaagtctcagggagtcttccatcactttcccttggctgaccactggaggctttcagaccaagggatgggggatccctccagcttcatccccctccctccctttcatacagttcccacaagctctgcagtttgcaaaaccctacccctcccctgagggcctgcggtttcctgcgggtctggggtcttgcctgacttggcagtggagactgcgggcagtggagagaggaggaggtggtgtaagccctttctcatgctggtgctgccacacacacacacacacacacacacacacacacacacacacacacaccctgacccctgagtcagcacttgcctgtcaaggaggggtggggtcacaggagcgcctccttaaagcccccacaacagcagctgcagtcagacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggtgggcaaacacctagtctagagttggggagggctgtccgtgagggtgttgagtgtcccagagaggatgcagggcctcagaggagatgctttaggggtgtgttggtggtgatgggcgtatctgaagaacagaggtgtccagggttaggcagtggggggtcttgtggaggctttgagcagtgatggccagaaatgggcaatggggctttcctaggtgggaaatgggaaatggtttggggtgggggaggcattggagggttctggggtaagcataggctgggagtgaacaggggcaaaccttatgcagctgtggggtagaaatgggctagaggcatccaggggtgagaaggagctgaggatgtctaaggaggggagatccctgggtggtcagaaagcactggtgtctggaaagcatttaatgctttattaaatgttagtccctgctgggcatgacggctcacacttgtaatcccagcactttgggaggctgaggtggtaggatcgctgaagctcaggagtttgagcccagcctaggcaacatagtaagatcctgtctctacaaaaaaattaaagaaatagccaggcacagtgatgtgcacctgtagttccagctatgcagaaggctgagatgggaggatcgcttgagtccaggaggtccaggctgcagtgggctgataccgtctctccgaaaaagaaaaagaaaaaagactccctccatgagtgtctggagggagtcctttggccccagctgggcagagaaaggggtcagagatctggcatgtgtgtgtcccttcatccacaggaatacctgtaccgctatggttacactcgggtggcagagatgcgtggagagtcgaaatctctggggcctgcgctgctgcttctccagaagcaactgtccctgcccgagaccggtgagctggatagcgccacgctgaaggccatgcgaaccccacggtgcggggtcccagacctgggcagattccaaacctttgagggcgacctcaagtggcaccaccacaacatcacctattggtgagccggggccgtgggggcagcggggtggggcggggaggccaggtctggctcttgggccagcggtgaacatgtcctgtcttggacgcgtccctgggtttcactatttaatgtgtggcccctggggagtgtccccacctctgagcctctgtttctccttcagggaaatggctcttgcaatccaagtcctcctgccagggccattgtgagggtctaagtagacaaaaaaaacaaacaaacaaacaaaaaaaaaaacagtctggaagcaatttatagatgagagcgtggacggcagagagcattgtgtatgttgaagtctctgcgatatggggtgtccctgctgccccgctccagcctttcacttctgacctccttcctctggctcttacgctacaggatccaaaactactcggaagacttgccgcgggcggtgattgacgacgcctttgcccgcgccttcgcactgtggagcgcggtgacgccgctcaccttcactcgcgtgtacagccgggacgcagacatcgtcatccagtttggtgtcgcgggtgagaacgtgaggagggaaaatccaagagacctgggcggggtcagggaagggaggaccacggagagcgtggaggcagcagtggccccggcttcctcttgcctgcccgcgctgccctggcttatacggcccctcctgccagacagtgcacagggccagggcgccaggctgggagagcttcgcgcaggcgggatttcagcccgcacttatttcggagcccttgccttgggcagcgcacaatctgcgcagcagtactcggctaaccctcttcctctcgacctgtttcttcagagcacggagacgggtatcccttcgacgggaaggacgggctcctggcacacgcctttcctcctggccccggcattcagggagacgcccatttcgacgatgacgagttgtggtccctgggcaagggcgtcggtgagattctgagtcctcctggcccctgattcccttcattctctcccactcatcacccgccgccctaactccggtcccccctcctcctgcagtggttccaactcggtttggaaacgcagatggcgcggcctgccacttccccttcatcttcgagggccgctcctactctgcctgcaccaccgacggtcgctccgacggcttgccctggtgcagtaccacggccaactacgacaccgacgaccggtttggcttctgccccagcgagagtgagtgagggggctcgccgagggctgggggcgcccaccacccttgatggtcctgggttctaattccagctctgccactagtgctgtgtggcctgcaattcaccctcccgcactctgggcccaattttctcatctgagaaatgatgagagatgggatgaactgcagaccatccatgggtcaaagaacaggacacacttgggggttataatgtgctgtctccgccttctccccctttcccacatcctcctcgccccaggactctacacccgggacggcaatgctgatgggaaaccctgccagtttccattcatcttccaaggccaatcctactccgcctgcaccacggacggtcgctccgacggctaccgctggtgcgccaccaccgccaactacgaccgggacaagctcttcggcttctgcccgacccgaggtacctccaccctgtctaccaggttcagccccgccctctcatcatgtattggcccccaaaacgcggctcttccctcccatcagtttgtctttccactctcattggtcctcaggacgaccgtgactccgcccacctacaccacatttccaccactatccctgacttccaatggccccgccccagccactaaggttcggccttttctgcccagctggccgcctcttccttggtctggtgtcccaggcaccgcccacgggtctagcctcttctcaggagtgctctacagcgccccctaggccaccaagattgtttagctccctgtcgggtcggcccctgactccttattggactcatccatctggctcatccaaggccttgggtctctccagctgactcgacggtgatggggggcaactcggcgggggagctgtgcgtcttccccttcactttcctgggtaaggagtactcgacctgtaccagcgagggccgcggagatgggcgcctctggtgcgctaccacctcgaactttgacagcgacaagaagtggggcttctgcccggaccaaggtaggcgtggtcccgcggctccggggctggggttcccggcagtggtggtggtggggtggccagggctgggggctcggcccggcgctcacgtctcaggctccctctccctccaggatacagtttgttcctcgtggcggcgcatgagttcggccacgcgctgggcttagatcattcctcagtgccggaggcgctcatgtaccctatgtaccgcttcactgaggggccccccttgcataaggacgacgtgaatggcatccggcacctctatggtgaggcaggggcagggatgggaggaggaggggaaagggcgtggctgtgccacagtaccaaagaattgggggttggggatcgggggaggaacggggcgtgcaggagaggtgggacctcaacgtctgtctggaagcagagcctgggcccagtcgctgccatgtcagtgcttagaggtggtgataaagagactctagagagagataggtgtgacttcaaaagccagtctactctgggcatggtggctcacgcctctaatcccagggctttgggagacccaaggcgggaggattgcttaagcccaggagttccagaccagcctcggcaacatagccagactcccatctctacaaaaaataaatgagcaaggcgtgaaggcacatgtctgtagtcctagctactctggaggctgaggtgggaggatctcttgagcccaggagttcgaggctgtagtgagctatgattgcaccactgcattccatcctgggccatagaggatgtcgcttaaaacgaaaaagaagaagaagaaagtcctgtggtttgggaagggaggctgagtgaggaggggcctgtgtgccagaggaggcttcactgagaagcttaggggagcagatgttctaggggtacagaggtatgcaggaataggaagagtctcaccccgtgtctctttttaggtcctcgccctgaacctgagccacggcctccaaccaccaccacaccgcagcccacggctcccccgacggtctgccccaccggaccccccactgtccacccctcagagcgccccacagctggccccacaggtcccccctcagctggccccacaggtccccccactgctggcccttctacggccactactgtgcctttgagtccggtggacgatgcctgcaacgtgaacatcttcgacgccatcgcggagattgggaaccagctgtatttgttcaaggatgggtgaggaggcggggttgtgtggatgcgggagggggctttgcggaggggctgcccgtcccttcccgcccactggccctgtgtccaaggcttagagcccgtcctttccctcctcgctttctcaggaagtactggcgattctctgagggcagggggagccggccgcagggccccttccttatcgccgacaagtggcccgcgctgccccgcaagctggactcggtctttgaggagccgctctccaagaagcttttcttcttctctggttagttacctactttccctcccccgcccggtcaatccccatcagtcaaggaggctcaagagaccatcgataacccacgaaacgtcttgtgcgttttagaaaaatacgccccctggcggacgcagtttagcaaacgtaggggcggctgagtttctgccccctcctctccacgccctcgcgtcgctctacccagcgcctctgcccctgggttgcagggactgcgggcacgcgggctaggaaaggcctcgccggaatctccctcctcgcgttctaggagtacgtgctccctctgcgcccccaaaccgacgtgaccctcctcccctgcagggcgccaggtgtgggtgtacacaggcgcgtcggtgctgggcccgaggcgtctggacaagctgggcctgggcgccgacgtggcccaggtgaccggggccctccggagtggcagggggaagatgctgctgttcagcgggcggcgcctctggaggtgagcgccgccgcggccgccggcagggggagcccgggcgccgtcggtccgtccgctagccggctcagcacctgtctcctccgcgcctgcccgcaggttcgacgtgaaggcgcagatggtggatccccggagcgccagcgaggtggaccggatgttccccggggtgcctttggacacgcacgacgtcttccagtaccgaggtgagggctgaggaggatcccttcgtgagacaccacactaagctcctcttagtgagtggtcaaattctgagcgaggaagaaaaagcccttggaaatggaaacaaatgccccagcacagacaagatcccagcagaggcagaggccttctccaggtcatttaggaagtcagggatgcaaccaagaccaggacccagatttcctgcctccccggctggaagctctttctccttcagtacaggacggcaggtggtttgtatggaagctcagttattagacaacagtcatcaagtgccgataatgtgccaggcactgtgctacagggagagataagacaattcacagctctgtgactttgggcaagtcactgcttctctactcttcgagcctcagtttccccatctgtaatatggggactatagctggaattacacttgacttccctttcttaccagtcacatccaaacagttgacaaggtgaacaagatttcctgccaccaaaatctttttcgagtctgtcattttttttgccatcttctttataaacaccccagcccaaaccatactggctgtccaggacctttaacaaattccatgagattagagagggggtaggagtgaagggcaatggtcttgggagtgaccccagatgaattccaaggtcaaagaaattaagaggatctgacactccacccccgtgttctcatctcttcccactcctcctgttatttactctgctccacccacactggctgctctttgaacagatcaaggtcattcctagcttacagcctttgtgccagttgttccctctgtctggaaagcttcccctccagattgtcactgggccatcccactgtcttccttcaggtttcagtgctaaggccattgcttcaatgaggccttctttgatgcttattatctatttacttgtttttattttctccatagctttctatattttctttttttttcttttttctttttttttttttttgagatggagtcttgctctgtcgcccaggctggagtgcagtggcacgatctcagctcactgcaacctccgcctcccgggttcaagcgattctcctgcctcagcctcccaagtagctgggattacaggtgcctgccaccacgcttggctaattttttgtattttttagtagagacggggtttcaccatcttggccaggctggtcttgaactcctgacctcgtgatccacccgcctcagcctcccaaagtgctgggattacaggcatgagccaccgcacccagccgctttctatattttcaaaaccaatctcatttatttatgtgtttgcttaattgtctcttgcctcactagagtgtaagcaccaagataattgagatcatgcctgcattttttctgcttatccccagtatcttgaacaaagcacatagtagatgctcagtaaatgatgaatgaacagatttgttcaatgaatgagcgttgaatgaattgttctgagcattaagatagttggtctattcatttgttaattcattcacaaaatgtgtatggtgtacctactgtgtgctaggctctgtggcagtgctttgggcactgaggtctgtgccctccagcatctcacagaacctcacagcatctcacaggttggggggatggaggtgatatgtgaaaaccttagaaagttctagaaatggcagaagagatggttgtcaagatcttgttcctatttctgtatatgtgggagaattagaatcactcctcttatgcctgcctgtctcctgcagagaaagcctatttctgccaggaccgcttctactggcgcgtgagttcccggagtgagttgaaccaggtggaccaagtgggctacgtgacctatgacatcctgcagtgccctgaggactagggctcccgtcctgctttggcagtgccatgtaaatccccactgggaccaaccctggggaaggagccagtttgccggatacaaactggtattctgttctggaggaaagggaggagtggaggtgggctgggccctctcttctcacctttgttttttgttggagtgtttctaataaacttggattctctaacctttagaagcagactttatttatatatgtatgcacgtatgtatgcatgtatgtatttaactgatagagtgcaaaaaaaaaaaaaaaaaggaaaaacaaataactgatagagtgctttctacgtgccagaaagtgttctaggccgggcacggtagctcactcctagcactttgggaggccgaggcaggcggatcacgaggtcaggagattgagaccaccctggctaacacgatgaaaccctgtctctactaaaaaaaaaatagaaaaaattagccgggcgtggtggcgggcgcctgtagtcccagctacttgggaggctgaggcaggagaatggcttgaacctgggaggtggagcttgcagtgagccgagatcacgccactgcactccagcctgggaggtggagcttgcagtgagccgagatcacgccactgcactccagcctgggtgactgagcaagactccgtctcaaaaaaaaaaaaaaatagtgttctaggcactttgtaaatgttaacatattcaatcattcctgttaggaaagtatgatgtgattatttctattttacagtcaaggaaatgatcaacctgtttattcattcatcaaacatttattgagcccctacatggagccaggccctgtactgggcaatggggatagagaaatgagttagactttagaatgcataagattccccttggaacttgcttaaaatgcaactccaggctccacctccagagagtctgacctatttacaagggtgattctatggctggtggcggtgggatcacacttggggagtgtgcagtgcatgatcttttattctacaataatggtgtgtgtgtgtgcacatgtgtgtgtgtctgtgttgtggttgaggtccaggaacgtttctcagtcaagatgacatctgaaccggaactgaatcagaaaggatgaacgagcttcttcctgtgcaagggacaatcttcttacagggtaatttaccaagaaccactaaacctaaaaatgtaactactttctgaccctcacatgtgtgcacaagacaacacatagaaggatgttgattgcagcattgtttgttagtgaaaaactggcaataacctagctgcccaggagtaagtcagtggataaataaaatatggatcatatacctgacgttagtagctatccacggtacagcactatgtgccaggcactgttctatgtgcattttgtgtgacaaaacaaccagaggagataggtactcctattactttgtatgtactattattactgccatcaccaatcccttgttttacagataaggaaactaaggcacagagagttatacaactcacccaaagtctcatagctagtgagtgataagagtgggatttgaatgtgggttcttggtgcaagtgcacgaagagaaaaagaagagaaaaagcagtgggtgtctggagaacttcaaatggctcagaactccagcatggggtagtagcaggtggctaagagggaatggagaggattccagaatggttaagatagcagtgctagtttgggctagatgagagaagtcctgaatgccaagctgaatatgaatttgaccttacaggttagcaaagggacttgactgaaagattggggcccgtgagtggagatgatgggtttgatcagggcccacgtgggaatttaagtaggagtccagaaaactgccctcctgagcttcctctttcatctgtttcttgctcaaatgacccactcccacttggcgtacaaacattccccgccatggcttgtttacaatctgtcttaacccctgcctcccactagatactagtctatttctctaccttcctatccctattcacaataaaacttcccaaaagcatggtctctactcactgtctccacttcctcaattcccattctctcctcagccatttccagcctggctcccaccccactacaccaccaaagtcaccctcttcaaagccatttatgaccttcttgtagccagatgtgac

SEQ ID NO: 12447 - DNA, 102738 bp, Human
atgggactagatatgattagggaaagagtatagatgtatgtgtggtaatataagtctgaagtagtggtattgattcacttctatgaagactcttcatctaatttgtcaacttggaattgtacataaacctgatagcgtttgctggatagggaaagcaactcactttgtagccactgcatagacgacatcaaccaacaagcaagttgcaaacatgccaatagttagctgcttttgaatgaactgtatgccaaacgtccttgactttcatgaaactacacctgagagcatccacatgaggatccacatttgagaatgccacacaaaaggaggattatggcacatgaatcagcttttctttttaaatatagataagtagtgaaaaaataagtgcctgtcaagatgacatctgggatcatttaccagatgatccattgttacattttagtctcatagcatccaggctcattaaaacaaaatattttgcatgtcacggattgttttggctactctttagagacagatatgaatgttaaatctcagaatgctaagtatgaaagaaaccatacaggggtaatggaaaaattaggttagaattcaccttaggcaaaaactgtaaacaatccaaatattcatcaacagagcaataggtgaacaactgtggtatagtcattcattggactagtacgcacaacaaggttaaatatgttgaaagcaaaaacagtttgttgaatgaaagaagacagacatgaaagaatacatactgtatgatgtcacttatatgaagttcaggaataggcagaaactaacagaacagtaggaatgcccatggggaatggttattgaccaaaaggagtcatgagacaactgttttgttttagaaacagggtcttgttctgtcacccagaatggattgcagtgatacagtcatagctcactgtagcctcaagcagtcctcctgcctcggcctctcaaagtgttggcattctaggcgtaagctaccactcatgaccttgattggagtgtttcataaatggctatatccatttgtccatattcgtcaacttgtatacttagatttgtacatttcactgtatgtcagttttacctcagtggaaaataagaaaacaacaaaaatggcatactgagtagttccgtgaggatgagcttcgggagcacatcagtccattctcagagagtgagggaaagtttcccagagataataatctctctttttatccttttacttccacagttgatttatttttttcaactcttagctacctccccacaataatatctattcctatgactatttaatttattgtgcaaatgcagaatactttagggagcaaaaaggagtgctggtataaattacactcaactggtaaaaactatcattgtttgcttctgttctagtcagagggttgtactctactgcagtcatacctgaaggaaggcagtagtagagcaggtgtacctgagggtggaacaacctctgcttggcctcatctaaaagtagataaagggggccgggcacggtggctcacgcctgtaatcccagcactttgggaggccgaggcaggcggatcacgaggtcaggagatcgagaccatcctggctaacacggtgaaatcccatctctactaaaaatacaaaaaattagctgggtgtggtggcagatgcctgtaatcccagctactcgggaggctgaggcaggagaatggcgtgatcctgggaggcggagcttgcagtgagccaggattgtgccaccgcactccagcctgggtgagagagtgagattccgtctcaaaaaaaaaaaaaaaaaagtagataaagggggcagagttcagcaagaggcaagggaggaggtggggattttatgtggcatgggcagatgtgtttgttagttgggacttacatgtgaacttttgaaaaagatacattatttgttttatatatatttcaaaactgattcatgttgctgtatttgttcctttgaaacaggtgacagtggatagtggaaacaggagatcgtggatcctccttcaaaaatggaggatggaaagcccgtttgggcgccacaccctacagatggatttcagatgggcaatattgtggatattggccccgacagcttaacaattgaacccttgaatcagaaaggcaaggtgagtttctcagaaagatgttgaaatatgatttctttcaaaaataggtgttttttttcacaagagtaaggtctgtcttcttaatgaggtagatatttgggaaagcatatttctggtaagtgagtctgttttctcctgacttctttgattaaatcagaggtatgtgccctagggaaaaaatggtgccctatgataaaatcagatggaaatttagtgagcctttcattctttgtttttttcacatccctttgatcatccagttcttagcctttcattcttaagaactagctgtatgataaaatctaaacaataatgacattttaatttcttgtgccacattactaaagttattagtgtgtctgtgatcgacatgtcacaaagtaaaaatatgaaaagtgaatgtggagatatcagattttgcttttttgccttagcttctattataaagtctttttttaaagttttttgttcacttaaaattattgctatcatttttgtaatagatgctttaattctgtacacatggtatttatttctttgcatgcttagacataaactagacagcattacaaaatgaaagtctgagggaaaagtgactaggagttgtgactcgtttacagagaaggcatcattgtaaatacctgtttcagtcttcatggagactgatacagtctgtttttgtggaacttcactccattctcagagagtgaggggaagttttccagaggaaataatctctttttattcttttggttccacaattggtttatttttcaactcttagctctcttagcacagtaatatcttattcccatgatagatgtccacaatttttagtttaataagtatgcctgttaaacagttcttctgactaaattaaattttgtaggtgtcatttctgtttactttagactgaaaatgttcatgaataatttatattctatgatacatggctaactaatgccatatgactaccatccttctgggaaccttagaaaaacaaggtggatctctcatgaggtcttttcacagagaaaactattctgttactgtaaataacccagggactgaaatgcataatgtataatgtgccatgttagaggaggccagttaaagataccctcaggacaggaaagacaaagtgtttctggtttttcctcttattagcaggtacctatttgtacttaaaattcagtacatgtttaaaaaaaaaagctcagttactttacatatttgaaggcttttgatttttgtttaacatattttataagcacagtaaatcagaagaccaaaatgaaattgagagtgtatttcctaggtgtttatatatagttgttatgtatattttgttgtattcacaggtgacaaaacaattcagttcaattatagaagaaacttgatttaagtggatatactttttcatattttaaatattttaatatgctttacactcttattcaggtacatatgtagaaccaataaaaactgtttacattagggagtgatataaatttcatggatctgtagataattctgtgaactaaagtgtacgttttttccacaaagttttttttgaggattaacaagttctcagagattacctttaatcttaattttcctccctactttctgatcaggttcttaataaacatactgctgtaataaccagacagttaaaaagatccttaagagaagcaatcttttgcttagctcattcattgcctagagataatcagcttcaaaataattattaaggaattaagtacataaaggggtggactggtcatgcacacctttgtgcagtgtgtgcgcagtggaagtacagtggaagtgtagatgagggagtgaggaacatgtcttgatagcaatggcttttcaaggtttttgtttgtgacccatagtaaaatagatttcacattgcattagctatgtgtatttatgtgtgtgaatttataagaaataaattttacatttcaacaactgtgtgtgtagtgtttgtgtgtgtttacttataaatgaaacagttgatcaaaagaaacattcttagcacatgctatgcattttgataatttctaataacttttattcttttaaaaatgctgttttaggctagctgcagtggctcatgcctgtaatcctagaactttgggagtccaaggagggaggattgcttgagctcaggaatttgagactagcctgggcgacatagtgagacctcatctctacaaaaaatttaaaaaattagctgggtgtggtggtacatgcctgttttagctactctggtggctgaagtgcacttaagccagcaggtcaaggctgcagtgagctgtgattgtgccactgcactctagcctgggtgacagagtgagatcctgtctcaaaaaaaaagaaagctattttaatccactaaattggtttcatattctgtatttgcagcagtggtaagaagccgctctgaagccttgtaggctgaagccctaaatttatggcatagaagggtctgcattttcttttccctgtctgctttgctggtcttctgttgtgtcaaccaagtctccccttcatactcttactcttgtgtgcctctttctccttctcttctgcaagtattaagtccttaccataccccaggtgatgttatgtgctttgtgtcattgctaacattgctcctgcctggagtgccactatccatacctgctctttattttatttatttatttttgagttggagttttgctattgtcgcccaggctggagtgcagtggcataatcttggctcactgcaacctctgcctcccgggtttgggcgattctcctgcctcagcctcccgagtagctgggattacaggtgcccaccaccatgtctggctaatttgttgtatttttagtagagatggggtttcatcatgttggccaggtttttctcaaactcctgacctcaggtgatccacctgcctggggctcccaaagtacagggactacaggtgtgagccaccgcacctggccaatctccatatccttttgcttagaaactacttatttttcttttaagactctgattgaggtcaccttgtttatgaagtttttctacagatacccaatctctccctcccccccattcagtagaattgactgttgactactttttcctttgaggagtggtataaattcttagctttcctttactctttgttggagataattgtttactttgtctctccctccctactagactatgtaatcttctcaagtgcaggggctattttattctgtcattagagcttgatgctctgtatttgacttgtggtaggtgtttaatgctgagtgatcaagatatgtttttagcagaaaaaagcctccttcttctaagagaaaacaattaatgaaacattttaaggagagaggaagatggggtggtgataatttaaagaataaagaaggagggagagaaaacacctttcaggactccttactggccttttagcctgctcttaactttctcattccagcaactctttgtcattggcctcccctcatccccactcccctcatcatctaacttcttggaacctttttaatttgacatggctcctaccaggcagagctaaaccctgaagtctggggagcccgtaaccctcttgccatggctgtgaaagttgggcacatacatatatgacattagcagttatttctgaatgcattttcctatagaatcattattataaattgtggcttgttttatattaccattaatatacttaatgcacatgatgggttaattttgcttttgtggcctgtcctacaaacttctccacatttataacattaacaacatgtgtactgggttccaagtaattaacttccagagtttctatggcataacagttttctacattgggtgtgacttagaattgaggtagtcccagcagcgtggattttactcattatagttgtagctttacacacacacacacaaacacacacacacacacccctataaatattattttaaaataattgaaccatttttccctgcagttttctttgatacaattagaaacttcagccacaagagtaattgtcattgtttgagaagtactgtatcagcttataaataactgtgagaatggcatggattaaaatttaattctctttggatgtcatttgagatcatttgttctctcttatgagatgttatcttaattctgcagtgttactctagcatttaagtgataaaataaatataagtattcatggatacttgtaattttacagacgaaatattttttggtattttttatatttctgacagatttttgtacaggagtttgtgtcaaatatattttactgaaacaatagctattaatataaccctctggttatctgattgaatgttatttttttctgtcttttttttttgagatggaatttttttctgtcttttttttttgagatggaatttcactcttgtcttccagggtggagtgcaatggcatgatctcggctcactgcatcctccacctcctgggttcaagggattctcctgcctcagcctccccagtagctgggattacaggggtgctgcatcacgcctggctaatttttgtatttttagtagagacggagttctaccatgttggccaggctagtttcaaactcctgacctcggatgatccacccgcctcggcctcccaaagtgttgggattataggcatgagccactgtgcccggttactttttccttttttaaaacactgaaattgctgtatctaccacattaacattttatttaaaaaaatttgttaaatagcatatgtatgtaaatttaatattaatatacctctttttttgtccttctttaggtgttggagcctaggatacttacttactgatttttattgttgatttcatgtccacagtaatagtagataatatttttgagtaaagttattgttctgttttggggttaatgacttgttaaatagtattatctgtattatattttaataaagagcatattgttgccactattacagtgtatgcaaccaattaagcccttctattgttcttactatttaaaagccttgagtttaatgagcatttgttttgcttgttagacatttttggctctcataaaccaagtgtttcctgcagaagaggacagtaaaaaagatgtggaagataactgtaagtaccaagttaaaaattaactctccgcacagaaaaggagactgttcttttaaaaaaataaattagtggttatataactgatacactgtgcgggttcagaaacaatctagtcttttgacatgaatattcatgtgaatgaaggaactcgagtcctccatgttgtctcacatttgcattttggtgaaagagtcttgagtgttcttttggtgttatttgagttgcataaatgtggggaatggtaattactgtaaggcttgaactaaaagtctcttgttaacagttttgaaagttattgaaccttatttagagtcaggtggtttttattgtagtatatgtggttcagtaatttggaagttgagtcagtaggagtcatttaacatcaccgtttgaagcaaacatgcatttaaaaaaattctatataattactaattgaaaaattaatttcagaacaattatattaaaacacagcattaatttgacttataacatctttgcatgtttgatgaaaaaagctcttctcgatggaacaggccaatgtttattcttacatttttaagattaagcagtaatcatttcatattgggggcagcagtgttaacaattatgtacacttgtcatggatttcattaaaggtacttgacactaacaactctccatttaacaaaaaaaggtagtgttaacaattatgtacagttgtcaaggtacctaatactaaaaactctccatttgagaagaaaaggtaagagaaaggaatagatgtgttattattgattttctctggaattcacatttgagtaagactataaaacccccatatgtagaatggtggcagcatagactagtgggagtaatggggagccatggactgtaactgtagagttaggcaagcctaaattctgattctatgttgttaggaggctgtctgctcgtgggcatttcgtctctcttctgaaattctcatctgtagaatggaagtaatgtgtatgttgtatgattagagatgatataaagtgctttgcacagcatctaatgactcttaataaatggtagctgtttttattaggtgcaagagattgaggaaaaaaatgtagaattcccttcctttccaaaattgctggagagtttgtctgattaaataatacatttttgaatagcaatcagaataaaataataaggaatgagactgtaccatatctaaaatacaaatttttgtgctgttaaaacttgctagggtgtgcagaactgggaatcaatccttttcatttattaatgtgtatgtctctaaatgtgacaaatggttttgaatagtttttaatccatttcttaaattaatattttaaaacattctctctccatttgctttgtcttgctatgcttgtctaacttacaaatttttgcaacctcagtatttgctgcctctggcaggtggtttccttggtgatgccagatggcagcagtgttaatgtgtgggtgttaactattctcataagatagtagcccatccctactgaagacacttttctgaaaccacattattaacacaactttggttgttgagtttagaatgtagggtttccagctgcagtggttctgtcacttagtactttcatctgaggcatgccaccataccactgtcctctgctgaatgacacactgtaacacaaagctatagtggtagctttgtgttatacacttgcacacacacacacatgcacacacacacagggtctcacatgcatatttctaaaattcttttcttctttatattatggtaatgtgaagattaaatgattgatgcctgtagagagtgttctgaagtatgtgttgaaggttctactgaaacagaagtagtgccttaacagtgccttaacagtgtagcaacacttattacctacttttcggtctaaatttttttttttttttttgagacagtctcgctctgtcacccagactggagtgcagtggtgtgatctcagctcactgcaaccttcgcctcccgggttccagcaattcttctgcttcagccttctgagtagctgtgactacacgtgtgcaccaccatgtccagctaatttttgtatttttagtagagattgggttcactatgttggccaggttggtctcaaactcctgacctcagatgatctgcctgccttgggctcccaaagtgctgggattataggcgtaagccactgcaccgagctatagctctgagttttctatgtgaagggttttatatgtagaaattagtatgttaattttgctgtttgactgttgcttattgtcacaagaataggaaaattgggcgtgtgaagtcagtaattaaaaggaaaataatagcatttttccatgctgattttgagctaccatgactttcatggcacataatgttcttcgtgaattattgtctattagatgttgataataataaagtatagagtataaaattggaaagaaaccgggcgcagtggcccactcctgtaatcccagcactttgggaagctgagatgggtggatcacctgaggtcaggactttgagaccagcctggccaacatggtgaaaccctgtctctactaaaagtacaaaaattagttgagcatggtggtgggcgccggtaatcccaactacttgggaggccgaggcaggagactcccttgaacccaggaggcggagattgcagtgagccgagatcacgctgttgcactacagcctgggtgacaagagtgaagctctgtctctaaataataaataaataaaattggaaagaattctaaaagttgcctcagtctctttttctgtaatggaatgacttctacaacaacatatatttagaattgattgacttctgtgttgaagttgtttgtgggttctttttttcttttagtgagccagagctgtaatgattaaacaggatcttaaatgctcagataactctctagtcagatatctaaatttaataatgaagtcatacctaatcttcattagaaacttttgtatatgttatatatttatttattaaaacagtgtttataaagaaactaattgtttattcaaatattttgttatatgtcttatgttaaattgtttcaaaattttaatattcttttgggtatagttaaatctgttaataattaggcataaaaggtaaacagtttacataaagagttgcatgtaaatagccaagccaagtaatcctaggactgactactaggaaaggacaggaggaaggaattatttggtagagcaggaagttatttgtgaggcccttgtggacatacctaggtcatacctttagggagatgtaggcagttgggacttagcatttcacattctggcaagacagggttgcaaatattttcctctccctctctctttttctgtgtcttcttgaaaatggaatggcctgtgtggcatgatttcagaggaataccctcctgtccaaattcttattgtcatcagcagatacttcatcagttaggaatttatttggtttaataaacacacatccctgaaaaggtaggtggtgagtgtggaaggagtaaagataggagagcaagtagtaattcccatgtctgtgtaggcttatatgattagcgttcacaggggaagcgtactgtaggattacgagtttttacttagaggaagcagtgacaacatcatgcaaccaggtatttcagaggaaagtgagagagatggggagtggttcaacagagtgctttgggtaaagaaagaggaacgtgtagaccaggctccaggggacaaggatggaagattagggatatagaaaggtaggtgacctcatacccaaaccagatatattaatacctctgctgcctaaccctctctatatccttccttaattcaaaggaaagctgccattcagctgttaggagcctctacccacttcttactctcttttattctgccctaagtggcactagaaagcagtgaggtgactgaggcaggagaatcgcttgaacccaggaggtggaggttacagtgagctgagatcgtgccactgcactccagccttggcaacagagtgagattttgtctcaaaaaaagaaaaaaaaaagcagtgaggtgaaagtgaactggctgcattaaatgattatagatggatgggcagtctgtggaggtagttatggcaagaggctcttgtttgacaccattggttaggtgttgaatagtatgttagacatacatgcagtgtaggcacatgagcagtttcagtgagggatcaaacaaatgaatcaggcagcatcttgcccccaaggatctgatttagtagacaaaaccagatatgtaaaattatcataataacactggcagtgtgtggtaagaaccataaagaaattgcaaagatagtagttgtagtggtggtggtgagaatgggtaagtgtcatttgtagggtaacctttgtactgaccttaaagagtaggtaggtttttgacacctagaaatgtagaggatattctacatggaagccgatagatgaatgatacctgcatctaataaatagttcagtctgtctatgagttagtattaaggtgaattgtggaaaattatatgaaaaggtcatgaatgtaggtttattaagagctctgatcagacatgaatttggatgttgatagagacccagtgatgattttatggggagagagatttgatgagggctctactttagttaatgtgctgagaagtctggattagagaggagagagactgaggcaataggtaaataagaggctaccatgatcacaaaagaggtaatgagaactaaactggtattggagcagtagaaatggaaagaaaggagataggttgagagattcagattatgctttgagtacctgccatgagctggcactgtgctgtactttcttacatggcataaagatttggaaactggtttagaataaggagggagagagaagatgattttagtgttgactaaggtttacaatttcagtgacagagaaaatggtggtgctaataacagaaacaaggtggttgagaagaggagtggtttttgtctactctagcaaggcatagaaatggagctcaggagattgaaggacttggagaatagattgggagtcagttctgacacttcagtagagcagatgtcacacaaacaagatttatctgttcaaactctcccattaattagcttcatattctcagttaagacatacataatttctctaggagtcttcattatgtcagttgtgaaggactccctgaatgatttgatggtctgttcccattctaaaattttatcttttgtgttttatctgtgaaattctgagtatcagattggattggtgtcatcactttgttgtgtcagaagtatattaaaatcagagctatctattgtagtacttttttccctcttgaattgtgctttttaatcaaccttcattaatgagtactcactaggtttactcttttagttgaaaattcattacttaaaaatatcactgtaacacacatgtaaactgaatcgcttttaaatcagcttctagggtttacatcagccagggttttaaaaaagatggagttaaatgtaacctaacaattgatttttaggatgagtcaaagtgattcagattaagatagtattgctttattttatttgttttcttcaattctctaatgacatataaattttatgtcttaggttcactaatgtatttaaatgaagccacactgctccataatatcaaagttcgatatagtaaagacagaatttatgtaagtattttacctgtagtgtaagtttttgtggagataattatttcatgtggtactctttgattttgtcacgcttgaaattgtctaacagaaaatcatgcttgatctgagcctcttgaatagagtgtgaggttagtgaggacaaagatttttttctaatttacaactcgaactctaggagttaaagcatgcctggtacacagaaagcacttaatcagtatttgtgggatgaaataatgaattcagagtgtcgtttaatatcttttggacttaaaaatgtccagtttgagtatttttaaaagcactgtaatggtttttggttttgatttttgacttctggtatgtctgtagatatgtttgattcactttccacattgtttggaagacaatgtaaggcagcctataaggaatgtatattgaaattaaaaatttgaatgaggaaaaaaatgtaaatcagaataggaggtagtatctgaggaaatactaagaacacaggaatgctgaccatagagcctaaatagttgctgaatttcattagaccgtaggtactctaccttgaaagtccagaatattcaaaaatgaaagaaaatgctttcagtgtaaatagtcaaggtttacaccaaatcattcagatggatacttaacctagtatgttttaattataattattctttgggcatgcatgagactttattccagtatcacctaactgtgtagtcctttggtgactggagataaattaccccactgtagttctcctgttataaagatggggctgttcattatttttgaacgaagaaaacacatggcttctttgacacttactagatcaaatgacagtcttaatctattatatcactatcagtttgcctaattgtacttacttaattctgactaaattacatttagtctctgccatctgtccaagtagtgacagctgggagatagaacttatttattctattccaaaagagtatacttgccatcttctagttatatgtagttttaagacttttctccctgattttttcaaaatcaactaaataaagaacatatttaagtttaaatgtggctattcttgattagaaatatatttagaggcaaaatttactcaatcagctgactcatgttgagtatctaatatgtgctaaattccaaaattaaaagcaagcttaagttgctcattaaacatttaacccataaatgttctaggcaatggttaacatatattgtttggaagaaatctgggaccaaatggtcactacagagctaaatcaatccttggcattcagtgatagggatgggcccagaaggtgctacgagctgtattaaactccttagtagcagggtgaatacagtaggtaaggaatacaaatgactaaaacttagcggtaggagatttcataagtagagtcaacaggagaaggctgaatgagatagagctagagactcagatttctgtctgtggtgacttggtggtgatgccatgtccctgaggaagcacatggaaggataatattttctttgaggcagaggtaggtgggaagagataatcttgagtttggatatgccgaactaaaggtgcctatgggttggtaagatacaaatatttattaagaattggagaaatatgggtccctataaagatcagggaatactcagggaatatttaggactgatttgggagtcttagttatatagataattgaaattttttgtattttattttttctatgagctttgtttatctttaaatgaaaatagtaattggaatattttatgtttatgcttttcgtatttagacatatgtcgccaacattctgattgcagtgaatccatactttgacatacctaaaatatattcttcagaagcaataaagtcatatcaaggaaaatctcttgggacaagaccacctcatgtctttgcaattggtaagtgattttaaatgtattttaattcttgtctttctttatattgtacaaatttactcaatttttcttttggattaataaaagataccataaattgaatatatattttggagaaactgtatacctcttggatatatcaacattgttaggagcaagtattttacacagggtgaggaagaatacttttgtagtcaactaatggggcaggcttaccatacatcattatctgtgttaaatgcctgtgtcctctaagagatgtctgcccaggtgaaagcaggatataataaaagctgacctaatggtacttttagactttttaataccatcagctccatcttaaaattgtcctccttcacaattttgaggttctggccttcatctcttacccagctcatcccttatgagtgtgttacttgggctagatttcagctgtaagagcagacttctgggcatcatcttgcatcaggggtttataaaattaaaggattaaaagtagtatatgcttcataccactggagaatctatgtgggaagacagtagtgtctctttgcctttctcagcctcttttattttgaagtcctccagctctgagtcatagaggttggaggttttagatcagaatgagcaattacccctcttcccaccaaatgcggaggtgttagctaaccctttgcattcagacataaagcagctaaatgacatgtattggaactagttcgtagtgcatcctgtttctctttgggctttcccttcatgcttgtgttttggcctaaccagagttcacttccagatttggttgacctgtatgttgtctgctactaggtagagtgaatatggctgacataattactctaccagggcagcagcagatttacttttggcttgaagaagctatgacaggcatcgttgtgttgcagcctgcaaaacggtgccccatcccttagaacctgaatacgagcaaacatcactggagaaaagttacatgtttaaaatgtaaataaactagcttttatttttagctttttactgcgaaaaaacaagtgtttggaatgattctttaaaaatgtgtggaggatgggtgtggtggcttatgcctgtaatccaagcacttcggggagggcggatcgcttgagcctgggaagtcaagaccagcctgggcaaacatgcaaaatcttgtctctataaaaaaaatgaaaaaattagccgggcatgtgcttgcctatagtcccagctactctggaggcagtggtgggaagatcgcttgagctcaggagatcgaggctgcagtgaggtgaagtcatgccactatacttcaacctgggtgacagagagataccctgtctcaaaaaaaaaaaaaaagaaaaaagcgctgctgataaattggacaaagggatgtgtgcgctcttgtatatggtttgcattctccccttagagtaaaagccgtttctgaagtcttcttggcacatgtctgaggtgagaaatagttgtcttatagagccaaattgtgatgacctagttttgaattaaagttgtcttaatttgagactgctttaacagcattaaattgctttcaacttgtctgtgtagtcttaacatttaatacagtttatagcctaaattgttggagtctaatgaagatagttaaaaaatatatatgtaaacagaggcaaatctaggaaatttaaagctgttaattttgcctagttgtaaaatgttgacaaattgtaaatttaatagttgtattagaggaaaaaaccccacagatataatctaggaaatttaaagctgttaattttgcctaattgtaaaatgttgacaaattctaaatttaatagttgtattagagaaaaaaacccaagttgccattatgtatttttttttccagctgaatttttggttgctagatttcttaattggaagctcattaattcttgcttttcactggggacttcattagttatgcatagtgaccatttttttaatccctctgcagatcagctctggaattaggaagagatgagccacagcccataatatcaagacattctgtcagaaacttaagagttgtttatttggatttcatattacttaacttttaggataataagatagaacatttaaagtaaatacttttaaaatgatttgaacacttttgaatgactttattttaaaatttcattaacattgaatagacatttatgatttctttaagagtaagtggtcctaaagtgaactttctattattaactttatatttaatatattgctcatcattaatgtcttattttgaccctagctgataaagcttttcgagacatgaaggtgctcaagatgagtcagtctatcattgtatctggagaatcaggagccggcaaaacagaaaatacaaaatttgttctaaggtgagtattcagctaacttgaagtatttgagtaggttgatcttttttttccccccttgagatagggtcttactgtgtcacccagggtggaatgcagtgtcaccaccacagctcactgtagccttgacctcctgggctcaagccactgttccacctcattctcccgaatggctgggactataggcacatgccaccatgccctgctaatcttttactttttttgtagagatgaagtcttactgtgttgcctaggctggtttcgaatttctgggctgggcttgagcaaccctcctgccttggcctcccaaaatgctgggattataggcatgaaccaccatgcttggcaaccaggttgacttttttctggtaaaaaaatacttaagtaaaagttgtcaaccatttctaagtgtatagcatagtagcattaagtatattcacgttgttgtgcagccaatctgtaccatctccagaactttcatcttggaaaactaaaacttgacccatgcaacaacaactccatttatccactcacctagcaaccaccattctactttccagtttttctgtgaatttaactactttagctatttctcatgtaagtgaaattacacagtatttgtctttctgtgactggcctattttatttaactcaacttaagattcatccatgttgtagtatgtgtcagaatttccttccttttatttttattttttagtattttggatcccatccttcctttttaaggctgaatactattttattgtagatctgtggtacattttgtttatccatgcatttgtcaatggacatttaggttacttccacctcttggctattgtcaatagtgctgttatgaacatgggtgtgcaaatatttctttgagaatttgaaaaggttgacttttaatacctttgcatacttcatgacatagtttggaatggtgggctctatcctttttaagatacagacatcttatatggaagctagtctatagattactgaaagccagctctgacatgttattcacacgaggatcttggaggatactggtactggttagacaaagggtgatctagaaatattccttaagaatctcacatttacgttctgtctatatttctgttgttagcatggttaaaaccattttttaccttaagcttacgataatttgcctccttatttctatttccctatagtctgcctcctaatgtgttctctttgctgccattaaattaaactctctgcattgtgtttttttgtttgtttgtttgtttggtttggtttgtttttttttgaaaacagggtcttgctctgttgcccagtcacccaggctgtagggcagtggtgcaatcatagctcactgcatcctcgacctcctggggccaagtgatcctcctacctcagcctcccaagtaactgggacccacaggcatgtgccaccatcctggctaattttttatttttttgtagagacagggttatgctatgttgtccaggctggtgtccagctcctggactcaagtgatgctcccactttgacctcctaaagtgctgggattacaggcatgagccaccatgcctggccttacactttgtttagaattatagcattttaaaaatggaaggaatcataacactcattgtagtatagttcttttaatttacatacccatgaggttagatctagtggttgaactactgctaggagcagcatactcaccagtgttactcccacagaattatagttcttagttgattgctgcatagtggtactatgaaagtttgctattcattatgtaaatatgtatgctgttcagagttatttatgtaaaatcaattgaagagtttgttaacagctgttatatatatgtgtatatatacatacacacaattctggttaagtgaatgcttcccagtattcttggattctaagtgtttcaatttctttttctttctttcctgtatgtaatagtctatatgagtctatggttaatgtatgaaaatgaacaaaaagttaaggagttataaacttataatatgaacttacattttaaattaaggattgctctttattttgaaatgtgccaggcaaatagttatttctctgtgtttcatatttcagtgaaacaacatgaatagtgataacttcccagttgttcggaggcagattgcctcattttctgtagccaaagattgaattaataggctctcacaaaaggctttgacatctcctatagtttatgaatatgatatatttaaaatcaaatagttggataaaatcagaacattcccaaaacaatttaaaaaacaatgtcaattagatgttaaatgcaatacaaatagaatttatttttcatttttataatttcaacatttagattcaggccacacatgtgcaggtttgttatgagtatattttgtgacacagaggtttggggtgtgaatgatctcatcattgaggtaatgagcatagtaccaccaaatatatatatatatttttttgaaacggagtctcactctgtcgcccaggctggagtgcagtggtgcagttttggttcactgcaaccttggcctcccaggttcaagcgattctcctgccccagcctcctgagtagctgggatgacaggcgcatgccagcatgcctggctaattttttgtattttagtagagaaggggtttcaccatgttggccaggctggtctcgaactcctgacctcaggtaatccaccctccttggcctcccaaaatgctgggattacaggcatgagccaccacacctgaccccaaatagaattttaaataaatttaaaaagctatgacagaatagttgcatttaattacacatttgttataatgatgatctaggtttcagttttatatgtactagataattataaattattgtacaccatattattgtcatcaacattttttatcctatattttaaacagatacctgactgaatcctatggaacaggtcaagatattgatgacagaattgttgaaggtattgctaatttttcagttgttacgcgtgtactgaaattaatttacaagacttcttttagtggtctggaatgttcttctctcagagatgcaaaagactctcttatctcctactaatcattgctcatatatcatcttgttatttacctaatatcaattgtttctgcccccacccgcacctcatgaaaacactaagaaggcagggatttttgtttcatattccaaacccttagaatggtaactgatacagagcataaatatctgttgaatgaatgaaagaatacaggaatgtctttagcttccagtttgttttatggagcttgttttgtgtaaaggaaagaggaagaagggttatttggcattaggtgcttttttagagaagtcattttttaacgaaggccgtagtgtgtaaattgatttccttaagctatccatgcttgtataccttcttagaaagtcttcttgtacctcagtttggagactgctggcctagactaccattatgttgaatctcctgcatgatgccctcctgcatcatagactcctgttttgtctcttcacttagattcttacttctccttaatccagtctctgtatagaatttggaataatttctttttctttttcttttctttttttttttttgaggtggaatctcactctgtcacccaggctggagtgcagtggcttgatcttggctcactacaacctctgcctcctgggttcaggtgattctcctgcctcagcctcccgagtagctgggattacaggcgcccaccaccacatctggctaatttttgtatttttagtagagatggggtttcaccatgttggccaggctggtcttgaactcttgacctcaagtgatccacccgccttggcctcccagaatgttgggattataggggtgagccaccgcgcccagctggaataatttcttttgctttaaataatctgatggcttcatattgctctcaacatcatgccctagattcataacatcacccacagtgctctgtgtggtctggctcctgcctcttctgagctcacctggagtcatgtttcttctgactccttatgctttaatcacattgggctccttgtagttctttgagctgtcttaaacaggcttctctgaacactttttctccttctccctgtcttactttcccccactatgtactcagtaagcattttttaataataatggtggtaataacatatatgggatgtattaggcattatctcatttgtttaaaaatctgttatgtaatttaaatcttcacagaatgaattagaaactattttatccctactttaaagatgataatatttaaatatgctgaagctcatatagttcatcagttgtgaaattcggatataaagctaagcattttaactacatgccgtagtaaatgcatattttaacactctcttggcattttttgtttttaaattagagacagcatctcactatgttgcccaggctggtctcaacctcctgggctcaagcaatcctcctgcctcagccttgtaagtagctgggactctaggagtgcaatacacatgctcttgacatcttaaagaaaaatgttggttgaacaaaaacttattaggggccttgtatgttcatgcattttgctagatcatagcaaatgatatgtgcatttttcacaatgatgtaaaatctgcatgtagatcaatctaaatacaactctaataaacatttttaaagttgagcaccagtaaagtttttttttaatataaagaatttcctagtttcatttacagtttttatgtggtgttgtaacatacccagatatgtacttatcttgtaagtaatgctttattcacagtaaagtgccttactttagcgagggagtcgttcttaaaaactgaataaattaataaaaaagaacaaattatgggctacctcagtaaaagactaattagtattctgatttgctcacttgaggtgcacactcacttaataattggatatacacccagtttcttccccagtaatgtgctgtacagtatgtagtgtgttatagtggagacaagttggaaagtgttattccaagtgcttctatagcttcttttttttttttttttgagactgagtctcactctgtcgccgagtctggagtgcagtggtgtgatcttggctcactgtaacctctgtctcccgagttcaagtgatagcgctgcttcatcctaccgagtagctgggattataggggtgtgtgccaccacgcctggctgatttttgtatttttttagtagagtcggggtttcaccatgttgggcaggctggtcttgaactcctgacctcaggtgatctgcctgcctcagcctcccaaagtgttggtattacaggtgtgaaccactgcacccagctcaatagcctcttaatggagaatagtaaatgtaactagaagggtatagcgtcttttgatcccatccttaatagaagtttagttgctggttttggaatgagtatattattagtagcattaatatgattttctgttggagaggttcttatcctattttgggatattttacttgtattaaattcttcagcaaaaactagtagattatcagtaagggagttggggagacctgtaattgagtcctctttttgttaacacagccagttatgtggactttgaagagtgagttgaccatggtttttttttttttttcttcttgtttttttttgagttggagtctcactctttcacccatgctggcgtgcagtggcaagatctcggctcacctcaacctccatctcccgggttcaagtgattctcctgcctcaggctcctgagtagctgggattacaggtgcccaccaccatgcctggctaatttttgtatttttagtagagacggggtttcaccatgttggtcaggctgatctcaaactcctgaccccatgatccgcccacctcggcctcccaaagtgctgggattacaggtgtgagccaccgcgcctggctgaccatgttggcttcagtttttttatcccatctgaaacatgagggatatatgttaatatttcttttagttttaatgttttcttattttggcatgtgaaatggctggggaatgatctttaaaagagtttagagactagttaagcattctactctagatagaataggagaaatctgcttgaaaaggcttcataagaaatatgacttcatgtttatttttttatttattttattttatttatttatttttttgagatggagtatcgctgtctcccaggctggagtgcagtggcgcgatctcggctcgctgcaagctctgcctccggggttcacgccattctcctgcctcagcctcccatgtagctgggactacaggcgcctgccaccacgcctggctaattttttatatttttagtagagacggggtttcaacgtgttagccagaatggtctcgatcttcagccctcgagatccgcctgcctcggcctcccagagtgctgggattacaggcatgagccaccaagcctggccagcttcatgtttattataggaagaacatgcttcataaaaaaaattttaacactgaacatcatgaagcactttaagtttgttgatggagaatatgtgtgtaagattaacactaatttggtatgtttgtaattgagatttagatgagtataagagtagaatctagtaactcttatccagtcatgatatgtgtataggtgattataaaataacagtgaaaatattatatttgttcactaggattttaaaacccattattctgagagccttaggtaattctgtaaactcttaatttgttaaatttcactggatatacatgtaaaaatgttaaatatggagactattaatatgtgaaatgttttagaaaagtaagtcaaataatacatctcttgcctatattttctcacaagaggtttgctgttttatctaagtactgttgtgggcctgatatactagataaaacagtaaaatttttagggaaaaaattttaaagtctagttataaattttgtaacatagtggcttaaaaatttagtctttcctataacatttatattttcttgttatatatttgagaaattttcctatctcatggacttgaatagtgcctgagcatagtgggtagtcaataaatatttgtggaatttggcattacatgtgaattccttcatgttaattttttttttttttttttttgagacagagccttgttcttgtcgcccaggctggagtgtaatggtgcgacctcggctcatcgcaacctccgcctcccgggttcaagtaattctcctgcctcagtctcccaaataactgggattacaggcatgcacctccacgcctggctaatttttgtattttttagtagagacggggtttcatcatcttggccaggttggtctcgaactcctgacctcgtgatccacctgcctcggcctcccaaagtgctgggattacaggcatgagccactgtgtcccgcccatgttaatattttttagaacatttttttctagacatatatattaacaaatggagatatgccatgcatattttgtaatgttccgtcatgctaattttttgatggatttttttgtttctcaatagctaacccactcctagaagcctttggaaatgcgaagactgttcgcaacaataatagcagtcgatttgggaaatttgtagaaatacattttaatgaaaaggtaagtgagagtaagctttggaatgatatttttggggagtgtttgtgaaaatgcaagggtcagttggtgctgtatttgcacttaatggtaaatacctttaagtttcattgttactttagatggttgcaggaatatatgtgtccactatgaccatctaaaagctcctttcacaatctaaaacccagatgctgaatttgacttcagcattgagtattactgtatagctagtcatgtaagatattctagcacctgtgttgaggtacggtgcaaggtcaattgtgattcttaggaggctcaaaacttaacaggatttgggtagagacttaaatggggatgtttaaaatgaaggatgaccattataaatactctgtgcttacgtttagttatttgttttttcccctttatttggtgaatattataacctctttgatagacaaatgtgtattagaaaaggtaaataatttaacattggttaattatattttaagactttaaatgcaaaaatatattttctctgtgttttgttttttagagctcagttgttggaggatttgtttcacattatctcctagagaaatctaggatctgtgttcaaggcaaagaggaaagaaattatcatatcttttataggttgtgtgctggtgcttctgaagatattagagaaaaacttcatttgagttcaccagataattttcgggtaggtcagaagaaaagaaatttcatatagccaggtgcagtggctcatgcctgtaatcccaacactttgggaggctgaggcggatggattgcttgagcctgggagttcgagagcagcctgggcaatgtagcgagaccctgtctctaaaaaaaaaaaatacaaaaaattagctgagcatggtggcactcacctgtagttccagctactcgggaggctgaggtgggaggatcacctgagcccaggaggttgaggctgcagtgagccatgattgtgccactgcactccagcctgggtaacagagcgagaccctatctcaaagaaaaaaaaattttgtataatttttgaaaatataattgccatcaagcctaatacttattttagtgaattttgaaatctacttgttgtgtgtatgtaacttacattggatcaagtataacatgttagaatgaccactgtactgagaagatctctattaaggtgtactgctgagtttatagtataacactgtatgaggaggcacataatggaatagataaaaggatagatgttaaaccctacgtcaatttaaactcaattagaaattgataatagctctgtaatactagctttaaagttacctttgacttatctgtaaaaatgtttgaacactaaattaatattaataaaggacacatgattgaatttcttaatttacttcaacaacaaatatttattgcttgcccattgggtgccaggcattgggccaggattaaaaagataaataatacacagtccctgctcttgatcaacttagatgtggtgggaaacgcacacacacacacatgcacacacacacacacacacacctgagcattacaagcgagtagagtttctaggagcggtgactggggatggtttggttaacacaattttcagattctcaggttagaaaacagtgtacttgtatggagtatgggaatgtagtttatacaaaggaatgcaatgtgagtaaggaatgtcgtctgtatagagttccccagctgattctgatagtcttttttggtcagaaagcctccatttgagaatcataacacacataattactgctctgtggttgtgtgtgtgcgtgtgtgtttgcagacagcttttcttttacttcaatttcttttaatgtgtgtttgcaaattttaaaagtctgttgtcttaaaacactttataaatgtatctctttatatacttctaaaatgtccagtcttttctagagctctccaaattaattggaatttgaagctagttgcccacatttccatgaaagtaaaggaagcatttcttttttactatggtttttaaaaaaggaataaattactaggaattacatgaaatataataatgatgatacggttttgtcaatacttagctgacaataaagtgatgtgactgttctggccttaatctagcatttcttcctgcttggaggcttgggagtatagtatttttgggtttcagaatgtacagcctttcctggtacaatggcaggcatcctgaaagggcagctattgaaatatatctggtcagaggatttcctgtttctgcagtgtgaaccaggaggcctgatttcctttcttacaggagagtccttgtgatggtaagaggaagagtaggggaacagcgttgcatacatctgccatcttgaatattcctctcatatgcaggcacaacacacccactactatatccacttcccccaaataattctgccttaaagtcacttgaaagtgtgttagtgatttcatcaggtttttctgtagtttagccctctggttataattgagagatcaggttttaaaaacaaaggggaaacctgcagtaggttgaacacttgtaaaattgttgaatttttttggtcactactctatcaaaattagtatgtaaagaattgtggatgtatacctgtctgtaaacatttttattaaccacacatatactttaaaaagtaaaaggtttaaaaatgtttgcatttagacatttcaaatatttctgcacatgtttctggagccaattgctgtaatcatggatagatccttgaatgtaaagaaggcttggatagaaaaagaatagatggccgggatagtgttctagttacagaaaaactaaaaggacacgtttctatccaaggttgtaatattaggccccactgtccagaagcaaagtatttgacaaaacaattggagtgaggagacaaagtgcttggtagcaaagaacatatttattttggctctacatgtttaaactattattctgctaagtaaaagagctcttatttgaaacagtccattgaaaatgcttaccaacattgtccctgctcccttctcttttatttttttcccaaagattctagggtggaagaaaaaaaaaaaccatgtatatagttgtcttgtttttactgtattttagcatttaattataatggagaaggaaagatagaggcattgattgtctaaaatattaatttatccccaaatcattcaaatttttataaaattttttttggtatgtgtatgatgaggtgtatttaatttgggaattcatgccatggtacaataaaatcatagcaacctgatttaagagaagctgagatgtttaaaaaaacttgtccatcctgttctctgtgtacatcctttctgatcagatttgcccaattccatctaaatgtctttaggctgtgtgtaattttcagaaaaatgcagtacttttagtctactgtatagcaaatatgttcattcactttttattagaaacagtttttaaatgaagcaagccttcaattgtgagactaataaatgggagcagtagattcttgttgataccagtagattttctttttttgaactactcctcttgttctatattttggaagcatttagcttttgaaagcctttggtaagtgaagtaaatcactgaaataagaaaactttaaattatttgatccataaagcataaagcaagtagtgtaatttatgtacagtcattgttagctttcaataaatgtgaaaagcatgttttaaaaaactgactctaaaaatcaaaaattaagaaaatcaaggatagaatttcttaacttctcagaatttaaaatattacttgaaaaattaaaccatactatcggttcttacttgagattctacatatttagtaggaaggtgattttcatgattttatacactatgtttagatttttgatactgaaaagatataaaattgttgccctttaaaagtagaaaacttttatgtcattgatttttaatcattttatttaatctatgctcagagattaggatttttaatattcctggttttattagtaggaagaaaatgcttataaaatatagaagtattgatttgaatggtgagattatacagtactcaagttgtgtttagaaattcttcatggttggcactatttggtaagttgtgttttctcctgtattatttccctgtggatcatatatgttaattatatttaatttgttttgtcatagtatttaaaccgaggctgcactagatactttgctaacaaagaaactgacaaacagattttacagaaccgcaaaagtcctgaggtatagtagaccattgttcataaaatctttaacttaaaaaaaaactcatgctgaaagatgtgttataatttttattttagagcccaagtaagagttctaacttttaggcttatactttaaaaaattaaatattcatctaagtctctgtcacagtgtaatactttatacctcttgttgttatctagtgaagtgacaggttctggttcttctggttgggcatcactgcattgctctcctctcattctgttttcaagcatgaaggtattaaattgcctaagaatcattctcttctagcatttttgaaacttgctcttatattacccacttgagcttaagtatatgtcttttacaatttattgtctatttcaaggctgacgtgaggtttgatgtagacagtaaatagattaagcgttcttgggaagaaatgcttataggctaggcgtggtggctcacacctgtaatcccagcactttgggaggccaaggcgggaggatcgtttgaagccaggagtttgagaccagcctgggcaacatagtgaaaccccatctttacaaaaaataaaaaaaattcactgggtgaggtcgtgtatgcctatagttctagctacttgggaggctaaagtgggaggattgcttgaaccctggaggtggaggctgcagtgagccacgatcatgccattgtactccagcttgggcaacagaattaaaaacaaacaaaaaaaagctggtcaggtggagtgggtcacgcttgtaatcccagcactttgggaggctgaggcaggtggatcatttgagttcaggagtttgagaccagctcggccaacatgatgagaccctgtctctaccaaaaaattacaaaaattagccaggtgtcgtggtgtgtgcctgtaatcccagctacttgggaggctgaggcaggagaatcgcttgaacccaggagatagaggctgttgtaagtggagatcgcaccactgtactccagcctgggcgacagaacgagactctgtctcaaaaaaaaaaaaagcttatatattattgtagttctgtttaaaacatcatatttatgtaatatattatgaaaaatttatatattggtttcagtaaattatatttctaagaataattagatataattataccattaagtattatttttaacacattaagttcttaatgtaaaaatttacaacccttataaattttaatatgcagtgtttaataagtgatattaagttacacgtactcaaggggcttaagttatgaaatactaaagtaaggattaatgatagatactggttaatgttacttttattaattttattaaatatttaaattgagtaatcgaacaagtttttataatagtcagtttttaatgcttctacatttgtaagcccgatattttttactcttcttaaaatgaatgagatgatttatatttttagcatatttatataaaaggatagaaagcaaataaaatattccattatttaaaattctaagcagacaaccctacagttaatttttgtttaatttggcattttatatatcattatagatacagaatctgaattacaaactataaactttgctatagccatggttggtacttttaagaagcaacattaatatttattattgtatctttctttgtcttgataagactatgtttttctgagatatcaaaatatagtagctatattcctttcactaagataatggagacctttcctagtgggacatttcagcagttctgaaggggggaaaaagatataaatttgatcatttgccatggaaaaaaatggagtagagaggaaagaaaacgagtttactctccaaagagtagcatgtactctccaaagaagaaaattgccctcttattctagagtcagtatactctttcagaaatcttattcacattgagtgtgcgtttatatgtacagttaaataatggattaatatgtttaaattactttttatgtcttctttatcaggaggatgaggtgatcattttgactaattaaaccctttgcccaattccatctgaatgtctttaggttgtgtgtaatttttagaaaaatgcagtatttttagtctgccatacagcaaatatgttcattaacttttgattagaaacagtttttaaatgaagcaattctttgactgcaagactaaaaattctgcatgatgtgtgttttctgctgaacagttttggctgcatgtgattgtttcctttgcttcttttaagaataaaattgaattttattgtcttagatattttccagaaatgttacacattcataattgaacattttaaataattttgtggaaagacaattatagcttgagctgggaatcatttgtttactgggaggaaaaaatatccatctccaggaggcatctttaatgatcagttaatcatgatcctgttatttaatgtttaacttgtatattctcaagttctggaaaatttctagtacaatcttttcgtgtccagtaacttttatgtttctccttctagtttctgcagtcctgactttcttctttttttcttctgagttggtatagagtctaacaaatgagcacattagatgcaagttcttttaggagagaaaacaaattttcttctcattttttctgaaatgttttaagtcattgtgtaaattattagagtaagtataatgcttactaatatactttaccatatatatatatgcatataaaaaggtttaaaaaagaattctaaggcatgaaaattgtatcagcctgacccctatttactacaacttaatattggtgcagttggtggcagttaacctaaaggagtcatactgattgtcacatttaaattttttattgcaccttttaacttactttttctttttttaattaacaagaataatgtatatttatacagtacattggaatacaatgtaatgtttgatacatgtatacattgtggaataattcaatgaatatatttatcattacctcatttaaaaaaactgtaatgttgattcaagtattgatattccctcctttttcactcaatttttgtctttttctaatatgctaggattataagactttagagcgaaaattgtaatttaattgaaaaacatctaatttcattattttaattgaaatttttacggataagtgtagattcacatgtagtaaatagtgaaatagaacagagagatcctgtgtatacttttcatggtcatttagtttttgaatgttagaatagtaaagattttcccattgacagattttatttttgcatgttatatagtgcattaattgacctggtgtagtagttttagtgtacttaaataatgtaacgatcagttaattggtgtcttcttgttttgtagtaccttaaggcaggttctatgaaagatcctctgctagatgaccatggtgattttattagaatgtgcacggctatgaaaaaaattggtttggatgatgaagaaaagcttgatctcttccgggtagtagctggcgtcctgcaccttggaaatattgattttgaggaagctggcagcacttcaggtttgctttttatttttttaagaggaaaaaaattaaatagaatttctgttatttatttgtcatatgaaaattgtctctttatatgcagtttgcttaaaaactttaagaagtatctaaaatatactgagttacatgttgaatctcccaaatgaagaatgtttcattatcagtcattctgagctctgttttgaacaaatcagtgatattgcttaggaataaacctctcatttttgaaggataaataactgactattttatcctgataaatttagggtaatttttagttaaattttccagttatattacacttttccaataggtgagaagattaattctctatcatctattaaggcatttttgaaaattttcaggatcattgggtgaattaattagggcaatttaatatataaaagcccatgtactttattaatgagaaatgaaaataaatgaaaattttaatcttatgcagattgaaaagagtatttaaatacatggcaaaagcaacttttcaactccagtgtttcagtctgtacatgaacagtaggactttgcataattctaaatttgatctacgaatacagggaatggcaaactatgaaccacagcccaaatttgacccactgcctgtttttgtaagtaaaattttattggaacaatgccacacccactcatttatgtgtggtctataccagcttttgtgctagtgtcagagttgagtagttgcaacagaggctatatgtcctgcaaagcctaaaatatttactatctggccctttagagaaaaagattgtcaacccctatattaagacattattgtacgatcttataccaaggatgagttaaggaaaacctacagcaccatttaatgtagtagtcaataatgggctttggtgttagatcccagaggctctctgagctttggtttcctcacttgcaagattaaataaaccatgagaaggacttttaaagtacagccagtacctagtgtaatgctaaaggttcttgccttagccatgccaaagaattggtgtggtggctgcctgcagtgagtgatggagacagggaccaagagaaaaaaaagccatagactttattgagcagagtgacagtacaaagctttcacagtgtggaaggggtcccgagtgggtagccagagttagattatgcagtttccttttaaactcttcaaggcgggaaatacgtgcagggggaagatgttaccagagcgagaaacaaaggcagtaaattattttgtgatgtgttttagattttgaggaaaaccggaattgcaacttaggttttatttactttatgaccttgcagcggcttggcaaaggagacgggaatttacgggactttacaaagtatgtttacaaggagttggaattaggagcatagataaggcccactggtcacagaaaaatgggcatttaacatttcttttagtttcaggggagggggaagggagagagggagagaggacatagggaagcttatggcaaaatttttgctgttatagctttcttggggaagaaaacacatgcacaaatcctggtgttaggaatattttaagcacatatctttaatattattcatccaggaccaaagtaagtcctgatacaggaaatgagtgagtttcacagcttcctgagcccctactcgacccaggaaggccagcgggcacctcctctcactagcaatagtgtgcatatagggaaagagcacaagaagacaggaaaaaaaagaagattaaaaaaagtgttatatgcaagactcttcttattctgcatttcatcataaacatcgtaattgtaatctgtatatcataaatataatgaggtaggggatattatctccattttacagaagtggaacctgtgttgaaatgatgcatgtggttattgatgaagttgtagatgtgagagctggttctgctcatgtctgactaacacagaggcttgtgataattgtcccttctttctcccaggccactgaaatttgtcatctatgaatgaacagactaaaacagatgtcttaatgattttcagatctaatgttctgtaatgctgtgaaatcaataatgtgagatgcaacataacatagtggatgggagcacgtgctcctgatccagatgctttaccacatactgtctgtatgaccttaggcagggaacttagccttttcgtgtcttagtttcctcactgtaaactgaagataatagtacctacctcatgttgtaaagaggaatacgcgagttaaatatttgtaaatgatttgagtacttgtgtctggcacatagtaatcattataagtgctttaaatgagtaagtacaattaaaatacagattgctcccaatttaaaatgaaaaaaaaaaattcaagcaaaattagatatgttcttaatgtgcattaaaattttttgtttttttttgaaggattggaaaatttgttttgaaaacgtaatgaatgttagcatacatttcatttgctctctagcattgttataccaaaggagcatatgtgggagattctaacacaaaaaaaagtctttacaataattaatacacactttagaaatgttgttagaagtgataaatggcatcttcacacctcttattattaccctgtggtagaagatgcagttgtatagagtattataagtgttgcatgatcaagttatttgaagagtatgaaatgcccaaaaggtaatgctatttgcattatctcttatttttcttctctaacttccttctattgagggtaaagtgaacagaaatcagggaagattggaaagagacagggaatcaataagattaatatgtgattcaattaattattttaaaagctaagattttattatatttgtcttcatccttcctatgactcttcctatagatccaaatggtttctttctaattagaagtgatttcttttttccctagggagcttaatttggcatgtcttagcaatttgaaaaaatgttggttttggcaggatatggtggttcttgcgtgttatcccagcattttgggaggctgaggcgggagggttacttgagctcaggaattcaagaccagcctgggcgacatagtgagaccccataaaaaaaaaacaaaaaaacccccaaaacacacacacaaacgcacacacacacacaaaataaattagctgggcatggtggtgcatgcctgtagtcccagctacttggaaggctgaggtggaatgattgagccctggcggtcgaggctgcagtgagccatgatcgcaccactgcactccagcttgggagagtgagaccctgtctccaaaaaaatttggtatttttataattattctactggaaagattattctccaataagcacttataggactcttaactgtcataaagaagtttttgcatgatgaaaatgcagaaaactgcattgggactgcctatgtttttaaaattccacataacagataaaatgttattataagaaactttaaaaatgtttgaagaagttcttttttggaaagaagtgatatgaaaactttacatgatagtattttgccttttaagacttattaaaaatcctgttttttttttttatcttagccttacataatttttggaggtgtgtaagaaactttgcgatatagtaaaaaagaagaaatatttaaatgaattatttgatggtcaattttttgagagctatataattttaggcaatatgtatatgtatagaacctacacgagtaataagcacattttcatagaatgaaacattcaaaatattctcaaagtatctctcttttttctttttttttggtaggagctttattgagatctagttaatataccatacagttcactcaattgaagtgtatatttcagtggttttcagtattttcagagttgtgcaaccatcaccatagatttagaacattttcatcaccccacaaagaaaccctgtacccattagcagtcactcctcattgcccacttctctcaaccctaggtgaccactaatctacttcctgtctataaatttattctggacatttcatataaatggaatcatacaatatgtggtcttttgtgattggcttctttcacttagcataatgttttcaaggttaatccatgttatagcatttagcagtacttcattttatttttattgccgaataatatttcattgtatggatatactacattgtttatccatttgtcagtttctagacatttgggttgtttccatttttggctattatgaataatgctgctgagaacgtttgtgtacaaatttgtgtttggatgtgttttcatttcccttgagtaaataccttggagtggaactgctgaatcacatcatggtaaactctgaccttttgaggaactgtcagactttttcaaagcagcttttccactttacaaagctattcccatcagaagcgtatgagggtttcagtttctccatatcctcaccagtactatgtgtatgcttatagcaatcgtacagggtgtgacgtgttatctttttgtggtttttatttgcattttcctgatggctcaagatgctgagcatctttctgtgtgcttactgaccatttgtatatcttttttggagaagtgcctgttgagattctttgcccatttattaattgggttgtctttttattaccaagttgtaagagttttgaaaatatattctaagtacaagtcctttatcagatatataatttgcaaatcttttctcccattctgtatgttatctttttactcatttgatagtgttctttgaaactcaaatttttatttcagtgaagcctaatttatctgttttttcttttattgcttgtgattttggtattatatcaaagacatgaagatttactttgtgatcatgaaggtttatacctagtttttttctaacagtttaatagctttagctcttacatttaagtctttgattccattttgagttaatttttgtttatggttgaggaaggggtccagcttcattcttttgcatgtggacatccagttgttccagtacctttattgaagaagctgttctttcctcagtgaattgtcccaacatcttattattgtaaggtctcatttttcacatttttttctcatatatattctaagattggtatgttaagtagtttatgaatttgtcataaaattgtcatgattttcacacattctttgtagtttttaattaggtagtcttagaatatatcgtttattaatattaatctgaaaatatttgtaaaatgctattttttattataatgcaaataaatataaagaatagttaatcgttagtactttctctgtaccagacactattccaagcatttcacatacataacctcattaatctaaatagcaaccatgtaaggtaggtaaagtaattatcccagttttatggacgaagaaactgtgcacaaagagaataagtaacttattcaaggtcacatagctagtagttgtagagcctgatcagccctgagactaaagcactttctttctttatagtactttttaaagcagcccttataaatagaaatctgtagatatgatgtactaaggcaaaaatgacctgcctggccaccttctgctgcaatatatcttttcctcacatacccctgtgcaagcacacaaaaaataaaatggcacacgtgcaggctggatgtgccaatggcagatttctcaaaatgcccacatgggtcaagacctaactgcattgcttttttttttttttttttttttttttttgctattctctgctctgcagtgtaaagatattgaaaatgtcaaaaaggcttgcagatacccctaagggtaacagtaaataaggaaaagaggaagcatttgtactgatctctagcacagaaagtcaagctgttggaggaactggacaggggtatacatgtatattagtgtgtatatgaaacataaatgaattttgtgtttcgaattcagctcatcatgtatatgcagttattccaaaactggaaaaaatctaaaatctgaaacacttttggtcccaagcatttcagttaagggatactcagcctgtacaggtaatagtaaatgtctcttcactcccttcgaccccaagcaatatgagtacatgcttattacgtatatgcataaacacatccatagacagatatgtacatccaaattgatctatttaggtgccttacagcgtttgcactaaaattactccttgaaatttcttgaagtcatatgaattttaatgatgagatactctatttctctaaagagttaatatattgaaaaggattataatctatcagtgtagtttgcttatagggtcaaaaaaaatgaaacagtgacagtttaatattgatgtgcttaaaggattataccatggacttccccaagggaggatcttctgttgatcttagcagtacgggtgtttgacaaggatagtgaaaaagtgaggtagatttaaaagttacaaataagccttgcctattatatggttttttgtaagtgaagtataattctaagaaatgggtcttgaaaatctggtttatataatacttattaatttcaatgaaaatatatttctattaggtggttgtaatctgaagaataaatctgctcagtctttggaatattgtgctgaattactgggtttggaccaagatgatcttcgagtaagtttgaccacaagagtcatgctaacaacagcagggggcaccaaaggaacagttataaagtaagttccttaagtaattgcactgcaaaaattttgccttgcagtttgtcaaggaaaaacataagttacattctgtttaaaacctgagcttggtagatcaaaattctctacatctcagtgtagtaatccaccatataaataaatggagtttaacatagctcttaaagttgttccttgctgatatttggaattcataaggtaagagagaggtttacttttctacaactatgaaaatatgagctgatggtataaatcaatatatgacagttttaggcaacagatcattttactttaaaagtaatttttttatgccaataatgtgtactaaaacacatctattaagcagatctcacttcagcaaaatacttagcaaatgacactttccttatgtttaggattctttatttgggagaaattacaaatgacgagaaataagggcttaaccaagattttaaaaatcagtaaccaagaacttctagattgtacctggatgtttttatacttttgtctccatgtcctatattttatatatttttggttttggtactgtagaataaaattgacattcagccttgtcattctgaggcactgcaggatcttcatttgtggagggaagaagaccctttatctcttactaataagataggcagtgagctctagtgacatatttccgaaaaagttgcaacaaatttaaacaaagaattttttgaaaaagcttttagcctctcagaaaattggctatctcttattcttttgaaaattttagcaaggtatgcttagcctgattctttgctaagcaaattcaaaattgttcttgttataaagaaaaactctggaagaagtttgtagagtaccaccctacagtctacagttacttggttccttagagatatctctgcggcccaagggaaagcccataaatgtgcaggtgggtggttctcaggcattgcttcctccattttcccattttctccttgttccaaagcagttttttgttgttgtttccttttttcaatcaatgccattccagaatccaaagcagctcttttatgtactctatatatagcgtgtccacatgaaacttcaagaaagggttccattgcagaaaatataagtgagaaatcactgtttagagaggcttaagtatcaaatgtcaggctgatctgaatgacttataattctacttccaaatttgactttcttttttttttttttgtgctctcttggtaccccatgcttatctttatgatagtatttagcatggtgtttggaaattctcttctgtgccagtctctcttcatcagactatcattttcttgaggacaatggctctgtgtctgtacctgcaacatttaatactattataccatatagtcagttatattaaatagtagaatgggacagttcaaattttaagatgtaaacattttatcctaaacagtgtaaagaagttaccaaactttaaagttatcctgaattaaacactgtttcctttgcatttaaggaaaaccaaaagggaggttattcctttgaataattttgtatgtattcaggatgtaaattaaggtcaaaatgattttttaagcctaattttttttaccccaataatagacttttgatctaattttaggtaattccattagttttcttgtagcagttttctacttagccccatttatctgtgcctattctcacatgacctttggtaactctttattttgttcttctctgtgggtatgtttaggtgcactctgtggcattttcacagtgcactattataaagaatttttactagcatagttttcttttatagggtacctctgaaagtggagcaagcaaacaatgctcgtgatgccctggcaaagacagtgtatagccatctttttgatcatgtggtaaacagagtaaatcagtgttttccttttgaaacatcatcctattttattggagtcctagatattgctggttttggtaagtagagtttcttttgtgagtatatatttgtttcatattttttcacacattagaatttgttcttaaatcttttctcctttgtaactcattttacttgatgtatgtgtaattatatgtccacactcacatttcataatatgacctagatagggagctgatactttaaagagaagaggaaagactcgtggggattagttttgatgatactaatgctaaaattaaaacattgattgaaactgctagagttaaggatatctctatactctaaaaggaatacaactgaataaaggtaaatccttgtgtgctactaataaagataatacattcactgattaaataacaaaaaaagataaatagagtcactaaaaccatttactaatttgtagagctggggataggttgacctaacttacaggccaacctcattactatgtttagaaattcattgctgttgctgtcagcaagtagctatattttccatcaaattaataagatatcaaggtaagtagttaaacaactgtagagctgttcaaccagaaatgaaatgggtcaccagcatgtgaatgctgctttgctctgagtgacaaaaatataaaaatcttgaaatgtaaatctaatgggttttgtattgggctttatcaatgtgggcattctttctgactgtgaaggagtagtgtcttctttgtggtttttgccaaagaaatgtatgagtgtttacatttggggagggatggagttttgcttttgatgtaatacgtattttaaactttataattctctaccttttgttcaaaggtagagaattattattattattaattttttttccttttctacaacagttttagcataacacatacaaaggattataaaattgtaaagccgagtgtatcttagacatcatgcaatataatctcttgattttagaaatgaattggtatccacagcatttttgataagtaattttacagattatgcagaaaaaaatcttctaaagcacttgtattttaagtaatttttgtgcttaatttagattgctttaatacctgtgctttaaaaaattgttggccgggtgcggtggctcatgcctgtaatcccaacattttgggaggctgaggccagcagatcacttgaggccaggagttcgagaccagcctgggtaacatggtgaaaccctgtctctactaaaaatacaaaaattagctgggtgtggtggcacatgtttgtaattccagctacttgggaggctcaggcatgagaatcacttgaacccgggggcggaggttgcagtgagccaagattgtagcactgcactccagcctgtgtgacagggatcctatctcaaaaataaataaataaatagttaacatgtggcttacattttatatcttttagtatacaacatttatctcatttgagaaacaccttatttgtcaactgaagcagggtatttttaatacttttaatgcctataaagttttgtcttgaaatgagaacatttgggaagtatagaacaaatatatataatatacaaatttaacctaattttaaattaagccattattacaattacattttatcctatgataaatttatatgaagttgatctcataatgactcttggttctggttttatattttcagagtactttgagcataacagttttgaacaattttgcatcaactattgcaatgaaaaacttcaacaattttttaatgaaaggattctgaaggaggtaattgccattataagtttaatttaagatctgcataaagctattttaaattttaaggaagagatatgctgcagttaccctgattggtgtggatggatggtgtataacggaaggtggctcagggaatctgggaagcccagcagaggccccggggctcaggcacgtcagaagtgttaatggttcagctgaagtttagggacccgataaaaacccttaataggggcttcctcagaagtgaacatctgtttttagtagtgacttttaatggacttgaagctctgtttctttttatgattttgttgtctctacttcttttttttttttgagatagagtctcattctgttgctcaggctggagtgcagtggtgtgatctcggctcactgcagcctccgtttcccgggttcaagcgattctcctgcctcagcctccccagtagctgggacaacaggcgtgggctaccatgcccaacaaatttttgtatttttagtagagacagggtttcacaattttggctaggctagtctcgaactcttggcctcaagtaatctgcctgcctcatcttcccaaagttctgggcttacaggcgtgagccaccgcgcctggcctgttgtctctacttctaccacaccaaacaaccttctacccgcatccctgcctttggcatctcccactctttttttttttttttttttgagacgaagtcttgctcaggctggaatgcagtggcgcgatctcggctcactgcaacctctgcctcccaggttcaagcgattctcctgcctcagcctcctgagtagctgggactacaggcacgcgccaccatggccggctaatttttatatttttagtagagatggggtttcaccatgttgaccaggctggtcttgaacttctgacctcaggtgatctgcctgcctcagcctctaacagtgctgggattacaggcgtgagccatcatgcccgactgtagctccccttcttcaggtctctctgcttctgcctactctgctgctggctcacctttccctgtctggcagcaaagccatcaagtcaggagatttgatgcatccattgtcctggagtgcctctgggcagtactttccttgtcatgccaccttttggactgtcagctgcttctactttatctgggctgaaatgtgcaatcattttatttcctatttccatcctttctatcttttcccacattttaattatgtttatgtttttgtgggcttcccagcacattctagcttttgtacattttacttacattctgtagttaaatgaattctggcataaacaaacaggtaaaacaagtacttaccagtaagataatttctctgaaaacgtttatccagtcacattagttctattaccatgtgaagttttaccttcatgcctctaatttaacataagctaatccttcccttctacaccaacctaccaaaaaactttatctagaaatattgtaaaaaggagactgtattttgatttatgttcacctttttaatatactttaaaataaatgtgaatttcaaattgagttgtgtttaagtggacagtgccttctagaatgtcagaaatcttttctagtatctcatgggaggaaatatttaaacactcaggaaacaatgttaaaacatatttacttaagttcattgcatagtttatccatctatgataaaatccctttaaaaattttaagaagacacaagacatatttgaggactcaaatttgatcatatattgttcttctaaattacacttattttccccaagtgatgtatcatatatattatatcactgtgttggtattagagcccatttgcagttaattgctatttccttacctttagtgcctgtctgcaagtgttcaaaaatctgttatgtttttggaaaaccatttaaggctataccagtttgtataaacctttgcattctaattagcaaatgttatgttcagaaacagtgcaaaattcactattgctcagtattgctgtatctatgattatgattatttcatttttaggaacaagaactctatcaaaaagaaggtttaggtgttaatgaagtgcattatgtggataatcaggactgtataggtatgtgttttttaactccacctttgaaaaatataggaagatgtagtgaatgtgtttagtgctttttctgtgctttttaattgacattacttgttatatgacttgaaactggtatttgagagaaggttacttctgtattactgcctggaagttattttttccaccaagacttcaaaggtatctttgttggaagttttctataatctcttctatttattttgaaggatgttttcctatttaaatagttagcatgtgaattggttaagggggaaacttaattgcctagtcagtaaagacatttattcacctgaggaagtccatagttaggccaggctccaggcaagtttgtcagggtttgccctgcttttctgtgattctcttgtttctgctgtattctgtgcattgacagcatcctctaactggttgcgagctggcttcatgtgtcacagccagataacactgcgcagcaagagaatagaggctctgctttcattttagtggtaaagaaacctttccctatagccgcacagccagttttcagtcttccatttctttcccaccccatctctaaaataaactgttgggcaaaccttgtttttaaaacagtttgataatcctgtcagtaactgatgtgctggatttgaaaaacatagtataataataatactactttacatcagtataaattttcaaagcactttcacatttcacttggtccactccacatttccttaacacacggaccctttctaacctctgagtctttgactgtgtggtttgatatggctggaactcttccccttccatttgtctttcaacccactttcacctcatgctacatctatcaaaatactcccatttgtagcttagttcagcatgcccctcctgccctaccactaattacccaagaagcatcattttctcactaatgtagttagaatctttctcttcctatgtcttatagctttgttccacttaatcattgttatatactgtattcaagcagtttacattttatagttagttttggacaggaaggaatttcaaacgaatggaaagagcgtaaaaatgtgttgttacagattttgtttgaaagcgtttacatcagtttctaaaagtattattaaaaagctatgcatgtagaagtttctgtagttttactttactttgaatatagctgtcatttcgaaaaggaggaatttccaattccttagcctcttctcctggtttacaaatggaatggttattatagtcatttgctttctttatgtagtagcttttctaaaacctatattaaatatatactgttacttttttataaacggccagatttgaaataaaaatccgtcagctctctataacttttgagagaacacatatagaatcacatgctatgttgtttctgatcagtccttgaaatctgtgattagtgaattgttcacatatctttaaaatgttatgtttttacactattgtgagtgttttcattttttgaaatagatttaattgaagccaaattagtgggaatactggatattttggatgaagaaaatcgccttccccagccaagtgatcaacactttacatctgcagttcaccaaaagcacaaggatcattttcgactcactgtgagttttgccattctgaaattgagactatggtgggacgagacattattaaaaaggtgcattagctattagatattactagataattagaataaaaattatggcgtgtatagagcaactatattatatccagcacagtatcttccttagatggatggatatttatatatgatttttatgtagtcaagagactttttctctgatgaaaagtacatttcacctgtctaatacgtacaatgtgcctgtagtctgagatactagggaagctgaggtgggaggacagcttgagcctgggagtcgaggctacagtgagttgttagcatgccactgcactccagcctggccaaaagagcaagatcctgtgtcaaaaaaataaaagtacaatgagaattacctgctgtcttcatggtctcccttctgagctaagtgggtatcagttgctttgttttgtgaccttaatcacattccaggagttggcactcggagtcgcaagcagccatctgtctgcttatttgtaagaccagcagttaaggttgtggcttagaactcttgactggtgcaggcaatacaaattagataatgatcagccaattcattttgaccctctttcctaaggagttttgagtggaaaatacactcagagagggaaattgaatctgaagcaatagagagattaggtagagtaaagagaaaagcagacagacagcagtagaaacaaatgagaggtgcactctaaaaggccagaagacctggtttctgttttcctttcttttttttttgagacagagtttcgctattgtcacccaggctggagtgcaatggtgcgatctcggctcactgcaacctccgcatcttggtttcaagtgattctcctacctcagcctcctgagtaactgggattataggcatgcaccaccacgcccggctaatttttgtatttttagtagagacggggtttcaccaggttggccaggagagtctcaatctcttgacctcatgatctccctgccttggcttcccaaagtgctgggattacaggtgtgagccaccgtgcccggctcagaagacctggtttctgaactgctgttaggtcgcagagctgtgcttgagtctttagagccattttccatgagggtggactgtgtggctattgagatgtttcctgtgttcacctcttctgaacctgtcttttcattcagccattgtcacctgaggtaataaaagcacagctccatccttgtacccagaaagagcctggctagcacagacaatgtgctagccacacaaatggatgtcagtttcaaccacaaagatagttgctgcctcatctcatagacaacatcattaacaacaacaacaacaacaacaaacaggagagtgaaaaagaaaagccgtttagagttgcctagtggaattagggaactaataggcaaaattgcctctcaaacaaactgtatattattttgagattgtaacatagtataatgattattgctttgatgaatccagaaacttaagtgaatggtaacaagtagttttgtttctattcatcattaacaaaatcagtggtaaataggtgaattggatttacctgaaaagctcatgtaattgtgttaaccttcactagggactaaaatctcacatccacctgctccattgacttgcaattcttctgtatccctatatatttcttgtaatgtggaatctatttctgttacttcagtggagatagaaataaaacaatatgtatcctcaacaaaacttctgctaaaattgaagatatatatccaatcctattccttaatagctcgctggtctttgttatgaccagcctatggatgcatgattacctttaccaggagttggcacctagagtcataagcaggtgacttaccaggggcactaattgctagtcaacagaattgtcacgagtgtctcagaggcatgtgacttaaaagacagtaaactgaagcatcaagaatggaccttggctgcttttgtcaaccaagaacaagagtaaagcagtaaatcctattttatataggttattccttttgttgtattttttgaaaataaataaaataatcatttattgaacacttagatgtggcaggcactattctaatgtttttacttgaattatttaatcctgttagatgtgtatgctacagatgagacatacaaggagaggttaagtgacatgcctaatatggcatgtaaagaaatggtaggttgggagtcaggctaggcactttggctgcagagccggcactctgacttgtcctggtgtattgcctcccacagggaacagcctctctgttctgctacctctttaaccttgagcaagcctctaaggttcccaagtcagttttctcaattttatttttttgatttttctttttctttttttttttgtagagacagaattttgctgtgttgcccaggctagtcttgaactcctgagctcaagcaacccacccgcttcagcctcccaaagtgctggaattataggcatgagccaccgtgcctggccagtactaactgggcctgaccctgcttagcttttgagatcagatgagattaggcgcattgagagtggtatggcggtagactctcaattttaaatgatgtcttttttttttttttttttttttttttgagacagggtctggctctgttgccctggttggagtgcagtggttctttcttggctcactgcaacctctgcctcccgggctcaaaccatcctcccaccttagcctctcgagtagctgggactgcaggcctgctccaccatgcctggctaattttgcatattttttatagagatggggttttgccatgttgctcaggctggtctcaaactcctgaactcaagcattccgcctgcctcagcctcccgaagtgctaggattataggtgtgtgccaccacacctagcccaacatcacttttcttacccttaggttatttcaagggtcagatgtgatcttgtaagtgaaaacattttagaaactttatgatatacatgtgagatattatgattaaatggtacaacctaaaatgatttagttttcttgaaatagattcaggctccttgtgtaaatatgttaggctatattatttgaaacggtaggagagtccctttgctgatgtcaggtgtttctttgactggctgcacatggaaatgatttgatataaatggtatgggctttgggatgtttaaaagttctccaggttgatccttttgtagttcataagcctgatgattggattttcatgctcatgtgtgcgatcttcctccctcagccttgttaatgtgttggcacattactcatctgacgtgataaagatagatagattttaaaaagttatccaggtaattctaatagagcaccaaggttgagaaccactgctttagaaataggtggttaactctgtaaaatgccaactgggttttgcatgtgcttttaaaaaaaaatttttttattacaagcatgttcttttaaattgtgtttttttttgggtctctttctctccgtctctgtctctgtctctgtgtgtgtgtgtgtgtgtgtgtgtgtgtgtgtcttacacctattttctttcctaagagattataccaaatatttgctagattttattgatactttaaggcatactcaatacataaaagcagtataattgtgaaaagtgtgaaaatttcctgtataattttaagtgttttacatctcagttgttttgtaaagaatgattatgtaatatatttttgatcatttaataactcatatatgtattgtttttcagattcccagaaaatctaagctggcagttcataggaatatcagagacgacgaaggcttcattatcaggcattttgcgggggcagtgtgctatgaaacagtgagtataacttttacaaggagaaaaccatttcatgttgaagctgcactgtacagtatgatagcttctagtcacgtggttattaattatttcacgtggttatttaaattaagtaaaattacaagttcaattcctcagtacactagccacacttcaggtgcccagtgtccacactgactagtggtgactgcgttggacagtgcagatacagaacatttctgtcatcacagaaagttcctttggacagagccatgttaagtgatgttatcacaagatggacagaaacattcctgtttgatttatttttcagacccagtttgtggagaaaaataatgatgctttacatatgtctcttgaatccttaatatgtgaatccagagataagtttatacgggaattatttgaatcatccacaaataacaacaaagatactaaacaaaaagcaggaaaacttagcttcatcagcgtgggaaacaagtttaaggtatttgtgttatttaattttttttttactatatttaaaatgaaattattgttttatattctaaaatggataatgtagatcactgtcagaaatctcacagtgaagttcaagagcagaccctgcattgttgatatttgtatgtaaaatatcataatgtaggcctagtaattgaacatacagaaatgcttgtaattatctgaatgtgttcattcttggttcttaacatatctgattgcctctcctaatgttcttgcttctgcatactgtctggttgaccttcaaaccttctctttcccatgtgttttctgtttccttcctcattcagcggttttgttttagctggagtagtccagctcgggatggctagagaggactagttgagttgagagaggaaagcaggcacagccaggggcttcaggtaaatgatcgccttcatggactcctatttataaagtggctgccatgttaaaaagagcccatctgaagttaatgattcagtttgtaattcattttcaatgtgtttctctcacaatggcattttgggtgtgcatattacactaaaatttgattaaagcttttaataacttctgttaaagataagcacttaggtgtggcaaactcttcaaactgcttatttaacatggaagaatatttcatttgttttattaattttggatcaggaatttattcttcaaggtctgacatggaatggcacagggtttgtcttagaacactactaattggttctagttattgaggagtgtagaaaaaaaatgttaaaatttgtgaagttatgagtttaatgaatgacaaactatagtatgtagaacaaaaaatgtatatgagagaattaatttcttatatatttctacagagtattattgttatatttataataaaactctacatttgcctttcactatatgtactttaaatatttaaaataatgtaattaggaaaaagatttaagtgtctgaatgttatggtactgataatataagcctccccaaatttattttggattgaaatgggctctaaataactaaattgataaaatatttataagagctagtttttttttaagcttaaacataaatatagggaaaaacctcataatacatttttaggtaactgaataaaaagccttgaattttgttataagttatattcattattatgagtttctgattcagtgaacaatcttttttttatttgagtattcttctatttctgaatcgacatttgatagcagattggtttaaaaatagtatatttgcctatatgaaatggatgtcattcactattttcctactctaatattattgtagtattgctgataagagcatacttgaaattttagaaaatataaataaagacattcttacagtttttctttggattacataatcttttatgttgagccttgaaacttcttataattgcttatatttaatacaatgtatttttttacattaagccactgaaagtgatagctgaatgatactaataataaaatatttcacgtttttctctgagataccttgaaatgaaataggaatagattcctagttttaaatatagtagaatagctcattaaattaaaattgaagtatataaggcaataaacacaaaacaggctatcatttacagcaatacttcagttatccagcatccctggaaaccagaaattttctattggaaagtgcctttttcaggttattgaaacataaaccctttactgttagtgttttagaaaaagtcatcctttttgatggaaacataattctattataagaatatttgtatgttttcaaataaaaatacaaataaagcatgagttgcctgaggctttttactcttaagccttatggtccttggctgttctttgatagttgactttcttccctcttttctcagctgctaagagtttattttgatgcttctgttcttttgactttatctccattttttttttttttttttttttttttggagaatactgtgcttagtctgtggatgaaggagtctggactttgcgacagttattttctttccaaattagtcactttaatacttttcaggcatggtggttcagattgattacggttgtcagaactctgtcagtgagataagtgggatacaactgtatttctttaattcaatgacaaatccattccattttaataacttaagcttctcagtatatgtgatgtatactgtaatagtatcactcacaggagaatgaaatttggtgtcaggccgatgttggaatcatgactttgccattattagctccgtaacctcgggcaagttatttatttccttggattgtcatgttctatccttaattagatcaaacataataactcctgtgaaaagctttgagcagtacctgacttatagatgacattcagtaaactatacttactaattatagctatgattaatacaatgttagtttaaaaattaacattagtcttttgtaagtagtttaataaatacctcagtataaaatccagatagaaaaattttacataattaacttattttgcagagtagtaaggcaaataaatgattttaatacactgaaccacaccacatcataatcaatgttataaaaacaagaaagcatagtaacttgtaatgttcattgtgaattttttttgagaaaattgtccaagcatttaaaaataactgaaatgtaaaatgttttaaaatgttaaagaggcagggtgcggtggctcatgcctgtaatcctagcactttgggaggctgaggcgtgtggatcacgaggtcaggagatcgagaccatcctggctaacatggtaaaaccctgtctctactaaaaatacaaaaaaatttgctgggcgtggtggtgggcgcctgtaatcccagctactcgggaggctgaggcaggagaatggcgtgaacccgggaggtggagcttgcagtgagcctagatcatgccactgcactctagcctgggcgacagagcaagactccgtctcaaaaaaagaaaaaaaaaaaagttacagaggatttctatagctaggcaggacaattttgtttacactaagtgttccataaaacaatcctaatatatactattagtgtatattttaaacatgtcttcattcctaatgtgtgtgacacaaactacagtttgccacattcaaagactgtgctattgatctcttattaaatgcatcctcactattttcatttacttccttcattgcctgtacattttttcctcattcattccatctgcaaatatgtgtgtatgtttttaatattgctaattttcagtcttttaattatacaacttctgtgtaagttattgttcttgcattacattagccattttgcatgatgctgtctgttaaagaatttgtgtaccaggaggttgttaaactggaatgtgttgtatttggatgttattgcatgttattttattccagtactggagagctaatattaactcatgacactgtgtactttggctttttgaaataataaactgatttcctttctttcacagacacagttaaatttgcttctggataaacttcgaagtactgtgagtatgcttaaaaagaaaacaggtttttatgggtcatctaaaactattattagtaattatgcaagtaggcatagtaaccctgtactaattaaaaatacattttaaactttattctcttattttaaaaaattagttttttttctgaagaaaggtcaaatatatatgtgaagtcagattattttataaatatatagaattcttgactatttaaaaattaagattatcttacagtttcaagaaagtgaaaataagtggtaatagtggagaatttttcttaggattaaagattagttatgaaattcaatcttattttattactcttacagtaacattctccagacatggcaatgttgatgtggaaaaaatggacaaaatatttttgtgccctgctatagagacaaaatttattagaagcctgttttttaactatacattttagtaattcaccccattttcttaaatgagaaaaacatcatagaaagaaattatatgtggtttatataaatgaagcatgattccaaagtaagacttattttttacacaaatccacagaacttgaaattttgtttttgtttttgagacaaggtctcattctctctcgcccaggctggagtgcagtggtgcaatcacaactcgctgcaacctccgcctctctggttaaagtggtcctcccacctcagcctcccaactagctgagactacaggcatgtaccaccactcctggctaatttttgtattttttgtagatatgaggtttcgccatgtttcccaggctgttcttgaacccctgggctcaagtgatctgcctgacttggcctctcaaagtgctggcatttcaggcgtgagccacggcacctagttagaacttgcgtattctttttcaaatagtcattttgaatagctagacatttattatatcagtattattgttgcttaacttactgttagattaatttttggaaccattaaaaatctttttaatatcctctttggctgcaaatatctatctcttaaggccatgtatatttaaaaaccaaatctgatgaagagagtatttttatttcttagatagggtgctgctctaaaattatgagattactttgtgatttatagaaaaaaaagcatttctaaaacgtgttctagaagtgtctgtgggccgggtgccatggcttatgcttgtaatccccagcactttgggaaggctgaggcaggtggatcacctgaggtcaggagtttgagaccagcctgcccaatatggtgaaacctcgtctctgctaaaaaaatacaaaaattagctgggcatggtggggcgcacttgtaatcctagctacttgggaggctgaggcagaagaatcacttgaacccaggaggcggaggttgcagtgagccaagatcacgccactgcactccaacctggttgacagaatgagactctctctcaaaaataaaaataaaaataaaaataaatgaataaataaataaaagtgtttgtagggagcttcattgttgaaataattatttgcaaggtaactactttgaagagaaacagttatttggatgtctattagcttcagtactcaacaatacgtttcattgtatacataatcagtattctttctacctcattcagcataatctgataattgattccaaatgaatgcctttaagctttaaaaaatattgtttgacaaacaaatgttaaaatgtacaacagtgcagcttagggacctactgtatgtttttgaaatagaatgattgaaaatattgttttgttttcttttacactttggcctaagtcttaaggggcataattttatttactccttttgtcatagggaaatttccttatcatagaaatatggcatacataaatacatttaaatatagaaaaaaatcacatgtacatcagcctgcaaagtgtgttgtttaaatatgttaaacaattaaatgtgttaaactttacagtgaaagacttctctttttacagtttttgacattcaaatctaaaatgtagtatttttgtaatattattaattagtaattcaaaaagtcattgtaagctttaaagcagaaaaagtatgcttgtaaaattttgagttttttttttttttgacggagtctcactctgtcacccaggctggagtgcagtggcgtgatctcagctcactgcaacctccacctcctgggttcaagtggttctcctgcctcagcctcccaagtagctgggattgcccaccaccatgcctggctaatttttgtatttttagtagagatggggtttcaccatgttggccaagctggtcttgaactcctgacctcaggtgatctgctcatttcagcctcccaaaatgctggattacaggcatgagccactgctcccagccttgagttctttagtaattacttttacaggttcatatgttaatgttaatatgctttgaaagttgcaggtattcatagaaacagaaaactaagaatgctatatgtattgtaacaaaaagtacctttattttcctagggagcaagctttattcgttgcatcaaacctaacttaaagatgacaagccaccactttgaaggtgctcaaattctgtctcagcttcagtgttcaggtattttcataatctctgtcagtgtgtgttagtagtcatagctcaaatacaatttaataggttcagtattttcaaataattcaccattatcttgattattttacagtgcaataaaattttcatcttatattttctttaattataagaaaagtatagagccacatgtggtggtgtacacctgtagtcccagctacttgggtggctgaggcaagaggactgtttcagcctgagttcaaagtcagcctgggcaacatagcaagatctgttttagaaaagaaaagaaaagaaaagcatagatggcaaattatttgagcaatattgagatgttgtttattgtgaaataaacaatttcacattaaacatttatgaaaactctctaacagcaaaactggatcttccttaagtgggcagctttctcaatccagcagtagttcatttctcattccacacatgatggtcagaaggtaggttttgttgtcctttcttcccactccacgacttgtaaagaaaatgaaacacgattccctctgcatctgtgacacttcatccatttgcttaaactatcacttcctacccctcaccctgccatgtctgaccttgctcaggcaccaggcttgctctgtttgctttatgccttgcccatcctcccttctcaccaacactacccctaatttttcccaaggtatcagccttctcctttcttgtttaccttttgatccaactcagcttcctgacacttccttaaactttcttctctgactccttattttgctcttttgagaggtagatttactatgaagctaagattacttaagcttcagggtccttcatttaaataaaccccttccaaagccctgcatgtaattttctgcttcgctaaaggcctctccccaactatataagcttcagcccccgcctcacaaatctagatctacccttgacctctctcacaaaaccatagctattgagaaatctaattctgttctttcttattgtctgcacagggttggtagacaagacaggatggcaccagttaaattcatcgtcattatctttaaagggctctcaaacctgtcctgccaagttttcctggtcagcatgttctgtttctcatcagagactggtcagacccatcctgctttcctcaaatctctgcgcctctgctgtcagatgggcttacctccttaactaaatatcctaaagcttctcttgtctgctatcaagcacttctgcctaccacttaaccttccctcctgttgagaaagtaggggttgcctctctgcctggttgaggcttatagttctttgaaagccatctcttcctagtttttcatggatcttcagcattgtttatgtttgtcatactattccctttcagatggatctttcccattaccatttaaacatgctgaaatctcatctctaagccacatttctcttacagctacctcttcctccttatttttctccagttccttttctctccaagaataggttattgttgctttttcagtttcatgcattctacttactctttaactccaggataatttagctcccaccttgatgaggtcaccagtgattgccttgttctgaagcaaatgtcccttttgcagtccttattttagtggacttcatagccacatttgactctggccaacccttttaacatatccttttcttggttcctgacatggcgtatgcccctgcttttcttttgaattctctgaccattcctgattcccctgcaggctcattttcttctacctggacatttgttatcatttttcaggatttaagttaggcctctttttcttctcattctatgtcagtactgtccagaagacctttacatgatgatggagattttccatatctgtcagtttagtagccatgagacacatttgactcctaagtacttgaaatgtggctaagaatgagtgagttactaaattttaaattttgtttaattaaaaatttttttttggttgggaggggcagggtttattctgttacccaggctggagtgcagtggcacaatcatggctcactgcagcctcaacctcccaggctcaagtgatccttctgcttcagcctctcaagtagctggaactagaggcatgtgccaccacgcccagctaattaaaaaaaattttttttgtacagacaggatctcactgtgttgctcatgctggtctcctggtctcaaactcctgggctcaagtgatcctcctccctcagccttccaaagtgatgggattataggcatgagctgccatgcctggccttaattttaatttttaaaaatttaaatttaagtagtcttatgtggctagtcccgctgtagagcatgtggctagtgactgccaagttgaacagcacagatgtgtattcccttaggtaggctccccagttctgctattgtaaccttctaaatagtgagtcctgatagtctctaatccaagctgtcaccatctcttacctggatttttgctgtagcttcctaagtattctcctatctcttcagtctgtttttcacatgcatccagaattatcactccacaactcatctctaatcatcatgtccttttactgcttaaaatgctctaatggcttcagatgagtattagggtgaagaggtcccatagagcctggcccgtgtgtccctagcttcatttgtttacactctctccctcccttctctccttcagtcaccctgactttcattttcattccctaaatgctgcatatttcctcccagcacaggacctgtgcacatgctgcctcctctgtttgggatgttcttgctatactttttcctttatctttcacatctcagctctgtcatcacttcatatgaaagcttttcttgatattcctgacatggaggggagcctgaatttggggtgctgagctcaagtgcctttatttcacagttgtagttacaaattttatacatatttgtataattattttatttttccctcctttattccataagccccatgagggtgggaactgcatctgttttggcttacacatacattcctatttccctggcatatactagactcagtaaatatttgttgaatggaatgaacagtgtagaaaatatgaagatttatttgtgactaatgctaacaaatactggaaaattaagtaattcatgtctgttgtattcttccataaagtagagatgtatttttgtaatattcaagtccatttttttccccattggaattcctctttatttcctaagtgaacacctagtgtcctggcaagttgcacctgtttagatttagctatatatgctatcagattagtggagagggtataggctactgatgaatgctttagctaggattcctctttcaataagcagtatatttcaacatcttaagacatgttggcactttaacagataataccaattcattatactttgatttttttaagtatcaataatagatatcataatagtaataatgataatgatatagaatttgttccagtcatgtagctaggtgatgagaaaatgcaaaaatccataagttgtagaaataaaaatatttacgaagctttctaaaataaagatatttaagatttgaattgtactttaactttccattttcattttaaagagaattaataaatttaagtcaccttttactaaaattactatttttttttttgagacggagtttcgctcttgttgcctaggctggagtgcaatggtgcgctcttggctcaccaccgtaagctccgcctcccaggttcaagcaattctcctgcctcagcctcccaagtagctgggattataggcatgcaccaccatgctggctaattttgtatttttagtagagatgggctttctccatgttgaggctggtctcaaactcctgacctcaggtgatccgcctgcctcggcctcccaaagtgctgggattacaggcatgagccaccgcgcctcgtcttttttttttttgagacagagtctcactctgtcgcccaggctggagtgcagtggtacaatcttggctgactgcaacctctgccttctgggttcaagtgattatcctgcctcagcctccccagtaggtgggattacaggcgcccaccaccacacccggctaattcttgtatttttagaagagactgaatttcaccatgttggccaggctggtgtcgaactcctgagctcaaatgatctgtttgcctcggcctcctgaagtgctgggattgcaggcgtgagccaccatgcccggcctaaaattactatcttctgattggcaaataccagggcaaagtaggggaaggtgaaagaaggcaagttttcttcttctgtaaccttggggctgtgctgcctgtcttgtagcaaagaggggtgccagctctgcaccgagaagccactcatcaaactccaagagtaaaagccagttcatggaaatgtttagaaggcagagtatttgccttagtggttaaaaaaaaaatttaagcttcaaaacatcttaagagtaaactagctgcaagtgctgagaaagcagttgtaggcttggtaatttgttaagcaccatgaaattcttaatgaactgtgagccagtttatagtttgcagctacagggcaagccaggagacttagatgcatacatttccaaaggtacttgtttatttgatacaagtgggcaaaaactgtgatgatactaaccaaactttacttttctttctccaagcaaagcctagagctaaatctagttctggagattttttttccccatacgaatgatttctttaatgtgtttcattaattaatattgaaaattcacagtaacagaaattaaatagtacagaataatataagtaacaagaaatctcagctcttaggggtgaccacttaactctacgtcttgggtatattttttatgctggttagattaagctctgctttattcttttaaatatgtcatatcccatcatatggttgtaacataatcaattgagattttagtttttttctggttttttttctattaccaacagtgacccagaggacatctggacattgtccacatgcatatctttgcccacaagtgtgaaaaatcatagaatagatttaccgagccaaagggatatttccaaattgccatccaaaattgttacactggcttacttttctactaagaatgcatctgtgtgttttcctacactgtcatcagctctgagtactagttgttatcttatacctttgccagtcaaatgggttaaaattcaatctgactgtctgtaaaggccatctttcctgtgagattactttaaaataaaaattcactggtttaaaaagtcttagagtttgttttaatttaaatttttggctagcaggaatttattttggtgtaagaagtgagacaaggatctagtgttgtttttgttttccaaatggcttgccgtttgtcataatactatttattgaataatcttactttctccgttgatttgaatagtcccagagactgaaatctaggtcttgtaaataaaagtcctggcatcacttatagctcagcctttccctgcctatctcacactttttctgacctgaaaagctcacattgactcaagactcagattaaccacttactagagttatactgaaaatagatatttatccaatagactaatcatcccagtagtctagttgctttgagaagtgagtgaaaggcagtctttatagtgaaacagtgagctcttctttcttttccatttgccttatgcactgatgataacttgggaatgtatctactttttggagtttctttcaggaattttgttctaaaattcacctcaggcctttgaaagtggtttaatgcagggctttgccttatatactgtgtttgtgacacagagtcttctaacagaaaaaaagatacaaactagacttgatctttccttagttttgttttgttttgttttgatacagtgtctcactttgtcacccaggctggaatacagtgtcctgcaaggctcactgcagcctccacctcctttggctcagatgatcctcctgtctcagccccctgagtagctgagactgcaggcatgcactagcatgcctggctgatttctctattttttttttttttttttgtagagatggggttttgccatgttgcccaggctggtcttgaactcctaggctcaagcagtttgcctggcgtggcctcccaaagtactgggattataggcatgagccactgcacccagttagacttgatctgtctagagaccaataatttgcctctagaaaagagtcttattgggtttacaggaaatttgactatagtagttttaggtggtggataagttgggacataatgagcataaatattttcctatataatatttagttgctgataattctcataaattgcccgtttctaaacagtatcttacaaaaatgatcattcacaaattattttggacttccgaacagtgattgacagtgctttgtgcttgttcgtgaatctagggatggtgtctgttttggacttgatgcagggtggttacccatcacgagcttcatttcatgaactctacaacatgtacaaaaagtatatgccagataaacttgcaagattggatccaagactattttgtaaggtataaatgccacccaaattgaaatttcttagctatgaacttgtcttttctattaataattgacatttaactttttaacttttatttttcaggctttgtttaaagctttgggcttaaatgaaaatgactacaagtttgggttaaccaaagtattttttagacctggcaaggtaaatatacattttttactttaaactgtaacatcatgaaaacaaatagttggggttagtgaatatcttaaagtatttaataatttgtattattcttgaattatatggtcactaacaacatgaattgctattttccataccatttctcagaaaagaaaaaaaagttgagaggaagataattatatataatgttcataatttgtttagctttactcatacatatttattctaaactccccatttattttagagcacaggtgtccagtcttttggcttccctgagccacattggaagaagaacagttgtcctgggccacacataaaatacaccaacactaatgatagctgatgagctaaataaacaaaacaattgcaataaaaatctcataatgttttaagaaagtttatgagtttgtgttgggcctcattcaaagctgtcctgggccacatgtggcccatggactacagcgtggacaatcttgtcttagagctttaataattatttgagaactaatagtctcatagagaaagcactttttcttgtttaaactcctgaaaaattagaaatatttattgaaagcttaagacaaagatttaaatatcttttctctcgttatgttacctttaatttaattttgactataagaagccgttatattggttgatgggtttttgacattcttaatattatagtgggttatttggtaaaggattgaaatcattatggaattttgtggtatatagtggaaataatgtattttattagttaagaacctactagctgttttatttgtgttgtctgtcacttagtagcaaaaatttctcatctctgtttaaaatggaaatgggggttgggcgctgtggctcacgcctataatcccagcactttgggaggctgaagcagtgggattgcttggttccaggagtttgagaccagcttgggcaacatggcaaaacctcatctctacaaaaaaatacaaaaattagccgggtgtggtggtgcgtgcctgtaatctcagctacttgggtggctgaggtggggaggattgcctgagcctgggaagttgaggctgcagtgaaccaagattgcgccactgcaaaaaaggttgggggtgggtaatgggagttaggagagacagaataattttggcggtacctggtattatatagctaatatgcacttatcaaaagctccataaggatatctgagaatgtgggtgagccaattcagagatacagtagtcctttttcattcttttcttaataaagtcttctcgctagccatctgtaatttaaaagtcatcccccccccccacttttgttattgaatatgctacctagcattaagtaacctccttacctccaaaaaagctcctgaagaaagaaaggaagcaaaacgtggccaagtgtgtttgtgtttgttgtattctctgccaaggcctatgtaattgacatgtgaccattttcagacagttagattttggatttgaattctgtttacatcatgtctttatgtgttcaaatgcatttatattttaatactgatactaaattatttcacttcctagtttgcagaatttgatcagatcatgaagtctgaccctgaccacttagcagagttggttaaaagagtcaatcactggctcacatgcagtcgctggaagaaagttcagtggtgctcactctcagtcatcaaatgtaggtgttttcctttacacctataggatctttcattgtttcaagatggtttgtggagtgttgtaaagctgtctcagaggtgatgctgagcaacagagactgagacttgttcacactgggtcccaggttcctatttgtagatgttctttctttttttattttttgagtgtatgatatttattttctttattcaaatgtgttataagagtgtcagtttcatagtgtcctaacaaaacagaattcactatcttgatctctcgtccccgcacccctcaccatcccctaatctctcagacttaaaccagaacttttctttctgcctgcatggcatctacaatacacataccccgaaaattctaattgtaattgattttcctttcttatccctgaaatattgtcagtcaccagatcctgttgattccttctccaaatactgtacattcctttctttttcttgccagtgccttagtgaagtccttttccaccttttgcataataattccattagctcccagactggttttcctggtttcttagagatatctctctaaactagaagccttttataactttcctttcataaaaggtgaagtctaaattatttgatgtctttcaagatcatgtaaaatggtgtgtcagttttttgtttcagtctcttcccccaccatcccctcttaaatcctgttttttgaacggaagtctgtcataatcctgaaagacactgtcttgaacaccataatcccaaatgttgaaatcttaaaagatgaaagtcccaaaactaggattctgtaaaaataataaaaaaagatatttatttacattttaaaaaggggatttgagaaacgtataaaaacatgacagaactcttcataggccacttttcacaataaaataggcaataacatatatataggcaataaacatatatgtttattgaaactataaacacatatactaacaatagttgcatgggtataacaggagcagacaaaccgtattcataaagaatagggcgaaaggtgaaatgcataaacacatattattgtggttggtaattgtgcacccagctttgttactgcagtcatctgaaatactgtgatgatgaacaagctgtcttttgatgagatcagtcaaaaaccatagtgagtcaccactgcatttgtagttgcccagagaactgaaatcttgagaaattttatcttttacaagtgcagatgtatgataaaggacatctgttcattgattaagtttcagtgtttttatatacatacacaatgtttacccagaaagtaaatgttgtggtaatgcattttcatggagttaaatttgcaaaaaatgaatacagtaaattagaactctccaaaaatttctacataattaaaaaatgctaacaatttaagatagtgaaaataaaaacaaagaaaaaaaaaacacccaaaactaaaaaggaagtttgacataaaaaaaagtgtatcacagggacagattataggcagttgcatggagatagtccataagagctggctgtctttctcagtcattaactatattttgaagtcttgtaccacgaataataggtgctttttttcttttaggacatggttcttggagaatatgttcatattcattttcttcatgagattgctctttttggaattcttctgtgattcctctgattgggatttttaggatttttgatgttagggattttaatctaggaattttgatcttttgggatttcaacatttgggattatggcttttgggattaggaattcaaacccctttgacatactgggctaagctgcttttatgtgtggtttggccaggtcatagcagctacatagctggcccaagacaaaagtgagggacagaacattttggggttacctaaggatctgtggcaaacctttaattgttgggagctgtgtaggaatcagtaacttgattacatttacagttgccccttatactcatcagagtacctgaaatagtgctaggtacatgaaaaggatccagcgaatttttccttatcagtagaaaaggaaaattcttttggcctaatgaaaaagaatcatgctaacaaagattatttttgaggtattttgttagacaattgtgaatatagataaaaagagaactattaatataaaaagaaaaaagatagcagaatcttttccccatcattttccaaataaaatacagaaacatctttattactgtagtttaatacgttcagctttacacattgcattatgataggaaacacattatagtaaactcatctgttacaccattcatttgtggactgtgttctacagtggtaccgaagtcagtaaccgggcagggatctttgcagaatgttaataggaaactctgaaaaaaaagttcaaggtcagatcatcctaggaaattgtgagtaactgaagttaagtagatttctttgctgtaggattctcagaggcttcactcagtatgttcattgtgaacctccatacagaagtatagtgtacagcttttcataaactcatttgacaggtaaatccttttttcaggacatacctattcacatttcatagaacaaatgttgcctaagacagtttgggaggtagcagtgtagcatactaaggaaataatgcatttaaaatgtaagcctaaccagatacatgatattgtaactgcccagtgggttctccttgcccactacccagacagagctgatttatcaagataggaattgcagtagagagacagtaattaatgtagagtcggctgtacgggacactggagttttatgattactcaaatcagtctctctgaaaactcggagatctgaatttttaaggataatttggtaggggcttgggttggagatgaaatcatagggggtcaaaattgagtttttcttgcttgcttctgttcctgtgtgggagcacagaactggctgggccggattacctatctaggtggcatcagctggtgcattggaaggtctgcaaaatatctggagcactgattttaggtgttacaactgtgatgttatacctgggagcaatttgaggaggttcagattcatgcagctggaggctgtgtggctcctaaaccgtaatttctaatcttggagctaatttgttagtcctacaaaggctgactggttccccaggcaagaagggggtttattttgggaaagggttattatcatgtttgtttcaaagttaaactttaataaactaagttctttcccaagattagttcggcctacacccaggaatgaacaaggacagcttagagattagaagcaagatggagttggttaggtcagatctcttttacataatttccttggttgtaatttttgcaaaggcaaaattacatctttcaacatctttttatttttaagaagaataagaaattatagaaatgttaaaactggctgggcgtggtggctcacgcctgtaatcctagcactttgggaggctgaggtgggaggatcacttgaggtcaggaattcaagaccagcctggccgacatggcaaaaccctggctcgaataaaaatacacaaattagcccagcatggtgtgtgcctgtagtcccacctcacctactcaggaggctgaggcatgagaatctcttttttttttttttgagatggagtcttgctgtgtcacccaggccggagtgcagtggcacgatctcagctcaccgcaagctccgcctcccgggttcacgccattctcctgcctcagcctcccatagctgggattacaggcgcccgccaccatgcctggctaattttttgtatttttagtagagacggggtttcaccgtgttagccaggatggtctcaatctcccgaccctacgatccgcccgccttggcctcccgaagtgctgggattacaggcgtgagccaccgcgcccggccgagaatctcttgaacctgggaggtggaggttgcaatgagccaagatcatgccattgcactccagcctgggttgagactgtcaaaacaaaaacaaacaaaaaaggtgttaaaactttgtttttgatgtctgatatataataatatggtcgtcaagatttcatgtttcttgagaattactttgtgaaaatgagtttttttaatatatgttagatttaaactgaataattttctatcattttattttactcttacacatagtgaaaaacaaaataaaatatcgagctgaagcctgcattaaaatgcaaaaaactattcgaatgtggctttgcaagaggagacacaaacctcggtaagatgaatagttcctaaaaagaactctacaaaacctagttactgtaatacaaaatgacaataaagtcataataaaaagcagtttggatactcaggttttctcatgttctttgtaaaatgatgtattagtcttttatttgtaatatttatttgaagttagttaattcatttattaccttattacttgcctcattctataaaaggatttgaagtggcatacaaaaatgtgtaaagactataaaacaagaagtaagtagttgagagaagctcttttattctgattattttagttatttgagtttcttgataatgtcaaggtgacattttttaaaaaacatctcactaatatgtttacataattttcaagattatctgtaggaattacattgtcccattataaattagtctatttcttatttgaatctttcatttttaatttacacttttaaaaattggaagtctgaatatctctattgatccatcacaccttttcaaagagactagattaatttcctctgtgatttgaattctcaaagttgtagaaggctttaatcccattgacaggcatcagtgtcattcacactcatatttgattttttttagccttcaacaagagatctgaaaaagagaatagtagataatattgaaaacagaagtgaaataccctgtttagcattttataaatgaaaaatctgccaaaagtactaaaggatgaaattaagctctaatgaagtattatttttacagcattgatggtctggttaaggtgggcacactgaaaaaacgacttgataaatttaatgaggtagtcagtgtgttgaaagatggaaaacccgagatgaataaacagatcaagaatctggaaatttctattgatactttgatggccaaaattaaggtatgtaatttcaacccgaatgactttgactttttatgtaatttaatatattttgttattggtattgaaattgtatagaaaacgtccttagtttttcaaaattacaaaatgtgttgagactcaatgatggcaagtacatgctcatcattattacctctactctttatgtttgaaaaatttcatagcaaaaagttaaagaagacaatttttatgccatttcttctgttgctaagaaagatatccctcgcaacttaatacctaggtgatgggatgatctgtgcatcaaacccaccatggcacacgtttacctgtgtaacaaacctgcacatcctgcacgtgcatccctgaaattaaaataaaagttggaggccatacatggtggctcatgcctgtaatcccagcactttgggatgctgaggcggacggatcatgaggtcaggagatcgagaccatcatggccaacatggtgaaaccctgtctctactaaaaatacaaaactagctgggtgtggtggcatgcacctgtaattccagctgcttgggaggctgaggcaggagaatcgcttgaacctgggaggcggagattgcagtgagccaagattgtgccactgcactccagcctggtgacagagtgagactccatctcaaaaaaaaaaaaaaaaatgaaaaaagaaaactaaagttggagcaaaaagaaaatggccgggcacggtgggtcacgcctgtaatcccagcactttgggaggccgaggcaggcggatcacaaggtcaggagattgagaccatcctggctaacatggtgaaaccttgtctctactaaaaatacaaaaaaaaaaaattagccaggcgtgatggggggcacctgtagccccagctacttgggaggctgaggcaggagaatggagtgaaccgggggggcggagcttgcagtgagccgagatcgcgccactgcactccagcctgggtgacagagcaagactccgtctcaaaaaaaataaataaataaaaataaaagtggtggggcatggtggctcctgcctgtaatcccagcactttgggaggccgaggtgggcggattatttgaggtcaggaggttgagaccagcccagccaacatagtgaatcgccgtctctactgaaaataccaaagttagccaggtgtgatcgcacgcgcctgtagttccagctacttgaggcaggagaattgcttgaacccaggaggcagaggttgcagtgagccaagattgtgccactgcactcctgcctcagcgacagagagagactacgtctaaaaataaataaataaatgataaaagtaatataatactataaaaaatttggaggccagatgtgatggctcacacctgtaatcccagcactttgggaggcccaggcgcagggatcacctgagctcaggagttagagaccaacctgatcaacatggccaaaacctgtctccaccaaaaatacaaaaaattatttgggcatggtggtatgagcctgaggtcccaaggaagctgaggttagaggattgcttgagcctaggagatggaggttgcagtgaacagagattgcaccactgcactccagcctgggtgacagtgagacccctggctaaaaaaaaaaaaaaattggagaaaccaccaaaaacctcttaatacctccacattaacaaattcagttagttactgttatttttacagtataattttacttgtttttactttaccttacattctcttttatgcatacatttttacagttcttatcataatatacatttcaatttctatctctaccattgttatatacttgtccatgttaatacattatcttcatagatacgataatgtaattaattttgtgaaaatagcaatttcctctccaattttgtaggaaaaaaatgggatcccttattttgttttgatttttatttatttgattactagtggagttgaagacttttctatatgcttgttaattatatttcatatttcattaattacatttcatatcttctcattatattttagagttttaatgctttttctcagtttcataggtcagtgcaagtatgtgggatataatgaatatcttaaagtgagcgttttatattttctgcagatattttatgtaaacaatggcaatcttggaggtagaaaggaaaaaaaagatctggaggaaaatgaaaatgctataaatagactcagctgattttataaatctgtcaagggccatctttgtttatgtggtatcattataaattaaaattaacccacccacattttttgaaggctaattttagaaatccaataattttggatatattttgtaatttttaaaatattctctaggtactatttgaacattattctaaaatagtagtaaactattgctaaattagctgatcattacttaagaaataattctttttgagataagaggcttgctctgttgcccagtctggagtgcagtggtatgatctcggttcactgtaacctccgcctcccgggttcaagcaattctcctgcctcagcctcccgagtagctgggactacaggtgtgtaccaccatgcccagctaatttttgtattttatttttataagagacagggtttcactatgttggccaggctggtctcgaactcctgacctcaggtgatctgtccaccttggcctcccaaagggctgggattataggcgtgagccactgcacccggcctagaaataatttttaactgcagtatattaccttatccacagattacctgtctaattgatgtgtaatacttgtgtgcagagataacataaaacattttttgaatagtatttaatgtacaaacagtatagtaaagataacggacgtattgcttaccatcttacctagtttttgctgtatttgcatattggagtagttttttattttaaattgtaaaaaacaataaaaacattaaaatttatcttagccatttttcagtttataattcagtattgttaagtatattcacattgttgtgcaacagaagaaataagcttttacgtacctatttattttattttttaaagtccactatgatgacgcaggaacaaatccagaaagaatatgatgcactggttaaaagctcagaggaactcctcagtgcattacagaaaaaaaaacagcaggaagaggaagcagaaaggctgaggcgtattcaagaagaaatggaaaaggaaagaaaaagacgtgaagaagacgaaaaacgtcgaagaaaggaagaggaggaaaggcggatgtgaggcatttatattattttgaataagagacttaaagaaatagtgaattcttggtattgacagtggttaatgacaattatttgttttgttttgtttttgtgacagggtcttgctctgttgcccaggctggagtgcagtggcgcgatcttggcttactgcactctgcctctcgggttcaatcgattttcctgcctcagcctcctgagtagctgggattacaggtgcgcaccaccacgcctggctaatttttgtatttgtagtggagacggggtttcactatgttggccaggctggtctcaaactcctgaccacaggggatccacccgcctcggcctcccaaagcgcttggattacaggcgtgagccaccgtgctcggttgacaattcttaaaactgtgttcttattttaatgaactaattttgtaataagtttgaaaattgagagaataaggtcattttataatagtgataccataaaataattttaactataatctgaatttgttagcctcttacacctgaggattttcttctttttaaaactatgatttgtttattgttttctaagctagataaatgacacttctacttttctgcagttttaaaactgataacattttgaaagattgccatgatagggtagagagaacagatgagttgttgacttggagagggactagagggaagcacctttaatcaggaccttacagccaggctttgtaaccacattcatctagagatgttaaaagttatagaatataattatatttgttttatttaagaattattgtcaatagagttaaattttattttattcaaaataagttgatgtatgtggccaggaggttaatttgcattcccaatctgttacctttgtttattattaaataatagttaaattgccttctgaaggattctttattttctgttaaatttttgaagagttttctattttttattaggaaacttgagatggaagcaaagagaaaacaagaagaagaagagagaaagaaaagggaagatgatgaaaaacgcattcaagtatgtacttactgggttgaatttctattaaaatggaacctacaggctgggtgtggtggctcatgcctgtaatcccagctctttgggaggccgaggcgggcggatcacgaggtcaggagatcaagaccatcctggctaacatggtgaaaccccatctctacttatacgaaaacaaattagccggacatggtggtgggcacctgtagccccagctaattgggaggttgaggcaggagaatgatgtgaacccaggaggcagagcttgcagtgagccaagatgacaccactgcactccagcctgggcaacagagcgagactccatctcaaaaaaaataaaaaataaaaaataaataaaataaaatggaacctatgaaagaagtgaaaatgagatcttgatttgctagataagctgtcactagtttatcctagagaccaaaggccagtttttgaagtggttatgggaatggactttggagctagggaagtgggttcaaatccaagatcagtcactgacagaaattgtgacattgtacacattatagtgaggaactatgggtcacagttgtctctctgtagaatgtggataaataatagttgcaagcatttgacagttaatacatgttaaagcattgtgaacactgtgtagatcaataaatattaataattgtttttatacctaggggaaagtcaaatgaaaattcacttaaaatgttaagttttaaaatatcatataactttgtagatactggaattaataaattaggattaagagtctctctccacccctagtttttaaaaagtcccatgttgagaataaattgctcatgtatttgaatttctgtttgtcatggctttcataatatatcctaagcataaccaaaactttaaattcctgacatctgctctctaggtgttagtgttaatgggatgcctaagatactcatgtgatgtttgggacactaatatttatagtcatagagttatggagctgtggttcttctaccttctcttggtcttgggaaagaggcaaaatggggatgtgtttgaagcattaatcataatagagaagaaagtagagactgaagagatctgtgcttaagcaattctttagtaaagaacttgtatgggggcagttatgctttccctttattttaagtaataaggggagtgatcaagtaaacaagtgaagaactcttggtgaaatagctttctgcccttgtcaggctgaagtggaggcacagctggcccgacagaaggaggaggaatcccaacagcaagcagttctggagcaggagcgcagggaccgggagctggccctgaggattgcccagagtgaagccgagctcatcagtgatgaggcccaggccgacctggcgctgcggaggtactggggcccctgggtggggtatagcgctctctcctttgctttctctacctctctgcctctcatttccatgcagaagggaataggagaaaataatattctgaaggccctgatatatttgagctaaaataattttaaaattatttgtatcgactttcatactcaagtgaatgagataattgatttttcatcatattattaaattgttgacaaataagactaaaatttcactaatgagtactctattaagaaaatatatcaacctttaccctgaaattgtttaagagtatagtatattaggtagacacctaatttctaaatacctgtcatcaaacactggcattgaaataagtgactgtgttatataatgcagtgtaatgtatttgtagttgagatttttctaatgcaaaaaaatttaatgtattaaatatcctgtcagttgaaatgagaactctactctgcaatgcctcagaataaatgagtttccctttacaagaagggagggttaaattcattgaaatattttggcttcttgggtttctgaattatctctaagcactccactatagtggagtgtataggaatgtggaagctcttattaaaagttgcagaaaggtttaatagattcagtttaaaaaaatttagtatgtagaggcattaattattttgattatttataataacaaaactaatttgtaaggttcctttgtatgtaggtatatatatgttgtatatatactgagaggcacatagacacatgtaaccatgcttttccgagcttaaaagcagtttatgacaaaatatagagtacaaccactagatggcgatgtttccttgtgaaaggatcaaactgcaatgtaatggaatatttggcaaaaaaacaaaagacggggaaggaaaagggcatattgagttgccttcatgctttttctattaggttggtgcgaaaataattgcggtttttgccattgggaaaactgcaataacttttgcacccaccaaatagtatgtgattgtattggggagctctgggactgcttgtatatgaaagtacattatattgtaaatgaactgaatatggctatatgaacaaaagatgttataattattaagctcttgggtttgagtccaatatttgggctctttattaagatttcactgtaattaaaatattttggcccagatagggcttttataaatgcagactcagctcagctgctgttctgttccttccacctgtgttgcatcagaatgattgggagtctttatgtgtaactgactagccgcctagggcaggctcttaaacgaaccaaactcttacagctgctatccctgatgtctgtgaggaagtactgcagttgacagagttgattttattatggcagaagtcaatttctaagggacttgttaatggagtcattgttggtactcatcatcaagctttatatttatgcacttgaaatgttaagctgtatccagtgccattccatatactgtatacaagatactgtctcatatgtggaccccttcccatcttcagaaaggtacatgtcttccaggttgagaagagtggatcgtttaggacctttaacataaacaagttacctgtaatttaaattaagcagaattagctaggtaatgggaccatattaagtaatgaggagatattcaaacccttatgacctgaaaggcagaagagctagttttagttatgtggttcaggcctaggggtggtatgaagaatgcccttcaaatcctttctgtcagctctccaggaagctttccctgaccctcaggtcctcatgagctccttcccttctggtcgtcgtggttattttatactgtgaactacaagcattagcacttcattatgaatgatgttctatacagatatcacatgtttgatagtttaatcttactccatgggctatagctaaatgtttttgaatgtttattttacctttgttagcactgagttttttctctaacaaatttatgagtaagaactaagtaaactgttcttaatctatagcatgatgttgttgggttctatgctgtgttaaaaaatgtatatattatagatagattctgcttcaataagcaattttaagttacttttccagcttggattcctatccggtaacttctaagtaagaattgttttctatgtatgtcatatgttctgaaatataatttcaatcaattacacatatgattcttgatgcaaagagatggtttcaaattacctaaaattgtaaaataatatccagattctattaaaaacaaacctcacaatatatgaattttctaatctagatgtaatgtatttgctctttaattttcactgcatgccttattttccaatcatttttaatgaatacttaaaaatatattaaaattctgagtgatctcatgttgattacaaataattgagtttttaaaatcaatgagtaaagtaattgaaacacaaatttgcacaatccagattttcacagttcacaattggttacgatattaactaaaatatattcttttcacagaaatgatggaacaagacccaaaatgacaccgtatgtcacttacctttacctttttaaaaataggttgtagatactttttgggagtagttttctcattggagtaaattttaaattattttcttctattgaaaggtaatgagataacctttttcatatttttcttgtctaggaaagtttaatgctcttgtatggtgctcaatcacagtagctcatgatttggtttccttctttgtattgtctgtttaaactataatgtaacacctattttgttttatgtatatatatgaattttttttttttttttgagacagagtttcgcttttgttgcccaggccagagttcagtggtgtcatctggggtcaccataacctctgcctctcgggttcaagcgattctcctgcctcagcctcccaagtagctgggactacaggcacgcaccaccacactcagctaatttttgtatttttagtagagacggggtttcaccatgttggccaggatggtctcaatctcttgacctcgtgatccacccgcctcggcctcccaaagtgctgggattacaggcgtgagtcactgtgcccggcctgttttatgtattttttttaaactgccccttaccttacttctttatagaagcaggtgtggaggcataaataataataaaatatttgattttcagtatatatggtagttcattctgctatatctaaaataattcatcatctgaaattgtatatgtagtgctaactttggtgctaatgtatctttttcatatgaaaatctacccacaaagaatccaggtaacatttggaatatacattttgtttatataaaatataaaacatattttgtatgtatgttatgtatactacatataaggattttggaatatatataaaatctttattttaacagctttaaggactccaacttaacatttatgatgaggattctcaactctatcaggctccagtcccaataacaattttttaataaatgatgcaacctatgtaaacaactctccaaacaatatatgtaaaggagaaatacaaggatagtcatttataataaaatgtttatttaatatgaaagtgcttctgcataactgcagtagaagacatgataagcgatcagatgtttttgcttacgtatagaatcaccacgaatgctgtatctacaaatacaaattgatataggaatgttgtgttgggcattcacatgccatgaaattgtgaacaatcctttgtgaagttctgaacagagccaagtacaatattctctcaattacacagtatttgcgtaagccctagacaaattctgtgaatattaaaggcatgcaaaaaatacgttgtttacatgtataactttgtttacatgtaaaatatgtgtttgtatgtgtttttcacctctgtatgtctcacagacatgttaaagttaaatggggcatggagtagttcttccttgggtaggacatttggcattcctttccccttacctcagcagatgccaggagtatactcacacattgttgttaccacaatactgccccaaattttgaaaatatctctgagtgggcactcttgccctccattgccacaactgctttatagttaccatttgagcttgaattaaataagcccgcaatcagtgtctaaggtgaaattatatttgcatatagtttggtaaaatcagaaggaagaaagcacctgggtgcaggaaccatttctgtctggcaaatttgttgcagtgtattggtctaggtcaggtgtatcttgatgcagggtcagggaggataatgcatcagtagagattgccatccattgtagtgtcagagcatgcagaaaaacacctgtgtgatcaacagacccagtggtaatgagatttgaaagtccatagactcccttaaaacctaccatgggaaaagaaatggaggaagctttaggagaaaaagatggtaaaaacagatgctcttgaatcctgagacaaaaaccttgaggtggagtgataatagaattaaacatacttatcaaaatctgctgcatttaaaagtgagacgattctgagaaactactagcttgaagagagattgataaatgtattgctcaaaagataatttttattagattgtatttgtgttatattttgtttttgctgtccttcactgtcagctttgaaagatatcttgttctctgactgtgctttcatagacctccatccatacataattgtagacagtgttcattacgagaaaagaggaatacaggagtgttctactcctttagtcagggtcccagctcttggcaggcattcaggaaattgcacctggaagcaagtacacccatcttcttttcttatgattttactgatttggaagggtttgaggttactagagtttgatgagtagaatgaatgagaaaataattacgaaggaaaagagcaaatagggaaataagttaaagaagtgttgatgaacactatgaaacttcattctgttttaaagaattaaacaaaatttgataaaagttacactcttctgggtaacaaaagcaaaataagttttttgcctttggcaaatgtttatccctggaaaatcagaatgcctcagatctttcattagtccattttgatattctttttcttaaaagcatgctttgatttggaatttttagagctttgaatacatcagattctttttaaaactctgacgctgtcaaatacatcagcttgtggttttcaccattgtgccttatctaagtaatatttactaagcaactctggtgcaaaaatcctcatatggaatctatatcttgccaagtttcctgtatggatttagaccatgttatttgtattctatatggaaaagaataccataaaagctttcctgagattttatctaaaagttgctactgcaaaaatggagagacattcaaataacttgaactggatttaaacaaaaatttttctgtgtgttacggctagatttgttgaatagtatattctaggcattaacaaagtaaaacagttatgaacagttgttaaataatattgaaaatatatattttaattatacttttagatcttttaattaatttatgtagtatgacttttatgtaaccatattgtattatcgtttttcttgtagggaacaaatggccaaagaaatgtcagaatttttgagtaggttagtgcagtgtaattgggggaaataagtgttcacctcaaaatcatatttttaaattacttttgattatttggaccagaacctgttacatgagtagcctagtctttctatgtaaagtgatatttctttctgtacaagaaatatcacttctccctcaccccacccaacaaagaaaaagttaaaaaccagtattccttcaaagtcatggggataccattggcattttgaatgggacagttcccttggcagtggaactctactgcttatctctggcctccaccaactcagtctcagtaggggacttcttcccctcatcatgacaaaatgagtattttgcaactctccctggggtggtgctgcccctaatttgggcaccactgtgcgtcgttgaagaggaggtagaggaagaacatgactcttgaggggctctgcactgtggcacatggtttgaaaaccactggtgtaaattgagccaccagcaggatctggtccattacttttataaatggatatgattcactaacatgttaattcttaattttgaagttacaaagataattaaaagtgttaatatattaacacttaaaaatcagtttgctactattgtattctttacatgattgtctttatagcaagtctgaataatcagcaaattacccctttactattttagtaactccagagatgggggtggggaaacatttaaatgtgttgcattgatgtacttctttggatgctatgttttttagtagatgtacttttgtttgaggtaataggaatgaaaagttagggatattaaaaccatattttaagcaataatcatttgaatttaatgtaatttttaaaagtatcaaaacacattttacatatattctaataccttatatacattctgacaattataaaactgtatattatgtcaatttacctcttctttcaaaagaaaagataacaacaaaaacaaaacttaataattttcagctgccctcctagaaaagactcccagaacagcttaaaaataaaaggattttttttgtttattgattggtagtttagggatgtagaaaagacaaataatatttgaataaatataaaagcataatttattgttaaggaaatgagagaccttgctgatacacagctggccatttttgagcaaagcaattaagaccaaaaagctacatggaaaattgccacttagaccgcttatgaaaagtatagattctgcaacaaagctaaaacagattttaatcataaaaatacaggaaggactaatggccacacattattcttttttttttttttcttctggaacatttttttaaaaaaattattattatactttaagttttagggtacatgtgcacaatgtgcaggttagttacatatgtatacatgtgccatgctggtgcgctgcacccactaactcgtcatctagcattaggtatatctcccaatgctatccctcccccctccccccaccctacaacagtccccagagtgtgatgttccccttcctgtgtccatgtgttctcattgttcagttcccacctatgagtgagaatatgtggtgtttggttttttgttcttgcgatagtttactgagaatgatgatttccaatgtcatccatgtccctgcaaaggacatgaactcatcattttttatggctgcatagtattccatggtgtatatgtgccacattttcttaatccaatctatcattgttggacatttgggttggttccaagtctttgctattgtgaataatgccacaataaacatacgtgtgcatgtgtctttatagcagcatgatttacagtcctttgagtatatacccagaaatgggatggctgggtcaaatggtatttctagttctagatccctgaggaattgccacactgacttccacaatggttgaactagtttacagtcccaccaacagtgtaaaagtgttcctatttctccacatcgtctccagcacctgttatttcctgactttttaatgattgccattctaactgatgtgagatggtatgtcattgtggttttgatttgcatttctctgatggccagtgatggtgagcattttttcatgttttttttggctgcataaatgtcttcttttgagaagtgtctgttcatgtcctttgcccactttttgatggggttgtttgttttcttgtaaatttgtttgagttcattgtagattctggatattagccctttgtcagatgagtaggttgcgaaaattttctcccattttgtgggttgcctgttcactaggatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatgactagccagttttcccagcaccatttattaaatagggaatcctttccccattgcttgtttttctcaggtttgtcaaagatcagatagttgtagatatatggcgttatttctgagggctctgttctgttgcattgatctatatctctattttggtaccagtagcatgctgttatggttactgtagccttgtagtatagtttgaagtcaggtagtgtgatgcctccagctttgttcttttggcttaggattgacttggcgatgcgggctcttttatggttccatatgaactttaaagtagttttttccaattctgtgaagaaaggcattggtagcttgatggggatggcattgaatctgtaaattaccttgggcaatatggccattttcacgatattgattcttcctacccatggatcttccatttgtttgtatcctcttttatttccttgagcagtgatttgtagttctccttgaagaggtccttcacatcccttgtaagttggattcctaggtattttattctctttgaagcaattgtgaatgggagttcactcgtgatttggctctctgtttgtctgttattggtgtataagaatgcttgtgatttttgtacattgattttgtatcctgagactttgctgaagttgcttagcagcttaaggagattttgggctgagacaatggggttttctagatatacaatcatgtcgtctgcaaacagggacaatttgacttcctcttttcctaattgaataccctttatttccttcttctgcctaattgccctggccagaacttccaacactatgttgaataggtgtggtgagagagggcatccctgtcttgtgccggttttcacagggaatgcttccagtttttgcccattcagtatggtattggctgtgggtttgtcatagatagctcttattattttcaaatacgtcccatcaatacctaatttattgagagtttttagcatgaagggttgttgaattttgtcaaaagccttttctgcatctattgagataatcatgtggtttttgtctttggttctgtttatatgctggcttacatttattgatttgtgtatattggaccagccttgcatcccagggatgaagcccacttgatcatggtggataagctttttgatgtgctgctggatttggtttgccagtattttattgaggatttttgcatcaatgttcttcaaggatattggtctaaaattctcttttttggttgtgtctctgctaggctttggtatcaggataatgctggtctcataaaatgagttagggaggattccctctttttctattgattggaatagtttcagaaggaatggtaccagttcctccttgtacctctggtagaattcggctgtgaatccatctggtcctgaactctttttggttggtaagctattgattattgccacaatttcagatcctgttattggtctattcagagattcaacttcttcctggtttagtgttgggagagtgtatgtgttgaggaatttatccatttcttctagattttctagtttatttgcgtagagttgtttgtagtattctctgatggtagtttgtatttctgtgggatcggtggtgacatcccctttatcatttttgattgcgtctatttgattcttctctctttttttctttattagtcttgctagcggtctatcaattttgttgatcctttcaaaaaaccacctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgcgttgaatgcgtcccagagattctggtatgttgtgtctttgttctcgttggtttcaaagaacatctttatttctgccttcattttgttatgtacccagtagtcattcaggagcaggttgttcagtttccatgtagttgagcggttttgagtgagattcttaatcctgaattctagtttcattgcactgtggtctgagagatagtttgttataatttctcttcctttacatttgctgaggagagccttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttccgtctcgttgatctgtctaatgtggacagtggggtgttaaagtctcccattattaatgtgtgggagtctaagtctctttgtaggtcactcaggacttgctttatgaatctgggtgctcctgtattgggtgcatatatatttaggatagttagctcttctttttgaattgatccctttaccattatgtaatggccttctttgtctcttttgatctttgttggtttaaagtctgttttatcagagactaggattgcaacccctgccttttttttgttttccatttgcttcatagatcttcctccatccttttattttgagcctatgtgtgtctctgcacgtgagatgggtttcctgaatacagcacactgatgggtcttgactctttatccaatttgccagtctgtgtcttttaattggagcatttattccatttacatttaaagttaatattgttatctgtgaatttgatcctgtcattatgatgttagctggtgattttgctagttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctgtgaagtattttatttctccttcacttatgaagcttagtttggctggatatgaaattctggattgaaaattcttttctttaagaatgttgaatattggccccaactctcttctggcttgtagagtttctgccaagagatccactgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaatgttggcctgccttgctagattgggtaagttctcctggataatatcctgcagagtgttttccaacttggttccattctccccgtcactttcaggtacaccagtcagacatagatttggtcttttcacatagtcccatatttcttggaggctttgttcgtttctttttattcttttttctctaaacttcccttcttgcttcatttcattcatttcatcttccatcgctgataccctttcttccagttgatcgcatcggctcctgaggcttctgcattcttcacgtagttcttgagccttgattttcagctctatcagctcctttaagcacttctctgtattggttattctagttatacgttcttctaaatttttttcaaagttttcaacttctttgcctttggtttgaatgtcctcccgtagctcggagtaatttggtcgtctgaagccttcttctctcagctcgtcaaagtcattctccgtccagctttgttccgtggctggtgaggaactgtgttcctttggaggaggagaggcgctctgctttttagagtttccagtttttctgctctgtttcttccccatctttgtggttttgtctacttttggtctttgatgatggtgatgtgcagatgggtttttggtgtggatgtcctttctgtttgttagttttccttctacagacaggaccctcagctgcaggtctgttggagtacccggccgtgtgaggtgtcagtctgcccctgctgggggtgcctcccagttaggctgcttaggggtcaggggtcaggggcccacttgaggagacagtctgcctgttctcagatctccagctgcgtcctgggagaaccactgctctcttcaaggctgtcagacagggacatttaagtctgcagaggttactgctgtctttttgtttgtctatgccctgcccccagaggtggagcctacagaggcaggcaggccttcttgagctgtgatgcttcccagttggagcttcccggctgctttgtttacctaagcaagcctgggcaatggcgggcgcccctccccccagccttcactgccgccttgcagtttgatctcagactgctgtgctagcaagagactccgtgggcgtaggaccctccgagccatgtgcgggatataatctcctggtgcgccatttttttaagcccgtcggaaaagcgcagtattcgggtgggagtgacccaattttccaggtgccgtctgtcacccctttctttgactaggaaagggaactccctgaccccttgctcttctggagtgaggcaatgcctcgccctgctttggctggcgcacggtgcgcgcacccactgacctgcgcccactgtctggcactccctagtgagatgaacctggtacctcagatggaaatgcagaaatcacccatcttctgcgtcgctcacgctgggagctgtacatcagagctgttcctattcggccatcttggctcgtgcctccacattattctttagctagtcttatatgtaactaagaatcactatgtcaaagaattttaagtatgtaggatgaagtatgctattttttattttctagaatgaaagcatacagagaccttttaaagaagcaagggcaccttatttatttcattgttaagcttagtattgaaagaataatttcctttacttcaggaagaaagtgacatattctcagacatcatttttcaattaagtatgtgtcttcactgcttgccaggatggctgttatctttcaaaatgtaaaagactgagaaaatacatgtttattttcaggtattatatcttgatcaatcctctttaagaggaagtatattttaggtagtaggtggataatggagaatttccttgtgtcacacctaagaagcaatatttttgttctttaatagttagttagtttaatattttgtgccaccttcttttcatgtcttgaaatgtgatgtatttaaacgcttctcgttaccttgagcttaaagtcttgcagcttattctgagtgtctgctatttgcaagtgtaatcttttgctgaaaaataagtttattattacagaaaagaaattgttcccatattttctgattaatgatctcaaattatatgcataaaagtcttaaaggccaggtgtggtggctcacgcctgtaatcccagcactttgggaggctgaggtgggcagatcacttgagctcaggagttcgagaccagcctgggcaacatggcaagaccccatctctacaaaaattataaaaattagcctggcttgttggtgggtgcctgtagtcccagctatttaggaggctgaggtgggagaattgcttgagcccgggtggtggaggttgcagtgagccaagattgtaccactgcactccagcctgggtgaaagagccagaccccttctcaaaaaaaacaaaaaacaaaaaacaaacaaaacgcaaaaccaaaaaagcaggccttaaagcactgcgtagcactgttttgaaaaagttgaatttatttcattttattgactgctttggattttatttctttcctctttccccatatgtgctactaaatgagtcatgatacagcacttgtgccctttgaaatctctgttatttacctcatgagctaaaacctcttgaatttactagttttcttattacttatgagggtgtgttttttgtgtgcttatagaacttttctaagtgttcttatagcagtgaagcctacaaagtaagagtttccagattccatccgttcttttagctgacttgaatgactctaatgcagtgggttgcaggtttggctacttacctatgtactctgtaaacatccagaggcccagggatattctgagccactgtgtgtgaatggagtttggccatctgtagatttccgcagtctctccaggtgatcgcactgtgcagcctcattgctcataaacaaaactttaatatgcttttaatgatctttcaagtgtgttgaggatttctttcttgattttgaggaatatatgtcagtatatttttcaactttaagtgttcgtatatatattagtaaaaacattgaaactgaagtctgggggaagtttgtggaactagaatattagaatcaaaagtttggatttaaaatctaatgtgactatcgagtggcatgctggaaatttttaatttatttggccatcttttagtatgccattcttaatctcatctgtcaaagaaacaaaaattatgtttttctagtagctgtttccggttttcaaacttatgcatgctttcttgcctctttagtcaatgttttcttcatgtttctggtttaaacatgcaaaaatgtgtaataattacagaggtcctgctgtactagccaccaaagcagctgctggtactaagaaatatgatcttagtaaatggaaatatgcagaactacgtgataccatcaatacttcttgtggtaagtgtttggagaagatcaaaaatagaaaatgttcatagtgataggtgataaatacctagattagggtgaggtgtgtgtgtgtatgtgtgtgtgtgtgtgtgtgtgtgtgtatgtgtgtatgtacatataatacctatattatctgaatcttttggtccatgaatgcacagtaacaaatggcaatgcagtgctttctttttaaggctatttttcttcccacagaacaattagagtaaaatactatatccagaggatcccacatagttatgttcttatttaaatcacagtgtttgagttcagaaaactatgagtaggaacgatgaattcagaaaactatgactagaaacaaaagtatcataattgtacataatttctcactacactttcctccattgagtatatctgcataattataaaaaatgtcttgcttgtaaatctagtttgtattttatcacagtgactttttattctattgtcaagacttgttgccttcgacaaattgcttaatgtttctgatgcaattccttcatataaaagacctgtttagttcagagttcttctgtggagcagatgatataagatagtaacactgtgtaaagaaatgatctgtgaatttgaacaataatattataaaatgcttatccttatgaataattagcttacttttgattttgtaccattaatttaaaaataaaaaaatctccttatgcgacagaataattatatcattatgttagacgaataaattaacatgtcaattttttttttttgctcaatgtaatcaatagatattgagctcctggcagcttgcagagaagaatttcataggagactaaaagtgtatcatgcttggaaatctaagaacaagaagagaaatactgaaacagagcaacgtgctccaaagtctgttactgattatggtaaagagaaatctgtacttttgaacgttttaaaatatatgtatataaatgcatgtatctgtacttaagacatgggtaaaatgtcccatataaattttctcctattttagaactgtgagccattgaacctaatacagccttgatggcctatcttttatagcgttatttttatgagtatgtctttaaactcatacttgttaagatatattgaatttactataattgagacaagaattttcttgtctgaagagggtgtgcatgcataattttcacacacacaaacacgtgcacacactcacaagattaaatgtgaaaatgtcaggattgccatgcatcttttaccttacatgtgaaatgaattttacatatgaaaatgagttgctaaaaaggatgatggttagtttttatttttaaattttctataatttttattttttaaataaatagagatgaggtcttgccattttatccaggctggtctcaaactgctgggctcaagcaatcctcctgccttggccttccaaagtgctaggattataggcatgagctactgctcccacccctttttctaatttttaaaatttaatgtagctcagtttttagaaatagttccctgaaatacccaatattgttatcttttttatttgtaggtataagtacttttctgttgctcccagaatagggttatagcctggaaaaagaaaggaattgattcatgcattgtccatttacactctaattcctttgtttcaaaaataattttactgcaaacattattttacaatactgcaaatatataaaagtgagaaatattaccttgcttcagactagtgttttgcctagatcaagatttgattttttgattgggatcctgaacatggattttgttactttgttatgcaaaaggccaaggtgtatacttgaaattggaaagtagagtagaagagatgtaacctagtacaagcatgcatgagctttaacattaactgagaatacgtgtgatatgcgagttgtaatttcaatctttaaagcaataattggacttactgtgttcaaattggcacaatttattcgcttaattctggttaacatcaaggtgacagcagattcaatattttgtgtgtttttttcccctaagcggtatattcccaacagttgatagtatagtttagcaatgcaggacccaaattgacttaaaaaatgagttcttggttatattttgctttcctcactaccttccaagtaaataaaagcagtgtttaaataaagtcaatttaatagtggaattctagtgtttctaagttgttgcaaagaatagattgagtgagggcaatattattattaataggggtaatattagtgccagttattgctccaggggtgtcagtcagaatacaggactatgcaagggcagtgggagatcacttgtaaccaagaagtggcaggtggaagccccactaaatattgtgacactgctctcttctccagtttcatatttttcctcttctaattgaacacaacaaaatgattacattagctgttcactgtctgtgtagtgagttctgaccacagattacctttgttttgcaaaaaatgacagtgagctgttctttttagctgtaaatattataattactaactttagcttgacagactttcattatattgtatttcaaaattaatacatctgagtgatcacacttcttaaaaagaggttcatgttgtaatatttggcacacacattttaaattaatgtacacatatttattgtatttgtgactcaaactttgataccttattcatctagctttacccaaaaaagttgcaaataatacgtggctcaccttgctggttcaactactgtttctgtttgtaatatattatttaagaaaacaaaagagtagattaggaaagcttcctaagggttctatcaaggtttatggacaaatttaggaatttatgtgaacacaaccccacacatacatattaagccttcagagaacttgattatgagtcattttcaggatatattttatcaaatgtaacttctgctctgaaaagtacttttttttgcttttctctttctctttatgttcttcctcatacaaaattcatcttgacacaggagcatagctaaaagcaaaggttaaagagcaccaagaagctcaattgagaaaattctatacttaaatgatttcctaatgtggcagctaaacaccctttaaaaggaagtgctgtgtagtctaatatttagaaggaacaattcattaatttgagaaaataaaatgatgacaacttatgattaacaaaaatgtagcttcgtattgttgacttaaagagtaataggttgacagctaatggtaaactcttaaaataatgcataaggagcctcagaccctcttcctggtacagtcctggatgagcatactttcatctcatttactgcagagggagattttttagaaataattttttggtcagtggcaaatcacctagtaaatatttatagtaattaattgtttaaaacaatgattttggaaagtagttttattttatagtttataaaataaaaatggcatgagtttaagatttagagagtttaaaaaaagcaaaacatactgttaccaaaacgtagtaacgtttttactcctgtaatgtatataattttttgatgaattctcattattttctatgaaaattctagtaatgtatgaaaggtactataatgtctattaagtcattgtattaggtttttgtttggatatgtgttccaaaaatcacaaatgaagtatgattttttaattttggtcctctttatatgtgcttcaatcagaatttcctaagcctaatgagtcaaaatagccttttaaaaaaatcagaaagcagcacctgcttttaggtaattctgagaatatttggcttgtggataggatatttacttttcagtcaccacctcgattggaaggctttataaattagaaaaatgctcatttaacagttttggcatttttatcttttcttcaacataaaatatttgttcacagattttgcaccatttttgaacaattcacgtaagtcaatgggtggtaactcatgagctaactggaagatgggttaaaatactttacaaagtactaacttctattaaaagttgttttgctacaattttcagtggaattgtagtgtgttaaagttgttatatccatactaagatatattttaatttgagatgatgctttatttggatcactccaatatgtatatgtattacaaaaaatctagtgaaattaatgttttatcaaattacttgcattaagaaaatgactagcattttaaactgagagtatgtacaattcttattgtagcaaaactcttaacatagcagctgaccttttagaataaagactaacttttaggtgctggtttttggttactgtattttcaaacactgatggtgtctgcatttctgccaaaggtattttagttttatagataatgtgatagtgtataaaggtttaataatgatacctccttaaataggaagaggagattattctgttacgtttatagcctcttatgatacacattctttgataatttaaaagctttgagtcaccttagtgcacagtaaatctcttgtagaattagttgattagtaatgatttggatataatgtcacattcatttgccaactggttggacctgatgttttgaagtgcttcttataatttataaggctgtatttgaagattacacaattgaatgtgaaggaaagttatttagaatattagtttcaagcttttaatgtctgtgtctttgtgtttttccagataagtattcgtttctagtcttccccaacaaaatttcagttctcctgttagtaagaaaagctatcaaagactttctatttagtttctgaattttatccagtatcttaacttacaggagacttacttcaaattaaaaagtaggttaattaatgaatgactatcagtatcatggtaaatttcctgtaaactggacattaaattctaattcactactttagatggagggaaggtttttaaattcttagttttgaattagtacattttcaacaatgtagggagttttgaaaacttaaaagtagaaacactgaactgtaagtagctctgggaaaacaggagcaaaagaatagataagcagatgtctgttaatatgtgatgcagcttttaaagttactaacaaaaccgggcctctcgttccttcatagggatatatagctttgctaactgctttttgctttctctggtttgcaaagaaataaattcaactgctataaagcttttgctatttcttggtgtaaaaagtagagtaagagtattttcatcctttcagtatttgcaaattcttacagaagccatgtggctcttcttggctttatatcatatgtacattttacaatatttctttgacacacttggattttcatagtgagactcttaactgagctgctgtaaatggttgttccacttttgaagttctgtgagtataaaacagattaaacaggctaaccaaaattatgctgctaaagatgtaaagtcattgccccagggaaatgtttacatttgcagataaaagaaaaacctaattgttaagtaatgaaaattgagctaggaatgaaagattgatatgaatgaaatgcccagtactagtagaaaagcaaggatttttcttttcttttggcaaggagaatcaaatgttacatactttgcacttcattggattttattctaagagaaatctgatttcagagtaagtaaatatctttaagggaaagtttatgcttactgttataaggttttttttgtcatatggttgtctaaatgttgttaatatctatgtcattgtggtcattttaaatcctaaaatttgttggcaaaagaaaaaatttttatatggcttctactttttgtggaaatagtgattaaactgacaaatgtctacatccttcagatttttgaaattactgtttattttgttctatcataaatagttgaataaaagttactgtacaaatttgaactctttacaggaagaatataaatctagtaaataatagtagtttgttttcctgccgtgtgagtttattttaggttactgttacagtgatttgtgggaatctgacaggggtttgttgctggtagtggtggtggtagtggtatgtgtgtgtttgtgttggcaatgctaagaaacatcttaagggaaagacaattctaagaagtaacactctgaattttattaatttgtaggcaataaatattttcattttgttttaaatttactattagggacctttcttctttttaaaaaattattggggtatattttaggattaaaggctcttttcttttcccttgagctgctggtataactttccttgttctgtgtaatagctcagcaaaacccagcagctcagattcctgccaggcagcgggagattgaaatgaaccgacagcaacgcttcttccgcatcccattcatccgccctgccgaccagtacaaagaccctcagagtaagaaaaaaggctggtggtatgcccattttgatggaccatggattgcccggcaaatggaactccatcctgacaagccacccatcctacttgtggctggtgtgtatgattcacatggaaaacaaattatagaacaaaaaagatcataaactctctgaatgaaacattctaatgtataatataataatttattacatttcagggttgagggatggagtcttgcggttaaatcacatttccagttcagtgaggattaactcatttataatgtgaaattgcttggattaaattatgttcttagcacatagaaacttgtctgtatcctaaaaacctttccatttgtgtttcatcatatccattgatttgtagtggcttgaggaaatgtagcatttttattaactctggtaacttgtttgatcaatagcagtgtttattaatattgaaagggtccttgatgggggacaaattttaattgtttctggtgattttattaagcagatttccatcttagagaaaaagtcttaggaagttttcaaatctatgagaattaataggtatttcaggcatacaactggtaagaaatggtcctgaagagagagatggtaattttctgatatctcatgaatacaggtaaggacgacatggagatgtgtgagctgaatcttgaggagactggcctgactcggaagcgtggtgctgagatcttgccaagacagtttgaagaaatctgggaacgctgtggaggcatccagtaccttcagaatgcgattgagagcagacaggctcggcccacctatgcaacagccatgctgcagagtctgttaaagtagatgttgcacaccagccttacagctgggagcctttgccatggtacttaggtagggtgtgtgcccccagatttaaccattccataatcatgttagagttacttctataaagtgaacagattttattaatcacggcttttggtgaatttgtttaaggttaattatggtagcaaattttggacctaaacattatttttctgtatcccgctgtaattcccaaaactctcattattctctaactattacacatgggcatattctgatgtttctcatcctttgccagaagactaccttacatccatcgtaattgttctctaggaaaagagaacttttttcaaaattcaaaatactttttaaggatggcacagtaccatataactggagtaataaaacatgagcttacattcttacaataactaaaccacttaaaatgatcaaggcactaatgttttggtctgaaaagctgtgtactttatagacattttcagacatttttggaaatttccattaaaggtggaaaatctatttttttcctcctttgcagtgtcttagtttgaatgaaacacttcgaagttctagaattctagaaagagccttaatgtatttgatgtattctgtgataagaggtactaatagtatccagcacagatttgcttttctttgctagcacaatgtgtgttgctgtcagaatattctttttatattctgtggaaaaataaaggaaattcagattgtttaaatgcctaaaagttttgagataagttttgtttcaattagaaaaggaaataggttttaggtggcatagtggcttaactggactgaattcaaatattctttcaacttcatctcaatagtgatttttgtatcagaatcttgtccaagttgtttcattgatttagtaagtgttctgcttccaacatctttctttttaagaaattcctagtgtcttttttggcctttgaggttttggtaattgtagacctgtttcataagctttgtaattcagaaatccttgtatttagtaagtgcttgttttacataactgataattttaaaatgttttctttgtgtgctgttagtattgattcaaatgtcagcagctttaagcctaatatttatgactttcacatttggaatttaaagacaaaaatacatcaaggagttatgctgacataattctaaggagttttgttgtattttagaataaaattataaagtaaaatgattctctgtactgctttttcccccagtttttagagaccctaacctttgaaatgaaattccagtgatttcttttttccctagaaagattacctcagttagggaagtatttcccagctgactagtgtttgtgagccacagacactgtcttcagaattgcttctctcatgtcttagtagagaaatatttatttattatgatacattcaaatgattgtcaagttaaattaaatggttgtgtctgtgctattgagaatgcaaatgtgattatcttttgaaggctgtattactgcatagcttcacccaccctcgggtcatttcgtccctgtgattggggacagaaggtgtagctactgaagtaaatgacctattctctctcttccatctctcgcctttaactggtgtttttatttgtgtaggatagtgaatgataagcttttttcctaaccagtagtgagtaaagttcttgaacaaaatttagtagccaaattgttttttaatgacatgtctctttagtacaatagttttgtgtatcttttagatacattaataggcactagatggaaaattaaagagttaaacatatttaaatgagagaatctaatgtttcagaaatttgtaagaaatgtatcacagcaaagggttgttataagtccttagtttttgactctaatagttaatacaattatagttaatcttaagccataatgtttctaatcatgtcacacagctgtcctagaacttatctatttaaaatagtttcctgagttaattttggccagcagggcaactgccctaattcagatagatttacagtaacctacgtacagtagatgcacatacacacagacacccctttgctggagaaacttaggaccctgtcagccttttaaaggaaacagcaggagtggtgtcctaaatgatgttcatgcagctgctttaccatgttcacagtcaagcccatgcatgccaggttaaaactgtggaaatcaaaagtaaattcactcatattttaatcattttaactgagatttaaaattagaagtttaaaccactatatataaagaactaatcttttcttaataccagttctttccatagcatatgctttgcaaaggcagcatgcataaaatatttaaaatgagaggacagaatgttttcacatttgattcaattttaatataattcctaattgtggtaacacagttgagatatgtattatgagttatgggaactaattgagaaaaggaagttactctaatccacgtatgttaagagaatattgagttttcttagttgtaaagttggggagatggcaccttctcagaggattgtgaaaatatgaggaagaaacaaaacagtgcatgtaggagcacagggccacacaaaggcattctattgttatgctcattctgcttctgtaatgacttttcataggtcattcttgtgaaccattttgttttgcaagcaaccaaggaaagaacatcttaagtggaaaatcagtggtggttgtgaacacttagagaatagcaatccacaggcaagaataatggtattgtttgtagagctttattaattggatattttttaaaagacattttcattcacaggtcattactatggttctcagcgatccaaatatgtagatcattggttttttttttacctgaagtagcttaagagtacttggatcagtagaataaatatttattgaatcaatcagtcagccaattaatatgatgttagtgatagacctgcctccttttatggaagaggtaacagatccagagaggtcaagtaatttagttgtagactgaaaaatatatcaaagcctttgctgcaatcatatgtaacaaaaagaaccaaaacaaacactttttagtggcacctgtggatttacaaagggttgcctctctgtcattccacaacttcagaaggtgtgacaggttttccctatttatcattaccaataataacaagtattgagagttttaaaat

SEQ ID NO: 12448 - DNA, 102526 bp, Human
cctcagcctcccaagtagctggggttacaggcacccaccaccatgcctggctaatttttgcattttttagtagggacgggatttcaccatgttagccaggctggtctcaaactcctgaccttaggtgatccacccgcttcggcctcccaaaatgcttggattacaagcatgaccgcacctggcctggcatattcttttaaaatttgttttgcaagaagtgtcctactacagttttaatcatgttcaaatcagaacttgattgctagcaaaatatgttattaggattatttcattttccttttaacatttaagcactattccacacagagacatgatcgtacaactaatttgatcatattaacaagaggttggtttttaaaccaagcagtataaatataaatacagccttgggtagatcatagtcaaactatccaaatgcaacctcagcttcaaagattgtaaagtcttttctttccccttttctcctttcctttttttttcctccaaatatttatttactacctaccatgtgccaggcactgtgatgggctatgaggatgcagtgggggataggacagatgccatccctgccctgaggagacttgcagtttattggaaaagatggacatcgtaaaatatacaatcatacaaataaaaattacataaataattcagtacttcaacttgtgggaggtacagcagtttataataataacatccctcccaccttcttgagagagtcattggttgccccacttctcttcatgaatgagaggacatgattaaacctatcatttcaggtaggagtttactgtgggatggatatcaatcttctattaatatgtttgtgctcatgctctccattttgcaatggacacttccaatatgcaaggcaggctgtattaggtgttgggagagggctacaaagatgagagagacagtcctttcctggaggagtagagagcatgtatgcaatatgtgtatacacacagtctatttattaatatatatctacctatgtatgtgatgtttacaacaaggaatttcaggaattcaggggtggtggtgaaataacttctagttcgggtgatcagctgatgtttcctggaggtgaccgtttaactgatccataagaaataaattggactttgataagaaaatatggtggataaaggcaaatgaaatagaataaacaaagacaagaaggcaggaaaatttgaggcatatcgaaggactgacacaagaaagaaaaacagaaatgcatcatcaaaccaaaaaatggttatatggaaataaaaggaaatcaggtttgtaggagaaattaagcccagatcactgagatttttaagtacttgtttaaagatacattggactttctttgagggatcacatatggctactcccaatatttaaccagaaaaggccttgtagaaaaaattaatcagcactgtgaaggagggtgactacagggaggaaggcccgaactcagagcccagctaggtttgttgctataatctaggtgggagatggggaagacctgaatagtcagtgctcatctggtaaattagtgttttggctttgaagcaaatttacaacaatcccctgaactttcccagagataatctgtagaatggagaagccattaggctacccctctaaagtcacaaagtgattgcttgctgaccagcttaaaagccaagttttcctgatctgttgggaaagacacgatagcctctgaacactcataatacaaataccatttaaaatggaaaaatcataaggatggtagacagattatgcttcatatcactactaatatctctgaactgattttagctgatttatgaataaatgattactccagttttgagagttaaatatttaaaagttaactttcttttagagttcatgtataatacacggctagttctctgtgctgcagacttccgctcttcatttccttctttttaatacattataattattattcctactctatcctttttcagttccccgcatgaaaattacttaaacgttgcacacaacgtttcacaaaatcttttgtgaaagaagaaaaggaaattcagtgtgtgagtctcagcaggagttaagctaatgcagcttaaaataatgccgaaaaagaagcgcttatctgcgggcagagtgcccctgattctcttcctgtgccagatgattagtgcactggaagtacctcttgatcgtaagtattaacgttttaaagctgttaggcccaggagtcaaagcctcccagcatttatcatcactctgaactgcgtgaatggagaaggtgtctgtgtgatactgaaaagctaatcaaaattaatttggcttttaccttcagcacctggtgtttataaagattcacactgtagaagtggccattgaaatggtcagactcacaattccctccctgtcattctccttcttccccctcaggtgccttttgtctgccctgctggggatggcctgagaaggattgagttgtgcaagctgcctgatcttcccaacaggcggctctttagagaagcagtcctgcaagaaaactatatgagccactttaaaatgatcatggagacctccccactcatcccttcaccactttactctttcccgtcatatgctgagggtggtctgcaaagatgaggggaggctccttctgccaactccatgcccctcggaatccctaaaccaccccagaattcatttctcttgattcagacaaggcgcatctcactttccaattttgaatcctaaatataagtctagaactaggaaaagtatcttatctagagcctaacaaatagtcttatttggtttaaacagtgtggtcaaatgccaaaatgcaactgctaaaaatacaagtaatatgcaaagcactaaaatggagcaaacaacagctactgtattagccctccattttcctagtagtaaatatatactgtgctctccctgctctgggtggcctgtttgtgaaaaataaagataatgctaggttccacccagtcacttttcctgcaaatggaaagcaaaatttcaaatctggacaattactgtacttcagaatcgatttctcctttatccctcatctgcatgacctctttgaagccattagcttcctgaatagaatatctgtttggcaagctttccaaggtgcaaggaagatagcactttcctggggctattcaattgttgggatgtcatttttatttatttattattattattattatttattattaccatagaggttgcaactgccagtgggaagacattaagaagagatgtggtttgtcccacactttgttgactttttgctgtgcttctataaagttcaataaaatgcagtgcttttcttatttaaaaaaaattcatccagtgaccttaatttcaattttcaaaaaaatatacaattgcttaagcccattggagtgggaatgcctaagtaagcatttgccctgacagatacacaggagggaaagaaaacatttgagagaaatgcttttgttctctcttatattaaatatattcccccttaatctgactgttcaatctgtcaagcagagggaaacagtcacctatggctaactcaattatcactgctaacggagaagaggcataaccatgatgaaaagaaagtcacagaaaaacccaggtgctcctatattaacctttgcaagtagtaacgacagacagcactgtggaatgatttgaattgcatgctaatgtaatttcttccctgcccctatttcttacatcgtttctctactacatgaacaagtccttggtgtgggcaccagcaacccctgagtgattgagaaattatgaagcagaaatctgctaacagtctaaaaagttcaattaatgactttggagattaaccatagaaatataaaaatctaaaattagtgttggacttggcttgcatggagcattatcactgtagcaatgtcccattgttaggtattattaccatatgcacagtgatgtctgggataatatgaccagacactacacagtatgtgacaactcaaattaattgtagatttcagctgtttttcaaattgaacataattacttgtccaacacaacatatatggaatggaattcgctattcctattcctggaagaactcgtttgcctacagcattgcttttgttcttccatatgtttatgtgggaaagctgctgcaagattaaaggaaaccgttaatgcaaatttcttcgtcttgcaacttcacaaattcaaccttcactatacaggttttcttagatcaaatcaaatagacaagatgccccctttatcttcagagttctaacgttcttattattaacatctgattttctttaatcctctttgcccacttacctgctgatattgatggggaaaaagcaaaacttcttgaagactgtaagtgtccttctataaattactaggcagtgtgaaaatgtgaccatgtctttgctttttgaattaatattgtgatttaaatgcacaatttcatgttttgtgacctttgtctttctaagcatgtgtgtttactgtagctaaacattgtatttcaataccaagaagcagttgtaaagtattatctgcatgaattctgaaaacttggctattactctttcttttaccagtgtgctgctctactaacttccaagctttattcacatctgatgtaactcaatgagaaaattctcaaaatttagagagaatgctgatctgttgtaaaggctaattaatgctttctggaacaaagataggtctttttgtgtcttttagaaggtgggtgcaggcaaaagctttacacaagatggcagctgtatgtccttttatgcttcttcagccttcgtgactatgtagactagtatttctaggtgccatcagtagactaacccagcgaatttgaatcttgtcttgaagtggacaaaagataagcagctcccactcacatggtatttgaatggcttgctctgagcaaaactttccactgcctttgacaggtggcatttatcacctagtttaaaaatagtcagttttcaggcatttgataatttcctttgatgttagattaaccaggaaaattatgtaaaatcactgtttttcttactactgaaaagcatttgttaattagcaggtgacccaagcactgtttaaggaggtatatccagacagtaaactcctggcagttaggagtgacatctgagccagctctgctgcagacctgtgaatagaagctctgcctctgaagccaccagatttgcacctgtgtcactcccagaaaagcacaaggaattgaactgagtcactcctaagaatcccctcccccactccctatggccactattccttggatgtggaattccaggcttccttccattatcccaaattctatatactcccagagcctgaaggatcattcagaggtgaatctggtccaaataaaaaatgattatgataataattttaaaatagctgatgttattgaaccattataacattggtatacactgagaattttatagtaattattttcttaatcctgctagctatcctaggtggtaatactacttttaaactttattttccctctcaggaaactaggacttatagaagttaagaaattggcttgaaatctcacagctagtaagaaacagactagtgcttaacaatcaggccaccttggaaactgacaaggctagaaaaatgaggattccatatggatgacggaggggggaagggcagctggaaagacaaggagggggatgggatattccaaagggaagggaaactgacactgcccagtaccctgcatataatagtacacaataaatgatgacagtaatgaggctagcttttgatttgtactttagctgttatttgaatatttagtaaaagatgtcttgtggatggcaataagactagaagacaagagaagaggacgcaaccgggtttatagatttataagactgaagatgtggaggtgatacatttagctctagcaacaattaaccacaagagagacaagaacagtgggcagttactgagctttgagaaatgtttggttggcaagtggaagaagtttcacaaaggaagcagaggtatgggcagagaggaaagggaagatccagaagatgaaaaacttaaatgagccagaatgtcaaatgcagcaggaaaggaaagaacagtgagaatccaagagagggccttgggggaatttcccagatgcagaggaaaggtgctgtggtatggccactgcattgcacagctccaggggtgccaagcacattgtcgtctgcctcagaacttttcagcctcagcactatggatgtttgagaccagataagtctttgttgtgtggaattgtcctgtacgttgttagatgtttagcaacatccctggcctctatctacgagataccactatcactaccaccccagtcgagaccattgaaatggcctccagatatggccaaatgtccctggaagggtggaaacaaattgcctctggtagagaaccactggtctgtgtaaacagctctccatggagttgtgcaagcagtggcttcttaccaggagccagttgagagagtttaggtctctgctttgtgccttcctagtcaagccattttgctgcactgagtaagaaaaaacaggttgtaaaaaattattctttagtcacttcctgtcataacactaattctgatctcacaagaagaaggacatggtgattttagaacaatttgaagagcattagtggtccagatacagctttcttcagattagattgttctgggtcagaacagtttccccataggatttgataataaaagatcagataacactttgaagagtaaatgggaacactgtctcctaggacagagaacttcctcaattccatttatcttctaaataagactcttttatctttgttcctcattcacttacctcctggctctgataagagatgtcacatctccagtttaacagtctgtttaatattaacttctcaaatgtatttgtccccaacatatattgatttatatgagcacacactaatgacctaagtctgttactctttcttaagaaagatgcaaatttatcataacttaaattcctttgaaaaacatcatttgaaccaaaggaatcaaaagaatttctcattgttacatcagaaaagaaactgtcttaatattaggtttgtattgataattatttccccaaacttttagtgtgagaaaatggactttgcaagtacacatagttaccgaaagaaagttaaaccttgacttcacagttttagcagacctttagcagaaaaatctactgaagtatatgctgctacactagaaattactaaaaatacttgaagcatatttagtctaaggtaagtgattttgatacaggaaaaaatggctactattatgattttaaatgatttgtttttttacatttttttttttctacaattaagtggtacagcctccaaccatcacccaacagtctccaaaagattacattattgaccctcgggagaatattgtaatccagtgtgaagccaaagggaaaccgcccccaaggtgagtgtgcattctgctttgttatagtactgagaataaatcaggaaatctctctgaatagagaaatatgtttgggaatttccatcaaacaaggcagactatgtagagcacttccttttttagttggatatttctcactgtgactcactagattgccctttggttcatctatcccagcccatttcagcccttcaaagatactgaaggtaacttcttgggtcctgcatatccctaaagtctcacctgtaggtgtattgttttgtctctctgcttaattagagcccattttttcttcttgaaaacccagattattgcatttctgtgcccatgcttttctgcaaaatgcttataaattgtgaggagttatggaaagagccttttgattctgattttgatactaatggccataaggcacaggcaaatcccttttctctgggctttaatttcctcatctataaagagattgaatttgatgacttccaagatctctgctgtctctgtaacagtttataaaatagtctaaaatggttttccaaacttggcagagttcagtcatgagaattcatgccatttggatcttgcatagcattttagatcactgcaaagcattttagagttgggagagatattagagataacccagtccaaccaatacattttatagatgggaaactgatgcctggtaatgctaagtaacttattcaaggccccacagcggatgatctgtaacatgtccagtcatatatggaagttttggagagttgggttattgttattaaaatgtaatgtggatttttaagcaataaagtagtgaaagtttccagttattttatttccaggtttgtctattacagaccttattaaattatcacaaactggcccctgagaaaaaattaactgggacagaatatgtactatgtcaaaacttccagcaaaggtttgcctcaaaataatatattcggctatgttaatggaaagcctctctcgcagaaggcctgatgtggtatcccttgatgaggtttcctttcagtttcacaattaatgccttctgtaacttgccataaaacaggatttatcctcttcagcattattgatatatggagtgtgatagataatattttgtttgggggatggaagtgtcctgtgcattgtaggatatttggcagcatccgtggcccctgcccacaatatgccagtagcatccacaccaccagttcctgccctggttgtgacaacaactgctataaagataagcagtgggaagggaaatccaagtgatcctagaaaacactgtgacgtttagagattcgtacctttgtatgagcatggccatcattgatttgtgactagttgtaaagtatttaattacatgagcactgtgacttttatataagtcaatcttttataaaaataaaatggagaaagagggatctcagttgacaattgggcatacctcccaagggattctcaaaatcatctctagaattaaaaattcccaaaatgttttatgtagagttactatttttaataagcaacatttaagacactctggaactgatgtctcttaacctcctcccaacctacacttcacaatttggtaacttgaaatttgtctgatcaattttcatcatatataaatagtacttgcagaggtcttgtcacattttagccccaagcaaatttttatagacaggttatcaactctgtgaacaatggagtttacagtaaaaatgctaataaagctctaagagagtgtacctgggagacctgctccctctattttcttagaaaaatgacaggcaatttgtgtgcatgatttctttattgagtcaaatttgggctagttctaaagaagacaggtaccttaaaatgtatagcctgcccttttttcccaggtcatgattcaatgaaacattttagatatgagggcttattgctctcttactgaatattaaaatctggtaattatttctagaaacccataaaactgctaggaatttgttaaggtaatcccatttttctggaccattaatacacttaacacttcgtgtgttgggcagcttttcctggacccgtaatgggactcattttgacatcgataaagaccctctggtcaccatgaagcctggcacaggaacgctcataattaacatcatgagcgaagggaaagctgagacctatgaaggagtctatcagtgtacagcaaggaacgaacgcggagctgcagtttctaataacattgttgtccgcccatccagtaagtggaaacttgtcaaccaacatgaccctttttaaagtattgctccaagactcagcttctgtgacatcatccaaatactattcaacaaagcagtggcattgcttccaatattctgactttgttttgcatgaaagttattgctcctttccaccttaccctaggaagctccttagtccaatgctttaccaatccaatatatcttttacagaagtcctgtgtaagacattggggttaaaaaaaaaaagtgtttcttccctgagttcatctaattatttatttctcatgtatctcctgtgaaagtgaaattcctacagccaaatggaaataaattcagtatgatatgggtgatcaaggtctaaatgctatttctttaaacatttttgtttcaaaattttactggaagtggagtgtcctcactaccttgatattattaaggctctttttgcaatggttagtaccaaaatcctctcaaaaaccttaagagcatgtatttaaataacagtcacatttttcagttctggtcatttaaaaaaaattacatgtataatacatgttcgttgtagaaaaactaattaaacaaaaaagaaatttaaaaactgttcatgaatccttccattcaaggaaataactactgctgaaatattctttctattttttcctaggcagatatgtatgtatgtgtttaaaaccagctcattttctgaaatactatcttacaaccttttctgacttattgacatatcgtgtatattcccatagcgatcttataaataagtgtacttatataatactctatggtattcagaggtgtagatgtgtaattctttatttagcaaatctttttacatttaaatgttttccattcttttgtgaagaacatgcttgtgtcaaaactgtttgtcttcctgatgatgtatgtagtataaattctcagctgtggaatcactgactgagaatttatactatcagtggcaatgcatgagaattgtcattttttaaatttttacttttttcttttaacattgtatttaaaaatattttctcattaatttagtgtacataaattacaaattatttctccaaaacttcagtttgcctttatttgtagggctttctttttgtacttttcaatgcagaaataactgagaagttatttttttatttaataggatcaccattgtggaccaaagaaaaacttgaaccaatcacacttcaaagtggtcagtctttagtacttccctgcagacccccaattggattaccaccacctataatattttggatggataattgtaagttttgataatatgaactttctttctttaaaagtcttaggattgtttacagtcataatacattattacctcttatgattcataaaatgttttagagatgctcaggaaaacagctgctcttcaaaataaataacatgtcatctcattcactcactcaattttattggacatttactatgtatcttgcttatattctttgcagtgggaggagataggagtggggaaggaggcagatgataaatgcaataagtacatttagaaaatctgtgtttgttggcaataagttctatgaaaaaaaaaaaagcagagttttgagcagagacctaaggaaatgagagagcaagccatgcccctaaatatctgagtagaaagggaaaactagtgctagcccctaaggaaggagcatctctgctgtgtgtaaaaataaaagcaaggaggacaaggtggccagactaatgaactaatgaaggagccgagcgggagggtgatggagaaggtgagaaaggtcacaggactcaatggaaaggactttggctttagcttggaatgaagtagggaaatgttgaaggagtgactttatctgaaataaaataagtagtaacagtatcacttcagttgatatgtagagaatatagcgggcaaaagagagagtagagagactgttggggccactgctgtaatctagatgaaatttgttggtgacttggacttgagtggtagcagtagaatgggtaagaaatggtaagattctggatatattttgagggtcaagcctccaggatttactggggtgggggtgggagcatgagagagaggaatcaaggataactacctttggagactgaacaactccaaaatgataaaatggaattgccattcccagaaacccatggcggggaggaagtcaagctgttggggatatgttatgtttctgttagtttttttaatccccagcaatagctaatagttattgggcctttaccaagtgtcaggccttttactaagggcttaacatgggttatttcattaatttttacaacaaccctatgaggcatgtccaattattttttccactttccagatgaggaaactgaggcagatataatgaagctattcattaggcaatttcaaacttgtctacccctgtttctgtcctcaagggcatgtttgttgctctgcctcttccaccttccaaaatttcctgtgccaataggtcagcgtgttaccttagagggagtacatggttctgcttggagactaagaaaccagagtttgggatgtgagaggcctgtaagatatttcatggcaagacaccagcaagagtcagagatacctgagtcagaaggaggattccaggctatgatcagcaatgtttgaaaccttagtgcgtaagtcctgcctagaggcctgggctagatgagaggatctgggaagcaggaaagcagagtctgggagactgagaccaggagccctccagaggtgaagaactcatggagaaatcagcaaagcagatgagaagaagcagtcactgaaggaaaaaaggaacaaagagagtggtgtccccagggacaaggtgaagaatgtgtgtcaaaaagatggattaaccaggcagggtggctgacactgtaatcccagctaatcgagaggctgggatgggaggattgcttcagctcaggagttcaaggctgcagtgagctacaatcacatcactgtagttcagcctcagcagcagagtgagacaccatccctaaaataatgataataattttagaaaatatttttgaaagacacaattattagctatttcaaatgctgctgagagatcagataatatgagaactaaaaaatgactactgaatttgacatcttggaggttcttggtaaccctgttaatagtcttttaggtggaatggtgggaatgaattaaaagtatctgtaggaaatacgttctattttcagtgacctgattgtctgtgcactcacaagacatatacattactaaagagaaaatttgcctctaacatttaatctgcattttaattttttaatttaatttttttttattttactttaagttctgggatgcattttggctctccttatatgaaagcactcagagaaagtaaagtaacacaaagaaataaaaaacaaatatatagctaagtaaatctagtcttttacagattttgcaaaaataagtagtaagccaaatgtaaataagtgacttatggctttaagaataatgctctccgaataccactgccaaaataaggctcaatatttggtacttggttcttattcagaaataatgacctttttgcttaataaagagacatatcacatgtaaagtctcagagtcatctgaatacataactaatttttccactcacatgcattctaggctgttggtgaagcatctgacctttcaaatggaattgcacctgcaatatgagaaaaaaatttatatagcatacttcttgcaagatgacattaagttattcctatctgcatacattttttttcaagtgcaatgcaaaatgccaccaccctcatgaagtcccatcgcctaacatttggtctgccaacacccttcaatttattattttattgctacagcaggagaaacagaggacaagaaatgtttttgtcttaaactctttgttaaacaaaatgtacctaattcttctgagggtttttttttttgttttagatggagtctcgctctgtcacccaggctggagtgcagtggcacaatctcagctcactgcagcctctgcctcccgggttcaggtgattctcctgcctcagcttcccgagtaactgagattacaggtgcaaaccaccacgcctggctaattttcgtatttttagtagagacagggttttgccatgttggccagactggtcttgaactcctcacctcaggtgatccacccaccttggcctcccaaagtgctgggattacagacatgagccaccaagcccggcttgggttattgtttaaacagtccttttcccgggaactaatggcttaaaaccataaatttgcaaccaccaaccaaacccccatcttaaccaataatttgattaacatgatgaaccgatgttctttctttgaagctctgcctccacattttcctgcctttttctgcctgagggagctccagacttttaaccataattttgcatttcatgaaatgttagatcaagcacctgctataggaggagcagacctgcttgacttacactgcaaaaaccctgtcaggagacatagtggcctgaggccactgggatgtgtgacttttttcagttctgtcacctcacagaactgaagaactctcacagttaaggctctgtggactaagtcaggagcttcaggatgtccattagctggctaagtgtgaactcacacacagatcaatcgttccacctccctgcatccttcatccacttagaaaatcttccctctaaataacttctgatactattgcacagtagggtgactgtgggtaacagtaatgcattgcatatttcaaatagctagaagagaggattttgaacgttttcacaacaaagaaatcgtaactgtctaaggtgatgggtatgctaattaccatgatttgatcattacacaatgtatatgtgtattgaaatatcacattgtaccccacaaatatgtacagtttattatgtgtccataaaagataaagaaaatcctcctacctaaggcaagatagttccttaactggacctaaggggaagtactaataaattattatgcttgacactggaaagtcagagtgctgatggttactcacttaatccttcagtgcacatttaaaggagccccgtgaagggccaggcactgttccagtggacaaaacagatgaaagtgttcaccgtcctggagcttaaattctagtgcaggaaataggcaataagtcatatgtatgatgagtagatatgtagtatgccagaaggtgataattaattcagaaaagaattgtagaggaggtggaggaactgggcttgggaggcttgtgaggggcaggttgcagcattaaataaatagtgtcatcatcacacccagttactgtcagctggccatttgctgcctgattcttcaactggatgatgagctcagacagggctgggactctggcatgcccagtgcctagcacaggacccagctcattgttagatggtctccacgtgtttagtttctgaatgttgtgtgtagatgcaacccatgttaacaattttagaagcttccttaatgattttctaagatatatgtgtatgtgtacttaacagttagggactcagatattaggaaaagtcacgccaactttttataaaacatattttgttcacttttgcttaaaaaaagatttcactgtataactctaatctcacctctgcccccaccccagagaagttactgtcagggaagtagagttagagttttagtgtgttacgtatttttttttttttttttacagttatttgcttttacccaaagagctatatagagaaaaaatatattcaaatgaagttcacagacctattagtaggtacatttatcttgctaatttggagggtagccactttatgatggaataatcttgatatctctctgcctttctccagcctttcaaagacttccacaaagtgagagagtttctcaaggtttgaatggggacctttatttttccaatgtcctcccagaggacacccgcgaagactatatctgttatgctagatttaatcatactcaaaccatacagcagaagcaacctatttctgtgaaggtgatttcaggtaagagttcagcttcccaaatctccccttcaatgacatttacaaatatgtgcaaaatatagaaactattatatactactgactttgaagtaaacaggttcattatcaggaagccacccatgaatgctcactaaagtgttggcatatatgttataaagattgtgcatacccttaatattggattttacattttttgcttttattgtcatgactggttccatgataaccttctgaaccacctggtgttctgagcatttatgtgtgctttatgctccacagtgcctcttattggcggtcctgcagcttaagttaaatgtctgcatattcctggtgggggtggctgagtaaattaatgagttagtcatgtacaatgtaaagcactgtttttacttgataggaacagcactcggtcaggatagctgcatatgtttgcttttattgcccaatactttttgacccttctcccccacttttatgccctcttcataatattctgtttatttcagtggatgaattgaatgacactatagctgctaatttgagtgacactgagttttatggtggtgagttatggtgattgtaactgatattctctccttcattgtagaatttagttcactaacttcacctccatgactatttaaccttatttctttatgagatttctagttatatgttaaataccactagtataaatgtatgtttcttatgaaatttacctataaactttgaagcatgccactagagcattttccatgatgtatgtgtaataatgaaacctgttgtaactgtttgcgtgtaaagaaccatttcactgatttggaaaaacctttcacgtacgttcagaattatgttttccatgttttgttctgttccaaacttttcttgtgaactaagtaagagttggcagggtgcattaacttgctagaatactgactcatcaaagcttttagcaactaacattaaggggatttcatagtaaatcatcacacttgtcatctgttttcatgtgacattatcaatataattagcaatgagatttctctcttagttttgtttaaaagtaagtcaaaccaagtcactgtcttcaatggaagtaatctttttaaaagtagagcatttaccttcattattttagatagaaatgaatttgattcccttaagggaaatgttctcaagtagagtctatgaatgaaaataatgggttttggataaagggtcctcttaattatccataaggtagaatttctgctgtattaatttttcacccttgagatataagtaaaagacattaaggtctcatcagtgaccaagatagacactccacaactgctgctttctgttattttatttgaatatactcctgaaaaatatgggccccaagaccattcccaaagtgattttagaggagtaagtttccccgctacaatctctaaattcttaggaaaactaatttttctcaagtaatatatcttctggcattgaattttttcttctgagaaatgagaataattcatagtatatgaccttttcattaaatttttataagcatcaagtagataatgcattaaagagttgaaaaccttcaagggctataaaaccttaagatgatgtaatttctgctccaagtttttctaagaaaccttcagaagataaggctatgttttggaaaggcctccataaaaaagaagatggcctgtataactatccctaagatctttgacttggatcctctttatttttttattgaggaaaatgatttccatttatttaactccaccattattcttattttgtggcataatatttgcaagacctctgtcagtaactctctacttttgttttccataaacctcacagtttgaggatcttaatatgattaatcagtggtattggctataatgttgtccccactgtaaaccagaataccccttctataaccatatctttataaaaatctaacatcttccagaagatagacagttaatttttgcttcgacctaagcactaatcctaagggaaatgtagtttgataacatgattttcctctccatgtcaacatattgaaaattttctaacccacagaaaatttgtaaaaacctaacccaaattaagggagtatacaaaaggaaaacagtccttattattagtgcttatgccaccaaaattgtttctgttcctgggtaactgagtaagtgatgactacttataacgcagagagtgtgtatgtgtatgtagcttaacaaatttcacaattaatgttaaatagcttaaaaagggattggaattttagacagcttttttgacaatgaagtgtttatagaaatacatatttataagttgtaatgcatactgattttcttgtttgcagctaaatcaagtagagagaggccaccaacatttttaactccagaaggcaatgcaagtaacaaagaggaattaagaggaaatgtgctttcactggagtgcattgcagaaggactgtgagttaacactttctgtcctgaagtacatttcttataaaaatatagtaggttggtagagagaggttaataatatcataggaggagtcattgtcttctactaattctagcaagcatcaagaaaaatttggtaattatttccaaagtaggcatatgaatctcatattattgttataatttttttaatgtaatagtaatcttattgaaataagtatcagtaatcaccttatgattgttgaaatattaggtctcattgttaaaatattttgttaatatagtagtagtatcttaaaataagtatcagtaatcaccttgtgactgctatgattataattagagtatattattttgctagtttgtaaccagccacctcaaatttagtggcttaaaaataatagctattgattactgatcacttgtcaagaggtctacagagcagttgtcctctaaccagcaaggttcggctaatttcagttaagcatgctcatgtatctgttaggtggctcagcagtgctcttggggtctactggctgttaactggggcatctgagttgatggccataagttgctaacatctctcttgcagtcttgtcctggcttattctcctaacaacagacatcatgcacagggcctgcctcttaaatcctagcctcagaactagcacactgtcccttcacctacttcctattggcaggtcacaaggccaagcctagattctttgaaataacttagttgtgcacacttcaaaattgaagctaccccagaactgacgcgcctttgacaggagttgcagggaggccttgcccaaatacaaaagcaactgtgatgttagctctgtgttacaaggaatttctatatagtccctgtcttctgcctgacacagagcaaacaccattggtatgggcgcatctgctgaaaacctggaatagaatctcagaaacgtgctgccctcacatgtgatccctgctgtccttgacaggcaactcattggtttcacattccttcctgaatccaggaaaacttgacttcaggaggcacgtggaggcctccgctggccgaggcaggaaatcatactatgcattactcagctcctcaagctacggaaaactagcaaaacccccttttaaagatatgttaaaaccctatatcttctgctagaattaagaaaaaaaaatcctcccagtttccatcgttatggtgtaagagagtggcatagtctgccagcctccaacctttgggagcagaaggtatctattctcacaatttaatgacttcttttcccacaaatgacatatttcataaaaaactaaaatatggttggtatttggaaatttcacaatactcccaaaagaatttttaaaactttggagtgttgtaagaccaagattgggactctatcacttaccaaccagccatcagacttatagaatcaaaatatttccaattcctgacaatggctcaatacagtagctggcctccaaaacaattcatggctttttcataatttcaaactatgaaactatgctttcatctccatctccttcttaccttcatatcatctgagatgcagattagtctgactataaggaaatatcaatatgttatcagattccacatgtatatagattttcaaaatctacttatttttatacttacagcatgttttaattctagaagctatttcatcagatacatatgctcagtttatttcttacttaaccaaacaagccaaaccaatattataatcaattaataccacttgcatttcttttttttttttttgcttgaaccataatttattatttctcatggttccatgtgatgactgggctaagcttttttaaattattttttattttccataggttattggggtacaggtggtgtttggttacatgagtaagttatttagtggagtaagttatttagtggtgatttgtgagattttggtgcacccatcacccgaacaatatacgctgtactctatttgtagtcttttgtccctcaacactcctccacccttcccctgaagtccccaaagtccattgtgttattcttatgcctttgtgtcctcgtagcttagctcccacatatcagtgagaacatacagtgtttggttttccattcctgagttacttcacttagaataatagtctccattctcatccaggtcaccgcaaatgccattaattcattcctttttatggctgagtagtattccatcacatatatatataccacagtttctttatccacttgttgattgatgggcatttgggttggttccctgattttgcagttgcaaactgtgatgctataaacatgcgtgtgcaagtatcttttctgtataatgacttcttttcctctgggtagatacccagtggtgggattcctggatgaaatggcagttctacttttggtactttaaggaatctccacactgttttccataggggctgtactagtttacattcccaccagcactgtagaagtgttccctgataaccgcatccatgccaacatctactgtttttttgattttttggttatggccattcttgcaggagtaaggtggtattgcattgcggttttgatttgcatttccctgatcattagtgatgttgagcattttttcatgtttgttggccatttgtgtatcttcttttgaaaactgtctattcatgtccttagcccagtttttgatgggattgtctgtttttttcttgctgatttgtttgagtttgttgtagattctggatattagtcctttgtcagatgtatagattgtgaagatttcctcccactctgtgggttgtctgtttactctgctgactgttgtttttgccatgcaaaagctctttaatttaattaagtcccaggtatttatctttgtttttattgcatttgctttcaggttcttggtcatgaattccttgcctaatccaatatctagaaggggttttcctatgatattttctagaatttttataatttcaggtcttagatttaagttcttaattcatcttgagttggtttttatataaggtgagagatgaacatccagtttcattctcctacatgtggctagccagttatcccaacaccaattattgaaaagggtgtcctttccccactttatgtttttgtttgctttgtcgaagatcagttggctgtaagtatttgggtttatctctgggttctctattctgttccactggtctttgtgcgtatttttataccagtatcaagctgttttggtgaccatggccttatagtatagtttgaaatcaggtagtgtgaggcctccagatttgttctttttgcttagtcttgctttggctgtgtggggtcttctttggttccatatgaattttagaatgtttttttctaattctgtaaagaataatggtggtattttgatggggattgcattgaatttgtagattgcttttggcagtatgtcattttcacaatattgattctactcttccatgagcatgggatgtgttttcatttgtgtcgtctgtgatttctttttgtagtgttttgtagttttccttgtagaggtcttttgcctccttggttaggtatattcctaaggatttttttttttttggcagctattataaagggggttgagttcttgatttgactctctacttggttgctgttggtgtatagaagagctactgatttgtgtacattaatcttgtatctggaaactttgctgaattcttttatgagttctagggcctttctggagaagtctttaaggttttcaaggtaaatgatcatatcatcagcaaacagtgacagtttgacttcctctttacgaatttggataccctttatttctttctcttgtctgattgctctggctaggacttccagtactatgttgaagaggagtggtaagagtgggcattcttgtcttattccatttctcagagggaatgctttcaacttttccccactcagtattatgttggctgtgggtttgacatagatggcttttattacattgaggtatgttcattacatgctgattttgctgaaagttttaataataaagggatgctggattttatcagatactttttctgcatctattgagatgatcgtgcgatttttgtttttaattctgtttatgtggtgtatcacatttattgacttgtgtatgttaaaccatccctgcatccctagtatacaacccacttgatcatggtggattatctttttgatatgttgctggattcagttacctagtattttgttaaggattttagcatctatgttcctcagggatatcagtccatagtttctttttttggttatgtcctttcctggttttggtattagggtgatactggcttcatagaatgaattggggagggttctctctttctggtggaatagtgtcaaaaggattggtaccaattcttctttgaatgtctggtagaattctgctgtgaatccatgtggtcatggacttttttttggtaattttttaattactattttgatcttgctgcttattattggtctgtttaaggtatctaacttttcctgatttaagctaggagggttgtatttttccaggaatttatccatctcttttaggttttctagtttatgtgtgtaagggtgttcatagcagccttgagtgagcttttgtattttggtgatgtcagttgtaatatctcccttttcatttcttgatgaggttatttggattttctctcttcttttcttggttaatcttgctaatggtctatcaattgtatttatcttttcgaagaaccagctgtttgtttcatttatcttttgtattttttgttgtttgtttcaatttcatttagttctgctgtgatcttatctcctttcttctgctgggtttgggtttggtttgttcttgtttctctagttccttgaggtgtgaccttagaatgtcagtttgtgccctttcagtcttttcgatgtaggcgtttagagctatgaactttcctcttagcaccgcctctgctgtatcccagaggttttgataggttgtgtcactattgtcgttcagttcgaagaattttttaatttccatcttgatttcgttttctacccaatgatcattcaggagcaggttatttaatttccgtgtttttgcatggctttgaaggttccttttggagttgatttccacttttattccactgtggtctgagagagtgcttgatataatttcaattttcttaaatttattgaggctcattttgtggcctatcatatggtccatcttcaagaaagttccatgtgctgttgaatagaatgtgtattctgggtggctagaaagatggctgaataggagcagctccaatctgcagctcccagcaagatcgatgcagaaggtgggtgatttctgcattcccagctgaggtacctggttcatctcattgggactggttagacagtggaagcagcccacagagggcgagccgaagcagggtgggggtgtcacctcactcaggaagtgcaaggggtcggggaactccccccccccccagccaagggaagccgtgagggactgtgccatgaggaacaggaggaacagtgcattccggcccagatactatgctttgcccatggtctttgcaatccacagaccaggagattccctggggtgcctacaccaccagggcactgggtttcaagcaaaaaactgggcgaccatttgggcagacaccgagctagctgcaggagttttttttcataccccagtggtgcctggaacgccagtgagacagaaccattcactcccctggaaagggagctgaagccagggagccaagtgatctagctcagcggatcccacccccatgaagcccagcaagctaagatccactgatttgaaattctggctgccaacactgcagtctgaagtcgacctgggatgctctaagttggtggggtatgggcatctgccattactgaggcttgggtaggtggttttcccttcacagtgtaaacaaacccaccaggaagtttgaactgggcagagcctaccacagctcagcaaagcctctgtacccagactgcctctctagattcctcctctctgggcagggcatcactgaaagaaaggcagcagccccagtcaaaggcttatagatcaaagtcccatctctctgggacagagcacctgggggaaggggcagctgtgggcgcagcttcagcagatttaaacattcctgctgctggctctgaaaagagcagcagatctcccagcacagtgctcgagctctgctaagggagagactgcctcctcaagtgggtccctgacccccgtgcctcctgactgggagacacctcccagcaggggtcgacagacacctcatacaggagagctccggctgacatctggcaggtgcccttctgggatgaagcatccagaggagggaacaggcagcaacctttgctgttctgcagccttcgctggtgatacccaagcaaacagtgtctggagtggacctccagcaaactccagcagacctgcagcagagggccctgactgttagaacaaaaactaacaaacagaaagaaatagcatcagcatcaacaaaaagggcgtccacacaaaaaacccatatgaaggggtcaccaacatcaaagaccaaaggtagataaatccacaaagatgaggaaaaaccagtacaaaaggtctgaaagttccaaaaacgagaatgcctcttctcctccaaaggatcacaactactcaccagcaagggaacaaaactggacagaaaatgagtttgacgaattgacagaagtgggcttcagaaggtgggtaatagtaaactcctctgagctaaaggagcttattctaacccaatgcaaggaagctaagaaccttgaaaaaaggttagaggaattgctaattagaataaccagtttagagaagaacataaatgaccggatggagctgaaaaacacagcacgagaacttcgtgacgcatacacaagtattgatagctgaatcaaacaagtggaagaaaggataacagagatagaagatcaacttaatgaaataaagtgtgaagacaagattagagaaaaaagaatgaaaaagaatgaatgaagtctccaagaaatatgggactatgtgaaaagaccaaacctacgtttgattggtgtacctgaaagtgacagggagaatggaaccaagttggaaaacacttttcaggatattatccaggagaacttccccaacctagcaagagaggccaacattcaaattcaggaaatacagagaacaccacaaagatactcctcaagaagagcaaccccaagacaaataatcatcagattcaccaaggttgcaatgaaggaaaaaatgttaaggacaaccagagagaaaggttgggttctccacaaaggaaagcccatcagactaacagcggatcttttggcagaaaccctacaagccagaagaaagtgggggccaatattcaacattcttaaagaaaagaattttcaacccagaatttcatatccagccaaactaagcttcgtaagtaaaggagaaataaaaatcctttacagacaagcaaatcctgaggggttttgtcaccaccaggcctgccttacaagatctcctgaaggaagcactaaatatggaaaggaaaaaccagaaccagccactgcaaaaacataacgaattgtaaacaccatcgacactatgaagaaactgcatcaactaacgcgcagaataaccagctagcatcataatgacaggatcaaattcacacataacaatattaaccttaaatgtaaagggctaaatgcccaaattaaaagacgcaggctggcaaattggataacgaatcaagacccatcagtgtgctgtattcaggagaccagcctcatgtgcaaatacacacataggctcaaaataaagggatggaggaatatttaccaagcaaatgaaaagcaaaaaaaaaaaaaaaggcaggggttgcagttgtagtctgataaaacagactttaaaccagcaaagatcaaaaaagacaagggtattacataatggtaaagggatcaatgcaacaagaagagctaactatcccaaaaatatatggagccaatacagaagcacccagattcataaagcaagttcttagagacatacaaagacacttagactcccacacaaaaatagtgggagatggccaggcgcggtggctcatgcttgtaatcccagcactttgggaggctgaggcgggtggatcatgaggtcaggagatcgagaccatcctggctaacatggtgaaaccccatctgtactaaaaaaaatacaaaaaattagctaggcatggtggcaggcacctgtagtcccagctacttgggaggctgaggcaggagaatggcgtgaacccaggatgcggagcttgcagtgagccgagatcgcaccactgcactccagcctgggtgacagagcaagactccatctcaaaaaaaaaaaaaaaaaatagtgggacactttaacaccctgctgtcaatattagacagatcagtgagacagaaaattaacagggatatttaggacttgaactcagctctggaccaagcagacctgatagacatctacagaactctccaccccaaatcaacagaatatacattctttccagcaccacatcacacttattctaaaattgaccacataattggaagtaaaacactcctcaccaaatgcaaaagaacagaaatcataacagtctgtcagaccacactgcaatcaaattagaactcaggattgagaaactcattcaaaaccacacaactacatggaaactgatcaacctgctcctgagtgactactgggtaaataacgaaattaaggcagaaataaataagttctttgaaaccaatgagaacaaagacacaatgtaccaggatcacaatgtacagctaaagcagtgtttagagggaaatttatacactaatgtctacaggacaaagtgggaaagatctaaatttgataccctaacatcacaattaaaagaactagagaagcaaccgaaacaaattcaaaagctagcagaaaacaagaaataactaagatcagagcagaactaaaggcgatagagacatgaaaaacccttcaaaaaatcaataaatccaggagctggttttttgaaaagattaacaaaatagaccactagccagactaataaagaagaaaagagagaagagtcaaatagacacaataaaaaatgataaaagggatatcaccactgatcccacagaaatacaaactaccaccatatagagtatagagaatactataaacacctctacgcaaataaactagaaaatctagaagagatggataaattcctggacacattcaccctcccaagactaaactaggaagaagtcaaatccctgaatagaccaataagaagttctgaaattgaggcagtaattaatagcctaccaaccaaaaaaagcccaggaccagatggatttacagccaaattctaccagaggtacaaaaaggagctggtaccattccttctgaagctattccaagcaacagaaaaagagggtatcctccctaactcattttgtgaggccagcatcatcctgataccaaaacctggcagagacacaacgaaagtagaaaatttcaggccaatatccctgatgaacattgatgcaaaaatcctcaataaaatactggcaaactgaatccagcagcacatcaaaaagcttatccaccacaatcaattcggcttcatccctgggatgcaaggctggttcaacatatgcaaatcaataaacataatctatcacataaagagaaccagtgacaaaaaccacatgatcatcttaatagatgcagaaaaggccttcgacaaaattcaacagcccttcatgctaaaaactctcaggactattagtaattgttttataaatttaggagctccattgttaggtgtatatatgtttaggattgtgatattttcctgttcgacaaggccttttaccattatataatgtccttctttgtctcttttaactgctgttgctttaaagtttgttttgtctgatacaaaaatagctacccctgcttgcttttggtgtccatttgcatgaaataactttttccactcctttattttaagtttatgtgagtccttatgtgttaggtgagtctcctgaaggcagcagatagttggtggtgagttcttatccattctgcagttctgtatcttttaagtggagcactcaggccatttacattcaatgttaatattgagatgtgagatacccttgcattcattgtgctatttgttgcctgtgtaccttgggttttttattttttgtttttgctttttgaattatatttttgttttataggtcctgtgtgatttatgctttaaagaggttctgttttgatgtgtttccaggatttgttttaagatttagaactccttttagcagttcttgtagtggtggtttggtaatggcaaattctctcagcatttgtttgtctgaaaaagactgtatctttccttcaaatatgatgcttagtttcgctggatacaaaattcttgactgataattgttttgtttgtggaggctgaagatagggccccaatcccttctagcttgtaggatttctgctgagaactctgctgttaatctgataggtgttcctttataggttacctcatgcttttgtctcacagctctttagattatttccgtcatcttaactttggataacctgatgacaatgtgcctggacatctttttgagatgagttttccaggtgttctttgtgcttcctgtatttgaatgtctaggtccctagcaaggccagaaaagttttcctcgattattcctccaaatgtgttttccaaacttttagatttctcttattcctcaggaacactgagtattcttaggtttggtcatttaacataatcccagacttcttggaggctttgttcatattttcctattcttttctctttgtatttgttggattgggttcattgaaagactttgtcttcaagctcttaatttctctcttctacttgttcagttctattgctgagatttttcagagcattttgcatttctataagtgtgtccaatgtttcctgaagttttgattgttttttctttatagtgtctatttcctagactatttctccctttgcttcttgtattgttttttggatttccttacattgggctttgcctttctctggtgcctctctgataagcttaataactaaccttctgaattctttttcaggtaaatcagggatttcttcttggtttggatccattgctggtgagctagtgtgattctttggtgggtgttaaaaatccttgtttagtcatattaccagagttggttttctggttccttctcatttgggtagattctgtcagagggaaggtctagggctgaagtctgttgttcagattcttttgtcccatggggttttcccttgatgtagtactctccccgttttcctatggatgtggcttcctatgagccaagctgcagtgattgttatctctcttctgggtctagccacctggcaagtctacccatctccaggctgctattggagtttgtttgcacagagtcctgtgatgtgaaccatcggcctctccaccatagataccagcacctgttctggtggaggtggcagggggttgaaatggactctgtgagggttcttaggtttggtggtttaatgttctatttttgtgctggttggcctcctgccaggtgctttccagagagtatcagttctggtagtatggagaggaactggtggtgagtggagcactagaactcccaagattatatgccctttgtcttcagctaccagagttggtagagaaggcccctcaggtgggggtagggctaggtgtgtctgagctcagactctctttgggtcttgctgtggctgctgtgggggagggggtgaggttcccagatcaatggagttgtgtacctaggaggattaaggctgcctctgctgagtcatgcaagttgtccctctgctgagtcatgcaggttgttggggaagcgagggaaatccagcagtcacaggcctcacccagctcccacgcaaaccaaaaggccagtctcactcccacagtgcctaccctaacagccccaagtctgtttccaggcagtgggtgagcggggcttgagaacttgccccagactatccacctcccagcggcaaaagaaaagggcttagttcttccccagcctatggagtctgcatgctggattcatgccctttcccgagttctggccaggaggtttctcgtctggttcaaattgttataaagttcagctggagacttccttctccctgtggcattttccccacacctctggctgccctcctgaaggatctctgtggtgccaggcaggaatggcctgcttggggacccagcgagctcccaaggcctttcctgctgcttcctctacccctgtatttcactcagctctctaaattgactcagctccaggtaaagtcagaaacttctcccacaaaccagtttttcacttctgcagtttgggcactcacagtatttgggatatctcccgggtcctgcaggagcagtccaattccttcagagagtctgtgagtcctttcagcaggtttgttcttgcagttattctggagctaaaattcacgatgcaagcctccacatgctgctctgtccatccgcatcagagctgcaatgtagttctgcctcccatctgccatgatgatcccttctgggctgagctgttcttattcagagtcacttgcatttctattgacaaatattgttatcttcctgagggcctggaccatattttcttcatcatcttcccaacacacagctcagtgcttggtgtatagttcagtacttaggaaatttttgtgttgaatggatttttattttaccttcatgaaaactttctaaagtcattagttcaagtcaagcattattatccctattaaggcaactaaggaaactaagcctcaaaaagatcagaaatccagggacagggttggaattctaaagatcttctaactccaagcctatattctgacttttcatctgtctccatattccatgacaataaaaaacacagttgggaccaggcgcggtggctcacgcctataatcccagcactttgggaggctgaggcgggtggatcacaagatcaggagatcgagaccatactgactaaaacaatgaaaccccatctctactaaaaatacaaaaaattagctaggcatggtggcgggcacctgtagtcccagctactcgggaggctgaggcaggagaatggcgtgaacctgggaggcggagcttgcagtgagctgagatcgtgccactgcactccagcctgggtgacagagcaagactccatctcaaaaaaaaaaaaaacaaaaaacattgggtgacaaatggtatgagtaatacctaagtttgatctattcttaattagtgtaataatatttttaaatgtcactaataatgaaactaaggaaaaaaagctctttcccttattacttagttaacatcatcagatagactgctgtaaaataggaaaattattccatttgatatggaaatgtatacaaaggtttatggtcatagatatgtttatgagtttttctctgtacatgtttaatcccagctgatgaaaaattataattcagtatcattaatataatagtaattcttttgattaacatagtagcttcatgtaaaaatttccaagagttccttattagtcacaacgttgaaaaaaataattaggccccatcagtaaagcaactcatgctggcattcatactgtatcattgacatcgaagtttatggtgtgccatcaattagtatagttctgattatgtgaaaacgtaaaactgtgagcattatttataaaagtgtggtgctaattaaaatatctatgtatttcttatgattttttaataaagatttgttacaaagttgcatgaaaattcatcctcaaaagtagtcataggtggattccttttttgtaacatcattatttatttatcctatcaggcctaccccaattatttactgggcaaaggaagatggaatgctacccaaaaacaggacagtttataagaactttgagaaaaccttgcagatcattcatgtttcagaagcagactctggaaattaccaatgtatagcaaaaaatgcattaggagccatccaccataccatttctgttagagttaaaggtatattgtttaaaatccattcttcttgccttcatgagagaccctgaaactttaattaaatgtggttttcattacatttttagtaatggtaaatgtaaagttatgtcaacattcatggtaccttgactctcttctcattgctattggtagtgcatctaaatcaggttaaaaatttacttgttcaaatcttcctcacagaagaatcccagttaatgaatataggaataatgaaggaaatagaaaagtcaatattagaatcccacagtaataactagagccggcaagatcaaacaatgaatgctaaaattagtgggtgaaactttaaggagaaacaggatatttgcatagcttcaaagtgtttctatcccgcagaaattaattactggggaagttttagcgtgtccacaaatactttattactcctttctttagaagatggagcttactttccctcttcttgagtgtatgctggacactaatgaacagagtatggaatccagggaaatagtaactttggagtggagaaacctggcagacactgtcttaaccaagtgatgaatgttaacgtcaataataataagtcatgtttgatatcatatattcccccatatggtacaagtagaagggttcattacctttgggatattctcaaaagcccaaaacctcagggtaatcatgagaaaacatcagacaaacctaagccgtaagacagtctacgaaataactgaccagtactcttcaaaagtgtcaaggtcacaaaagacaaggaaagaccaagaaattgtcagattggagatgatgacaagtaaatgcaaaagacgttacaagtaaatacggtgtctaggacaggatcctgggacagaaacaagacattaatgcaaaaacggaaatcctaacagaatgtgtagtttagttaagtaccattgttaacttttcgttaggtaactagaccatggtcacataagatgttaacattagaggaagctgagggaaggaggtatggaaatgctctataatacctttgcaacttttcaaaaatgatgtttttaagttgcttcctaattatatatattctacagggctcagaatttattttatttatttatttattattttgagttggagtctcgctctgttgcccaggctggagtgtaatgggctatcttggctcactgcaacctccacctcccgggttcaagcaattctcctgcctcagcctcccaagtaggtgggattacaggtgcccaccaccacacctggctaatttttttttttttttgtatttttaatagcaacagggttttaccatgtcggccaggctggtttcgaactcctgacctcaagtgatccagccactttggcttcccaaagtgttgggattacaggcatgagccaccatgcctggtccagaatttaaatttgtgtttcttagccctacctgtacatgtaattttctctgtatgcttagataaatctgtcacctctttgatgtctgattaattttaatataaaatgagaaaatgaaatttgtatcaaacaggtctagaaataatacatatacgtcagtgagtctctttaaacattctttgaaaatcttaagtgttctttgaagcattgtttataaatctattcgctcaaaaaaaatgagactaatttagtgtgaagtacttgcttgtattattaaaatagttcaatatgttcttttgctaaaatgcttatttgattcagatttttggtcttttttcttcctcctataaagcggctccatactggatcacagcccctcaaaatcttgtgctgtccccaggagaggatgggaccttgatctgcagagctaatggcaaccccaaacccagaattagctggttaacaaatggagtcccaatagaaagtaagttgccttgagtggttctaattgcagtatattttcagagcatatatacatcccgacagtgaataaatggtgataaaaaaataactcaggttaaggaaggaagccacatgtatgttaaacacaggcaccaaattacctttgcattttattaccattagatatttattatgaatgtgaatagtttatgctgttaacataatggcatgtgatgactggtacttggcaatatttcgtctgctttttacatggataatgggaagaatgacagggtcagaaataaatatcacttcaaagtttagatgatcttctttgtgcaaaacatcaagtgatttgtagaaatgtcacaggcactagaggagataggtggggagactcggcatagagccaatggatatgacaagcataagaaacccagctgtcttaatataaagagttttcagtcataagtatagcaagtatagcccaggtgttctcactgtcttccaaggtcaccgtcccatttgatacccaaagaagaacacatcctctgaccctgatcgtatgcaggatgctttacctttgactagtgctccctccctgagagctgctgctatcatccttgagcagcacctgggcatcctggctatacttgttgccccgttcagcagcctccctgctccgatgctccactccttccacttcattagccaatatctccaagctaccactatgcttcccagcgtgtggcttcaggccctcccattaatctgctaaatcatagcaaaggccagctttacaaaacttggctaaaggcttggggagagtcaagggaattatagcaaagaaaaaatctttaaatggatgttgcacctcactgctccttaattcctaagccatggccatgaacagagaacccactagactctcctcttcctctaccccacccaccaccagctactgccgagaggagcatctttcaacattttccccttcttggagttcagacctcctcttagacaccaagacagagaaagtcagtttcagcatcaaacccagccttaggttcactctcccagtcaataacatgattacctgcaaaggtattctttactcacaataaagatagccctcaggcttatgatacaggacagattggctttgactgcctccaagtcagaatccaatattggttctacatttacataaccaaaaggtctgccgaattgactttcccaaagtaacacacacacttcccctaagatggttccaaaaacctgctggcagatttaaagtggcacaagtctctgtttcttaccatcaaggtctgacaactgcagggtgactgagtcgttgtagcctgccccatgaatatttattggaagttcacttgtgtctcgtagtacagtagctgtcagatactttgaaacaggcagactgtcttcactgtagaaggaagtgtattcctgggagaaaacagatgctagaggccagcaaatagggtttgggtatttccattcccaattttaaccaggatcaggatccagagaaatggcagagagtactttgtggttgtgtttcaggaagctcttgctactctcaggggaatatgagtgaaaactgagaggaaaaagtagaagaaagcctagaactaaaaaagttttatggtggctcatgtgagcctgtaatcccagcactttcagaggctatggcgggcggatttcttgagtacaggagttagagaccagcctgggcaacagggcaaaatcctgcttctacaaaaaaatcaacaaaaaattagctggtacaatgtatgattttctcaggaatgcatacaaaatggcaataaatgatgatacatgcttgatacttttgcaccatgttttgcagctcagagtttttgtgtccatttatggaagtttaaaagtgtccctgagatctagactcagtgaaactgacaagtggaaggaaccatccatctagcccttcagcagggaaaatggggaagctaggggataaaccctcaagcttggcagccagagtgcaatactatgcaaggaaaattgagatgtgggtggatgacataagcaggggaggattaaataatgaagctgatttttcttcttgatttgctcagcttgttgtccttccaaaccagccatcttagtccattcctgctgctataacaaaatgccttagactgggtaatttataaacaacagaaatatattgctcacagttctggaggctggaaagtccaagatcaaagaaccagcagatttcatgtctggtgatggcctgttcctcacagatgctgctatgtgtcctcacatggtagaaggagcatacgggctccctcaagacctttagaacagcaccaatctcattcatgagggggaaaccctcatttcctgatcacctcccagagaccccacctcttaaccttggagttaggtttcaacatgaattttggagggacacaaatattcagaccatagtaccagagtatgcagtgcctctgagggaaccttgtaaatccagtcatcttaacagctttgaaaatacactcataacataataacactccccttttaaattacatttttgtggggagaatcaaccataaaaggcctgctttgggggtacagagtagtaatagcagaaagagtagttcctcttgtaaccctaaattgtctgagtaggtagagaagaaagagttaggactaaatgtctcaaatcagatcagctcatctcttccatcccaaaagtcttctttaaggccccctgagacagaaaaaaggagactgagaagacaaggctggaattccatagctcctatagatccagggtcgctcaccctctggtgtgcctcagagcagtcactctagtggacgtgcagggagaggaataccacatggtgtggcagcaaagcaaggagcccggcaccaccaggccgctccgtggtgctggtagcaggtgctgcatgtttataccaaggtactgtgaagcttccctggaaggggtctttctcgacatctggtggccaagctgaaagtggattaccatttggacatctgataactaaaagatgatgagccagcggggcctctgcacagctttctgcacgatgaccctgcaaaggtacagctgtgccctgcccctggccttctgcagctggcccatctgcagcttctgctgagtggccacatgggtggatgctaagtcttcaacagctaagttcaaagtgaaccctgcatgcccccactgtgtgttgatctcccctgatccaaaataatgagagaatgaggggggtgcagaaactatccaaaacattaatagacatttaaggagccctgtgccgctctctttttcatccccttcttggtaattgtcccatgaatttagaggcccctgaagggaattgcctttgagggttagggaccatcctggaaacggagcaccagtgcttgcttcccatctggagtttgctgacttgtgcaccccacatctagcacggctgggagacgggggaaggatgacagggagatgcagagaggtgaaggtaggaactgagggcacagtctgccaccatgtgtgacagggctgaattagcacaatgaagactccttgccttcatcatggggtcctagcataggcgccagaagtgagctgggagcacaagctggcttgctgacagcactttctatccaagagactgcagaaattgcaggtggaccagctgctgcgggtgaggcacaggaaacagctgtgcttctgaactactgttgtcaggggctgtgcagtgtcccctccaggtgcctgaagtttgtctcctgtgccacacaacagagatacagtcaggggaccatactgccaggtacacagcctccccactcctgacttgcaggcgagcacctaaggacactgactgtctcctttcgcctctgcaggctctggctgccgagtgcacataaatactgtaaaaggagaagctggttcagggaggggaatggtaagaagggttcttttagcaaaatgcaatgtcattgatctgtgactgcatttaagacctgaaagctgttgttttaaaaaaaaaaaaactggaaaaattaactccaaaagtgtctgggcttttatttcattgtctcctaaagctttacccttcccccatccccaggactggccagattacttaaagctttccttgaagcaaaaattacaggctgtattaaataaatgtggaaatttcccaaaaccacctaaaatagttttaaaacaatctacagaagtcagataaaagaacacagctgcagagaactagtgctgaaagagagctttaattttattgtgtaatgggagggtgtgaaaatagaacccaggaccagaaagaaaatgaacttgctattggcaggatggggcaaagcatttccctgctctaccctaggaggttgcttttcaggacttcaaagccacactgaggggggtgtttttgagttcctttttcttcctcttggtcttccccactggagagcctgtgccattctggtggtggtgcccaaggctgtggccactgtgattcctatctctgcaggagagtctaacacttgcagatccttgatagtttccagcgtgcgttgtattaggtctgtcagactcttctgcatgaaacgtggataagatcacaccgttattgtgttaaaaggcccctgtcctctcagggatgaggagggaaaagaactaagagaatgagaatgggcagaagacctcttcctggcactgtgacatatttttctcacaatgaaagatgttgaaagccaggaatgtaagataagcaccaggagaatagaggactggtccaggatattcctgggatttcatcaaggcatcctcccttcttccttttcacaaaactaaggggctcagtggcatcctcttgtagggatggaataagtaaatgaagagggaaatttaactcttctcccagaaatgtgttctacattatgcccaaatgttcacgttccaggaaatgtttacaaagttgactaactgagaaaacctgagcagtaacctcatttgaacaaaccagtacatgctgccatttgtagtctctcatctccaaaatgcataaaatactatatgattagcctgtttcacaaagttctttttaaaatgaaattatgcagtaaatgtaaaagcattttaaagattgatcgtactctgttcatgtaagatggcatgattattattattattctcattatctatatgttgaaagtgtttatatttttacctaccaacatcaggagagttgggttataagtattttctgaaggccatcaccccagttctggaccttatctttgtggctttaagttatttgtagggattctgtgcttttaaatttctttctccagtgtttattgacagcagatgaagttggttattcctagaattaatgattattcctctggataatttggatttgcatgctagagagttactctacccactagccagcccatccaaaggctccaaatgtctctacattagtgattttactctgtgtccagctaccaaccgagcctccatatgtcaccgtgacagttcctgggtttgtttgcattttttaaacaagtacttaaggaaaactcccatggagagaggtctgcttactcattattattacctaaagggtttattttgttcctaaataccttgccaaaaataaatatttgaagactgctctatttagcatatataaggcagatacagtcagatgcctttcaggtaaaaaaataccttcccaaagagttgatagcaaagaaaagtgcaactgagagcaacagaaaagctttctgacatggtttgtttgtgactgatgagtctccacttggggaaaattgtcctactgacattgttgagctttgccctccaagttcatggtcgtgtaacattattattattattgtggtaaaaacacataacaaaatttaccatcttaaccattttaagtgtacagttcagtagtgttaagcattttcacattgtgcaacagatcttcagaactagagccctttagccattaaatatcgcgtggtggtgtaacttttaaaaactcaatacatttaaggaatttgaggaactcttatgtagtctgccacccatccagagagattcggcccagagctctgcctgggattcatcacagtctaaaatacacagccactctattccactgcctggaacatccacagagatgcggtcagggtgggcacatggtgggcaccgagagtgccctgaagagtcccagcactgagagcccaagtgctgggtccagaagtgctaagaatctttttctttttttttttttttttaccgaccttaaaaatttagtttgtttctctactttattcttgtattattttttatttccatagatttttgggcaacaggtggcatttggttacatgaataagttctgagattttggtgcaccggccacccgagcagtgtacacactgtacccaatatatagtcttttatgcctcgctgccccccacactttcctttgagaccccaaagttcaatatatcattcttatgcctttgtgtcctcatagcttagctcccacttatgagtgagaacatataatgtttggttttccattcctgagttacttcacttagaataatgatctccaattccatctaggttgctgtgaatgccattatttcatttctttgtatggctgagtagtatttcatagtgtgtgtgtgtgtgtgtgtgtgtgtgtgtgtgtgtgtgtgtgtgtatttctttatccactcattgattgatggcatttgggctggttccatatttttgcaattgcgaattgtgctgctatcaacatgtgtgtgcaagtatcttttttatataatgaccagaagtgctaagaatcactgacagagaacaagtctccagaaatgctgctttgtgttccagcaccccttgatgaggcagtaggtgagcatcactgagattgtgtgagtcaggccccagtcatacaagacttgggatctgggacacatgggctgccctaagttacactgcattttcagggtccatggctgccctaaggtacactgtgttttcagggtccatggctgccctaaggtacactgtgttttcaggatccatggctgcctgccacagctacagttccctttctaggccagtgtgtcatatccatcctctgctgtcttttatcaacgaatctatataccctgttgaaggaattatgacttgtatttgtctttgatttggaagaacatgttccttaaggcaattttgaaattattagagtcataaataggagatgtaagctaagaagtcaattcaaagtatctcgacacccccacataactagttgaacaacctggagtatctaagatgatttcataaatgagttactgatggtaatcagagtgttgaacaactgcttttttgttacatttttccttgggaatgaagacgttaatcagtccatgaggagtaacttgtaagttagagttttaataatccttggatgctaaaaacttattctgaacttaaatgtatggcgaatttttaaaatattctagtctaaaacatctaaaagacttttaggctataaatgtgatacagtatgtggtagacagaataatccctccttctaccccaccccgccacgatgtctacatcccaatccctagaaactatgaatatgtcaccttacatggcaaaagggaatttgcacatgtgattaaggttaagggccttgagatggggaggttatcctggactatctaatttgggcccaatttaattacatgagcccccaaaagcagagtgccttttccggctttggttggaaagaaaggtgactatggaagaatgatcagagagatgcaacatcgacagctttgaaaatggaggaagaggaccatgggccaaggaatgtgggcagcctccagaggctggaaaaggcaaggacatggattctcccctagaaccttcagaaagcgacgcagctctgctcacgcattggttttagagcagtgtgacccatgtcagacttctaacctacagaactgtatgacagtaaatttgtgttgttctaagccactacatttgtggtaagttgttacagcaaccgtggaaaactattacagaatgagggagccaaatacttcgagtttgggtcataaaacaaggatgtactatggtttggttgatttttattacagtgggttaataaaccacagatgaaacaaatttttttttattttaaaagtgataaaagagtctaaatacagtgatgagtgtgtcttagatgcacatccttttcctttcaccaaggaaaaagaaatggtgcttagaaagaacataaagtcttcttaaatgcttcaagttgcaggagcagtttaagagaaaaggtgctgttatttagttttgattttgatcatcgtgctgagacagagacctaaatccctcttagtgtacttctaaagcaatataagctcaaagcctaaagtgtatcattcacagaaaggaattcatctccaatctcacagaagttccaaattgctgggcatgcccgggactaaatcctcacatactgtgttacccagccagttctattccacttcagtaaggatcaagcctgttcctaacgttttaatacttgagagatttagctgaaaacattgtcttcaagaggaatttacacaatttatttatacttcagcttcaagaatatccacagcagaaaattaaatattttcacatttggttattagccccgtagtgtttatgtatttgttgatttatttatgtcaagaagaggctcctaaaaggaacaggtttgaacaagctggagtgtttctatattttttactagcttttgctatttcctcttgatcgttaactttttttctcctaaataaccacaatctcttgaacacggcaatgttttcctgaatttgtaatgcaattttcacctaaacttgtaagagttttttttctgcatctctcaaaataatacttggtgttcaacatggcacatgtatacatatgtaacaaacctgcacattgtgcacatgtaccctaaaacttaaagtataattaaaaaaaagatacaaggggcaagtgaatggaaaggtctttaaaaaaataaaaataaaaataaataatacttagtgttacagaatcaatcgacttaagactaaatgaatattgagcacatacccttgctaatatataactcaattctgagaaggaaaatgttctggtttctgcctaaattctagtcttattcttactgcatgtacttagatcagtctttatttatgtcctactgactttacaagcttaatatacatcttttaagcaaataggaataaatactttctatttttacatccaaacagttgcccctgatgaccccagcagaaaaatagatggcgataccattattttttcaaatgttcaagaaagatcaagtgcagtatatcagtgcaatgcctctaatgaatatggatatttactggcaaacgcatttgtaaatgtgctgggtaagctctcattttattaaagacatggcaaattaaattaatgactgctgttattttctgttcaatcagcaaaaatatattgagcatctactatgtgcaatgcacagtacttggagctataagggatggataagatataaaccttgccccaaagaatattgcagtcttaatgttcttccataacacagtttttacaatggcaaattcttcattgtagaactagtcaaataagctgttctacttacagatggttagactaagtgtcaaaccctcaaaaggaaaatagcatttgtctgctattagcatctgaatattattgctcttcgttgtaagacactgacaagttgaataacagtgattctgatttttaaaaactaatgcatgaatcataatgcttggcctttatccaagtcacagatgtacatttattttatttgtaaaaacatattttaaaaagtgtgatatactgaaacatattctcaaataattggcttatgtgaacattgtatttcttatattggacaaaactaccaaaataccacatttgttaaaatttttgtgagaattgttttcatggtgccagggaattatacttcagccctttaaaattagtatgcttccttttcaaacaaaattaccatcagtaagccaaccaatacttggtattttcctttcatgcttgaaatgaaggtcactaatcctatgaagagctaagcagttaagatattggtggatgttgagaaagcacttttggctgctgattcctttttcatctctacttttatgagttcagcatttttagattttacatttaagggagatcatgccaagtttgtctttctgtatctggcctgttgcacttaacacaacgtcctccaggttcatccatgtggtcatgacatgaacgacatgaaggaaatgatagaatttccttcttttttaaggctggatagtattccattgtgtgtatatgccacagtttctttattccattcattcattggtgggcacttaggttgattccatatcttggctattgtgaataatactgcaatgaacaagggagttcaaatatctcaacatactgatttcatttcctttggatatatacccattaatggcattgttggatcatatggtagttgtatttttaatgttttgagtataaacagtataaacaatctttatagtattttccataatggctgtactaacttatattccctcccacaatgtttaagtgtccccttttctctacattcttgccaacacttagatctcctctttttgataatagccattctaataagtgtgatataatatctcattgtggttttaatttacatttatctggcgattggtgataattgggcattttcccatatacctgttggccgtttgtatatcttcttttgagaactgtctagtccaatgccttgcccatttttaaccaggttattcattttcttactattgaattatttgagttctttatatattttggtattaaccccttaccagatacatggtttgcaaatgttttctccccttccataggttgtttcttcactttgttgactatctctttggctgtgcaagctttttagtctggtgtaatcccatttgtctatttttgtttttgttgctgtggttccatttattcagccatcacactcatcactctgcttttttctgccagcttatgtgttccccaccgttcctacccactagggttatgatgagtgagtcattcaacaaaaatatacttggctgttatttttgtgccagacactgtgctggggataagacaaaagtctcattccctgactgcagtggactcacagtaaatcaacaaccaaaatgatgtctgagcaagaagtagggcaggaggtagagggaggaaaaatgtatttttctgccttgagtgactggcagcattatgcctgatagagaacataaggagagagatagattgcttgtgctttaccataaactttaatgaccttaaaacaaaatacaataaataaacgatagtcctaaaatgtattctaatatttactttaccttttaaaaatatttgtagctgagccaccacgaatcctcacacctgcaaacacactctaccaggtcattgcaaacaggcctgctttactagactgtgccttctttgggtctcctctcccaaccatcgagtggtaagtagcagctctgtgtgtttttcaatacttaaaatgtttgctaaaggcttcatattctaaatatgttgggttttattcaaaaacaaacagggaaaggcaccacacaatccattacactgttaatatattttttttttcttgtgagacagagtctcacttcattacccaggctggagtgcagtggcacaatcacagctcactgcagcctctgcctcctgggttcaagcatatctcctgcctcagcctctagagtatctgggcctacagccgcctgccaccacacctggctaattttttgtatttttaatagagagagggtttcaccatgttggccaggctaatctcaaactcgtaacctcaggttatccgcccgcctcagcctcccaaagtgctgggattataggtatgagccactgtgcttggcctacactgttaattattaaattcattcattatttcacaaatatttattaactactggctctgtgttaaatactttcatgtgtataatctatttagcagcacactctatcaagcacagatctacatgtaaatgatttttttttaaatttaaggctgctgtatttcacaatgccatggacatcccctgggattttgtgagtagtggctggagggactagttaggggatattccttgataataaaatattctgtggtatagtggggggttctataagctccaaagcagaatttgttcttaccattgtttctcttgagtacttgttgcaccaggtcttcctgacttggatccagccaagctctcccatgttcttttactccccacttcagaccatcccctttcatatgccacccgaggtttaagtcctctacctcctcctagcttgtttactttagctgaaagagacaaggctaggatggatgagcaatggctcagaaggaatgaatgaaagaaaactggaacattctttactgatcatctgtcaggtcctagatgctgtgctaagttccaactactgaggtcagaatatatgcagggttaagattaaaggaaaatttcccttggcccctaccttaaccccagagaagaaaaatggatgcttatgcagatgattttcctagtgaaggtaacagattcacactcactttgtttcatccgtttcacttctcctctctgacatacatgcctttttttcttccctggttattttcctattgatactttcaaaagtacaatccttctagccttgcaactttcacattcatcatggtcatgttgaccttgaacatggcattttatgtctgacttcaaaatataatgtgtttttattctcattgtgataatttctgtaatgaaggtttaaaggagctaaaggaagtgctcttcatgaagatatttatgttttacatgaaaatggaactttggaaattcctgtggcccaaaaggacagtacaggaacttatacgtgtgttgcaaggaataaattagggatggcaaagaatgaagttcacttagaaatcaaaggtaaggcagaggtaatgtgtttaatttttaaatgactttgaacaaattctccagctttgccaaatggataacgatgactctgcatttcagatgctacatggatcgttaaacagcccgaatatgcagttgtgcaaagagggagcatggtgtcctttgaatgcaaagtgaaacatgatcacaccttatccctcactgtcctgtggctgaaggacaacagggaactgcccagtgatgaaaggtatttgaagacgatttctttactttctcttcattctttctttaagctattcttgaactaaaggtctactatgtagtcaattatggtgatgtttttagtttctgaagtctgctgtctccaaaatagagagataagcattttctccctactgtaaaatatatgcacccaagaaggtatcaggtgattgaaataggaccctgagaatgtttgtctatctttgcgtgctggtctcttgtgtaattcaggatgggaaaaaaccctcaggcctggacagcatccattgttttataccttgaacagcgaagtctcaacagatgttttcattacctttctacaaataagcagaaatatgacctctttaatcaccaaagactgctcaaatccttgtcagtattttaagacactcgtttttatttggatagggagtttttcttttgattttacctaaagccagtgaaaggggaaggaaaaacaaaaacaggtagagcatttaaaagagcccaagcatgctgcagatttcattaagaatggaagaaaggtcatggcattttccagatgagaccctcaatttgacatagtagtacagagtagatatgtgttagttttagcaaagtggctataggcctcactctctattagaaggaatgctgtattctggtcgaaatcatttgtgtggttcacctacagctgacctaaaattgtggtgcctaaatattgccctgttgcttgtcaatgaccctggaagaactctgtggccttctcttttatgtgcctagagtctccatctaattttatgcttgaactagtcaattttatttgttgagttgataaagatgaaaaggtgtggtggtctcacacctgtggtcccagctacctgggaggctgaggtgggagaattacctgggcccagaaggttgagactccagtgagccatgactgtaccactgcactccagcctgggtgacagagtgagaccctgtctttaagattaaaaggaaacataaagaaatgaccatcaggttaaggtggctgaagcttttacttggaaattaactgagaagacagtttatgacttaggcagtttcattaaaataatacattaattctctatacattaattttttgatctactgagcaatttttcatgcccacaagttccctctagaaaagtcttagagagattgttcatctaaatcttcctgtttctagtgataaagcaaattattattctttgcatttaatttctcctatgagagtttatacatgtaagaaaatgacatgattttctgcagtaaataataaagtatttaaaatatatactttgatagaaattgaactgaatgagtggttttccaatgtttcttggcagcaaaagccttagtaaagccctttagtaaggctaatgctggaactattcttcgcctccttcccctgggaacttaaggaagctccttcctctccctctagagcagtggtccccaacctttttggcaccagggactggtttcatggaagacagtttttccacggacagggtgggggcacaatggcttcaggatgattcaagcacattacatttactgtgcactttatttctattattattatgttgtaatatgtatatacatatatatattattacatgtaatatatacagtgacagatcatcaggcattagattgtcataggagagcacagtctagatctagatctctcacttgcacagttcacaatagggttcaccttcctgtgagaatctaatgctgccactaatctgacaggaggcggagctcagcttcactcgccccattcccctggggcctaaggaaactcctaccacaccctctagagcagcggtcccctctgcagcccagttcctaacaggacagtacccagttcttggcccagggtttggggacccgtgctctagaggcctggttgaaaaatactgtgccagaggacatatcccttctaacccaatattctaattgattctcattgtttttcaactttaatcattcttaaagtgatatgtattttgctctaacttttgaaagtgtttaccatctttctcctttatcaaatttacagtttttttcctgccagtgaagcaattatagggtacggctgcatgtccatttcagctgctctgaatgcattctatccacaggttcactgttgacaaggatcatctagtggtagctgatgtcagtgacgatgacagcgggacctacacgtgtgtggccaacaccactctggacagcgtctccgccagcgctgtgcttagcgttgttggtaagaacgaaaacaaaaatagcacaactggcttccctgcatttggttgaaaagaaaaaataagataaaaattataaatatcaaatatttgcttgttaatatgcatgggtgagttcatacccatgtttttcttctttgaaagatgccttggaggcaataatttcagtataaatagactgtgtagcagcactgggtgaaatggtggatatgcacattagtaaccttttttgtaataaaataaggagaaatgatctacttgtatctaaaattgaaggttttttttcctaaattgttactgcatgtttatcaatgctgtgtctcacagctaagcatagggcttaattttataaccttgaataatgtacagtctttgtcatcttgtgctatcttgtatctttccattactaattttgattaaaatcctttatattaatgtcctttctagctcctactccaactccagctcccgtttacggtaaactaatatgagtcttctttctctgttttctgtcaaacaatttcacatttgcagaaagtattcataactttcttttctatgtcacataattgtgtttcttaaggaaaaggtctctgtcagttgttatgttgtgtcacccatttactgacaatgaatcatttcttcatcataaccacagatttttcaccaaattcgttgccagttctttctaaatagttcatgtgctattataaaataacttcgtttgataaaagtccctctttgatgcaatttccttttaaagtagcatagtgctttttcaaaagccatcatccacattttacagaatgaaaaagctatttctaatattctacaaattaggctttcatctcaatttattaaaagttgtttgggaaaaatcttgttttgggattccattttcaagaaatgtatatggggaaaaatagatgtttagaacaacatttaacttttatatcagagaaaaccgactcaccatgtgttaacaaaagacaaatcactcaagaaagaccaaaaggaggggcacatttatgttgtgtggctttttagaatctggaaaataagtcagaaatcatttccagaaatctttttatttagagaaccttcatctttattcagtacgtcaatacaaaaatcaatttttggcatctcagctgattttgcacaatattattaatattgtatctaattatccaatataaaacctgtgctttgtagacatttactgccttatgactgataagaaaaaaaagcacatatatttgtatggtctctggtcccctaagagccagagatactcctaggagcaaggtcaaataaaggcctggggggaacagtaactctctggatctcagaagcaccattagaagaggcagacatgcttctaggacaccttcatcccaacatgtgtctgtctatacactgttgtcctctgggagtaaacacacttatgcatgctgagggctacctccatagcatctatttcagcattctttcacaaatataaatattctttcagagccccaaaatctgttattcagcattttttttagaaagaacatttgaattttctttaaacagcaccttttatttgcctgtatttcttttttcagcagttgctttctctatttcccatgtattagaaattaagcttattatttttcatgtttgtgcccattcatgtttatgagaagaaacgctgagagtgctgatgaaccacatgtgtctgcttcactgggtttggttacaaatgctttcgtttcctttgaaaaacaagtgagcagaactcattgatgggttatcttgtgtgtgttcgtgtgttcccagcagcctcagctgtgcacatttcctttcagttgcatgctcattgactatcaagtgtgctgtgtctttaagatgtcccctctgtgaatagtatcacgagtaaaggagagcctcttaaagatggatgcgtgaccatgatgtgtgtatgtttggtctacagatgtcccaaatcctccctttgacttagaactgacagatcaacttgacaaaagtgttcagctgtcatggaccccaggcgatgacaacaatagccccattacaagtatgtggtattatttgctctatttccgatcaactaaatggccatgtttgaagcactttgtaacagtcagctgaatttcctcacaaaggtatttactgggattctctgcttcattactgatagaataaaaatatttatttatgtccttcctctcttcagagctgaaactattcctggttacaccttctagaataggacaccccttaattgctgaagatgttgactaatgaaatacactgtcatttgtgtttaagatccataaaaatcactttaaatatctaccatgtaggaagatacaccttaagttagttgtttattttgcccatttcttctgggagaaaatgttaggaggagcaagtgctgaatagctctgtcttcctattaggaaactgatacttgatgagtaaagtaacttttcaaccccctgttggtaacagaactgggcgtagataacaggttctaccttaacttccaacctaggtctctttctttccattagtccctgctacaaagttgcccattcaacaatgtgagcttctcacgttggtgacataagcctagggcctaggaaataaggaaggacaatgtcataaggatactagaagagcataataaaattagactataggtaagcttcgaagttgaattgtaaaaccaaagagatacttaagaggcagacacaatcaggtcacatgcctgaaatacattattaccttcaggcatataccgcaggaagacaattcctttctgatgactacctaagatgattctgaaatgataggtgtgttgatttattgcacctcctggtaaagtagaatatttccactaaaatttatttatttatttatttattttatttttattttttttattatactctaagtattagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaattagtttacagtcccaccaacagtgtaaaagtgttcctatttctccacatcctctccagcacctgttgtttcctgactttttaatgattgccattctaactggtgtgagatgatgtctcatagtggttttgatttgcatttctctgatggccagtgatgatgagcatttcttcatgtgttttttggctgcataaatgtcttcttttgagaagtgtctgttcatgtccttcgcccactttttgatggggttgtttgttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttcattgagcagtggtttgtagttctccttgaagaggtccttcacatcccttgtaagttggattcctaggtattttattctccttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacatcccatcaatacctaatgtattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcagaatgatgctggcctcctaaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcagtctatcaattttgttgatcctttcaaaaaaccagctcctggattcattgattttttgaagggttttttgtgtctctatttctttcagttctgctctgattttagttatttcttgccttctgctagcttttgaatgtgtttgctcttgcttttctagttcttttaattgtgatgttagggtgtcaattttggatccttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaattcgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatcggacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgtgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgagatgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaaatctgcagaggttactgctgtctttttgtttgtctgtgccctgccccccagaggtggagcctacagaggcaggcaggcctccttgagctgtggtgggctccacccagttcgagcttcccaggctgctttgtttacctaagctagcctgggcaatggtgggcgcccctcccccagcctcgctgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgacttggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccctattccactaaaatttaacaaaagcccctcctctatcttgtgttgtttaatggtgctcttttccctacttgagtgttcaatgtccttgatcagaacacaaattcatccaggcccagtcttctagctcattgggtacattagccagagttagctggttagatggcttggagactcttttttcctatattaaaataataccattagatttcaaggcatttctactctttcattcatttactcattcattcaacagatatttttgagtgcctactgtgtgccagacattgttctaaaacaaaatagtcaaaaatctctgtggttatggagtttatattttagatgaggatataaataagataaaattaataatacattattaagcataatttcattatatctgcatgtaaacatatatatatatacacacacacacacacacagaggactcagatctaccttcaagggcgaacctgctgtaaggagtgttaacccacagcctccatctgcttctccttctctaaggctccactgcagagttcacgtgaggccatgctccttggggtgctccagtgactgggcacagcaaaggtcccagaagtcacacgtgcctaatgcagaactcctcctgtgtagactgtactctgggctcctggttgacctggctgagactatcccagagctatactatactgtagtctgaggcttcttctactcactcctccttcccttccccacttcctgttacagatgtcagaccagcattgtggtctgaaggtcttccctccttcaggcgtccttgcttcctctcccttttttcttccatggacattttcccaaatagacctcttgcacttcttttttttttgagacggagtctcgctttgttgcccaggctggagtgcagtggcgcaatctcggctcactgcaagctctgcctcccgggttcacgccattctcctgcctcagcttcccgagtagctgggactacaggcgcgcgccaccacgcccggctacttttttttttgtatttttagtagagatggggttttgccgtactagccagaatggtctcaatctcctgacctcgtgatccacccgcctcggcctcccaaagtgctggaattacaggcgtgagccactgcgcccggccacctcttgcacttctaattctgtcttagcctttgctccctagaggactcaaactcatatatatctattaatacatatgtttgtgtttatatgtgtttagggcatgcaaaaaacaaatcagcagaaagacatgtggagctaggggtataattgtgaatagtgtgaataggaaaggccacactaaaagaacatttgaatgtgtcaatcaagacaggggagggaggtcagtgagcacactatgcagttgtctaggggaagaactttccagcaagagcaaaggaaaagagcaaaggccctaagacagggcatgtctgctaggatgccagtgtggctgcagtgaaatgaaaaagggaaagtgagggcggagagaaggtcaaagagctgaagagttcggtggtgggtgtgtagagtgggaattgtgcaaggtcctgtaggccactgtgaagatgggaaagcccttggagggttttaacagaggagtgatgaatgaataactctggcttgtctattgaaaatagtgtatagaagaacaagaggggaagcagacagactgggtaagaccatggttcccaaactgtgcactgaagtgccctgtggtacttcagtgaattcacaggaccttccttggaataattttaaagttttaacttttaaattctgatattaaaaaaacacagtgacatctgtcaaacgtcacatgaaattagcttgaggcagattacaggttcaactttatatcccatgtcattttgtgataatgttatatctctgcaaagcgtttgctgtgataaaaagcaagtgccacatggaaatcagtggggaataggaaatgtggaaggtggtgtccaatctgtttacaaggtttgagaacttatataagagaagctttacaatgttaagatataaatagatttaaaattgtttaaaattaaattgcttacatttatttaagatataaatacatataaagatgtatgaacctagctacttaatacatgaaaacattaggtaattcttttggcctaagggagccatgaaaaataaattatggagacactaagtacaccatgaaccgagaaagtttgggaactactgagttaggaggttatgtgataactcacacaagagatgagggtggcctggaataggctgagaaatggtcagattttggatgtattttaatggtacaggccattgtactaccgagagtgtggaagaagtagggaaataagaaggattccagattttgacctgggctgtcactatcaattggagaggaagattagaattagttttggtactatccagtttgagatgctgtcatggacaaccaagtggaattgtcgagcagacagttggacttcctgagtctgcagttcagggaagaggtctgggctacagatgtaaacatgaaagtcatccatttataggactggagatcatccaaagatgaatgtggattgaaaggagaactccaaggacttagttttgaaccactgcaacacatataatatttttagttcatctttgtgtttatagtgcatatcatggtacctggcacatagtaggcaatcagtgaatatccaaatacctattattttacaagggtaaagtgtgtacacaccacagaattttagtggacgcagagggtatgcactgaaaaatatgtcttcctcccgcccctgtctcccagctcctctggccacaccaatgttataggtttatattctctgagaggtaatatgcatttatatgcaagtgaatatgtctgtttatttgttgtagtaatttcgttttacatttacacaagcatagtatccagcacacacgattctataccctgcttggctgcttggtttcacttaataatacactttagaaatcattccatttcagtacgtatggaacagccctattcttttttttttttttttttcctctctctctctcttttttgagacagggtttcactctgtccaggctggagtgcagtggcttgatcatggttcactgcagccttgactttctgggctcaggtgatcctcctacctcagcctcccccatagctggaactataggtgcacgccaccacacccagttaattttctgcagagacggggttttgctaggttgcccaggttgtctcagactcctggactccatccacctgggtcttccaaagtgctgagattacaggtgtgagccaccgcacttggctgacagtcatttttaacagcttcagagtattccattgtgtggacctagtgtaatttgtttagtcagtgtcctgttgatggatgtttaggttgtttgcaattaggttgtttcaattgcaaataatactacaatgtaaattatttctcatgtgtgtttgagccatttgtgtgagcccatttattcaaaataaattgccagaagtgaaatttagtatgcgccttaaatattgacagattttctaaactgtcttatatagaagttgtcccaacttacacttcctacaaagtcagagaatgcttgattccttgtatcatagtcaacgaagtgtgttaaacctttgattattgccaatatgtttagtggaaaatggcactcactatatttaatttatcctattatgaaaaaaatttgatcatcttttcatatatttaaactttttagggatatatggattaattctaaacagttttaagtaactaaattcagcatgctagagaaagcaataccagatttggtaaaatctaaaactgtttagaattaatccatatatccctaaaaagtttaaatatatgaaaaggtggtcaaattttttttgtaataggagaaattaaattaaatacagtgagatgccatttttccactaaaatgttatcatgtgtgtttatatgttgaggataatgacaactctgaaatcaaaatattttaatggcatttttcttgaaagtaaaataattcatgtttggttgcttgtgttgggttgccctgttagttattgctggcagctacccctgggttgactgaattcacggtcttgggtttggtgtgtgtgtgtcgtgaccagaattcatcatcgaatatgaagatgcaatgcacaagccagggctgtggcaccaccaaactgaagtttctggaacacagaccacagcccagctgaagctgtctccttacgtgaactactccttccgcgtgatggcagtgaacagcattgggaagagcttgcccagcgaggcctctgagcagtatttgacgaaagcctcaggtaaagcgggaaagcgggacttctagggtacgaaatataataaaaaagttttccactcttcgcaaaaggccaaagcttacacatgtgtggctgcttaacttccagaaccagataaaaaccccacagctgtggaaggactgggatcagagcctgataatttggtgattacgtggaaggtgagccatgatgccttcaaatttattcgctattttttagagtgaaaaaaaagttgtttgaaaataatatctacattagaatctcatttcacctatttctggggaaaaaaaatatatatatatataaagatacatatatatctttacttaagaggcagtattatatagttgctaaaagcttgagctctggagtcaaaatgatttggtgcaaatcccagctctgccactaactctgtgatcttaggccagttgtttaacatgtctgttaggcagctgtatgatgggagtaataatagaaccaatttcacagtattaaaggagctaatacatataaagcacctagaacagtgcctagcatatacacatgctcaaaaaaatgctagctagtgttatcataaagaaccacctggggccagtagctcacgcctataatcccagcactttgggaggccgaggcgggcagatcatgaggtcaggagtttgagaccagcctgaccaacatggtgaaaccccgtctctactaaaaatacaaaaattagccgggtgtagtgctgcatgcctgtaatcccagctactcaggaggctgaggcaggagaatcgcttgaacccaggaggcagaggttgcagtgagccgagattacaccactgcactccagcctgggtgacagagcaagattccatctccaaaaaaaaaaaaaaagaaccacctggaagacatgcaccaagccattcccagcagtcaacttctttagtggggaaagcttatctgtgttttctggatttggaaaattaacatatatttactcataattcaaaacctattttagatagagccatacatgcatacttagacatgtatacatatatgtacatacttatatttatacaaacatgtagaaacaacagaatgacaggctagcctttttttaataaagaggaaaacagtctgtaagtttccatctgcaaataaaatggacaatgatgtactattgcacaaacaggaatatataaaggattctatgtgaccgaaatgtctaaagaatcaccatccttgaaggtagagccagagtttgaaaggtttatgtgatatttattgcatcaagatagtagtttacaacctttgaaatgttgatcccaaacaagctttgaatctcattgcaaatgcacaattgatagaaggtccctggagaaaatggttaatagcttgtgttttagtatttcaatgatcactttctgtaggtctgggaattgaatttgctgttcctgtaaaagattgtgcagttgatttgtgttataagctctggttatttggctttccttgtagcccttgaatggtttcgaatctaatgggccaggccttcagtacaaagttagctggcgccagaaagatggtgatgatgaatggacatctgtggttgtggcaaatgtatccaaatatattgtctcaggcacgccaacctttgttccatacctgatcaaagttcaggccctgaatgacatggggtttgcccccgagccagctgtagtcatgggacattctggagaagaccgtaagtgatgccatttcctacttttccccagcaaaacagacttaccaaggtgcaagccaaggccatttctccttgctcaggttgcaagggagggaggtggcaattattttgcacgacttctctgaatttaaacagcctgctgtgtaagaaagagaagttcagaacgttcaaggtgattgcagtatagttgtcccttggtatccacaggggattggttccaggatgccctgccttggatacccaaatctgcaaatactcaagtcccacagatagccctatggaaccctcctatatgaaatatcagccctccatgtccgtgggttttgcacccaggaatactgtgttttccatcttctttggctgtagatgcagaacctgcagatgtagagggctgactgtattttggggggaaaaaaaaatccaagtgtaagtggacccatgcagttcaaacctgtgttgttcaagggtcaattgtactttttaaaaaatcgtgttttcctacccactgatggtgggaggatcccttgagtcaaggaatttgagtctagcctgggcaacatagcaagatgccatctcttaaaaaaaaaaatctctcacaaagtcaaacagataccccaaaatctgtgttcaagccttaataatccatagaataggtctgcagtatgcttcaagccaaaattattagagagagtcatatttatggatgaaattaaaaataacattgatacttctaccacttccttgtccttttcctagtcccaatggtggctcctgggaacgtgcgtgtgaatgtggtgaacagtaccttagccgaggtgcactgggacccagtacctctgaaaagcatccgaggacacctacaaggctatcgggcaagtgaaaggggaccttttgtggctttatttagtaagggctgcagcgaatgccacttgtcatgcacaccacaggaggtggggcttatttgtttcattgctttgtgaacttgtggactgaagagttcatttcgctcattgcctcaggtagccactgccagagttgacttgaaatctcactgcatccaaaattaaaaaaaaaaaaaaagttttctccatttttcccactgatgatctaacattctaccaactaagtatgtatacaaaatggggaaaattaattttttaaagacctagaatattaccaactctagctagctttaaagcaatatggaccacatgtgttgaacacacaaaattatcctgataatcatttaggcatttttaaaataattcagaatatactttaagaccatatactcttagctaggtcattcttataaatatccattatctttgttcttgagaagtactgaaagataaatatccattatctttgttcttgagaggcactgattttatattttttactgataggcagccaagcatacagtcactactttgatttgttaagcctgacccctagaggtcactttttgtactacatcacattcaacttttttttttttccccctagcattgccagattccatgtaaatgttgacttctcctgaaaatgcctttaaattcataagaatttaagaagacttagtaaacaacaattctggatttgtgaccaaaattaatcagtactttcttatccatctctccaaaacctgtgcctgcaatcgaatacaaaaaaaagtattttaaactaagtgatacagtttgatttagtggaaaaattctagactttcagtggaggatcccctgtggctcttgatacctctgtggctgtgaaagtcacttagtagcccacacgttcatctgcaccatatgaataacagtaataaaagcctcactgtggtgtttacaatcactacatgataggttgtacgtgaacatgtattaattctggaaaaatatgtaaacattgggcagtaatttttatttttagaatattttatacaagtaaaagacttaaatcctattgtcctccatttgcctcatgttctagagaaaaccacatgggtctcgtgctgttttcattttccttagactcctacgacaaagtagtgtagcccagctttgtcatgtggctgtaatttaatttccctcatgatctatgggcttctattcctcttgcctcagaatcaatatccatcagttttgctagtaattttcttctaaaatataccaacggaattttctggaaaaacaacagtttcaattttgtgagcataaggaatcttgtttgatcctttctgcattcctgactttcgttcttgctgtttcagatttactattggaagacccagagttcatctaaaagaaacagacgtcacattgagaaaaagatcctcaccttccaaggcagcaagactcatggcatgttgccggggctagagccctttagccactacacactgaatgtccgagtggtcaatgggaaaggggagggcccagccagccctgacagagtctttaatactccagaaggaggtatggaatggacgtgtctctaagatctcaggaacatatggcatggcctgagaggttttgcctgacagaagggctactgatcaaagtatattctggaagccaaatgtgattgaaatttctatagatgaatacagcacacacaaagctaccaaaatgtcagatcatatgtgggcctaagtgtacatagaaggcttcagaacccaaaatgctgctctgaaatgccctctcccgtgacttaaaatttttctccacacacactgtctgaaaccttgttactttgacattaatttggatcattaactttctgacctgaaagaggttccataacttctctgaatgtcagtagcctcatctgaaaagcatgagaaccaaattagataacctaacaaaaacacctggaaaggaaaatatttctataagttatagtttacttctatagtttctttcttagtgctcttttctaatttattagaaagttgaaccgagttagaaggttgcaagtcttgaccaagtggattgggaagaggagggaaaagtcattgcagatatgggcaactgcaagggagagagtaaggaaggaccaaatatatattgatccaggagtcaggggagaaggaatttggacacagggacaagggagccttgtgggtgagggaaagaggggcccatgtagtaaaaaggatgaggatttgaaaaggaaataaaatgggttttacctattttaaattttgcaacaatatgccactatgacaatggccagatagcttctgtagcttgcttagctctttttgataaaagaagttcacagaagatggaccccaccctggctgctgattgaaagattcatgatgcaggcagctgcccagcagcctctgagaaccaccctgcatcccagctcccatctcattgtaagtttttgtcgtcaatctcactgtcccttagagagtcagggctcttcctcctcgatgttttcacaacctggggactgtagtcccttagggagacaatgaatgggtttaatgagctccatgagcctcctaaaattgtatgcaagataaatgtatatttttccagggagtgtttatggctgtcatcagattctcaaaagggtctgtgatcccctaaagtaaagaaccacttattgggttggggaagcttagaagcctagaactatgtgccaggcatggttttaggaccagacaaagacatctaggggcctaaagcagggaaatgacaaagaagatggggataggaagaaatggatatgatttagattaaggaagtggagttagtgtctgaggagagggtggaaatgaggcagatagggaagttcaggttgactctggtttttggctagagtgacaatagggagagtggttccattagttagtttccaggggcagtggtaggggaggtaaccattgtgagagagagctgccaccagccatcatcctcatgaggaagtgaataaaagatgagcagacatgtttcctctggtgatttgccagcctctgccacagagaacctgagacccctcgggccttccccagggctgggggtgtgccaaggttgggcttttgtccattcaccaccagatcctgggcagctgtcagctctcaggataagaacgtttctgcacctgggcatgctggcccaaagcccagcaggcagggcattctgactgtttggagacacctggtttgttagagaaaacagtccttaatggtccagaacacagctgcttccactcagatccagttagaatagtttcacttggtagctagtttgcttctattaagacaccattcatgcgtcagacaagtactgcctctttttaaaatattaggtttgagtccatctaaaggcaaagtcattatgtgttttgagaggatggttttattaaatataaatgtaaatgacaagagagaaaaaggaagagaataactaaatgggtgcctgtcacaggtttgtactaatgtattttcagctgaatcaggaatgagttactgaaactcaaaaccttgaatcgtgcgagcacggtgaaatgtcaatttaatacatgttgaaacattcagaaatctttgtgttgactgtaagttctcactgtaagtccccagtgctccctcgtctttgaagattgtgaatccaacactggactctctcactttggaatgggatccaccgagccacccgaatggcattttgacagagtacaccttaaagtatcagccaagtaagctgttgggaggaagagaaggggaaatatgtttttttattttatttattattttaattgacaaataattatacctcctcatggggtacgtagtgatgtttcgatacatatagtgatcagatcaggggaattcgcatattcatcttctcaaatatttatcatttatttgtgttggaaacatttaatatcctccctctagctgtgtaaggaacaccagaacttagtctttgtatctagctatcattttgtatcatatatatatatacacacgtatatatatatatacgtgtatatatatatacacgtatatatatacacgtatatacatatatatatatatatatatatatatatatatatatttgagatggagtctcgctctgtcacccaggctggagtgcagtggtgagatcttggctcactgcaagctccacctcccgagttcacaccattctcctccgtcagcctcccgagtagctgggactacagacgcccaccaccatgcccggcaaattttttgtatttttagtagagacggggtttcaccatgttagccaggatggtcttgatctcctgacctcgtgatctgcccacctcagcctcccaaagtgctgggattacaggcgtgagccactgcgcccagccttccctttaactgatatctccctatctcgtcttccctctgtccttcctttatttctgggatcctgtgttctactttttacttctgtgacatgaactttttttagctttcacctatgagtgagaacatgtggtgtttaacttaactgttatcaaaaaatacaagctagtttttctttatatctgtagaatatatacatataacttcaagtgttgtttcagaaagaacttcaaatcttactttttaaagaaaaatgatgtctatgttattaaaaattaagtaatctgtagaataatacagacctttaggagtggggtttaggtgagtcctgtcattaaatcacatatgcattttctacaaatagaaaatggttcctttggcaaaagtcctctgaagaaaaatgtttggggttatttaacaatacaactccacctgcaagaacacaggggaaaaaattctattgtgattcaaccacaacattcttctagtttattagccaatagagaacatactacccccttgtgatatatgatatgaaatgatatgatacgatatgatagaacatagcataggagctgttaaaaggttatcacttagttatgctggggaaagagtgagtgggattataaaagtcaatgtaagccaggttgaacatttttagttgacgtatttatttataatagtattcctatagcagttaatggagaatgcacttgttcattatttcttattgacagttaacagcacacatgaattaggccctctggtagatttgaaaattcctgccaacaagacacggtggactttaaaaaatttaaatttcagcactcgatataagttttatttctatgcacaaacatcagcaggatcaggaagtcaaattacagaggaagcagtaacaactgtggatgaaggtaagatgggtatgtataaaatccatataattataagcatcatgaaataaaaatctttaagtttatgctttttccttcttgctatggaacgtctgtcttacctgattaacgcaaacacttatttgtaatttctcattctgatatataatcagctatttagttcatattggactgatatttttcaactccatgtgaaactttcttaaacttacattaaaatcttggtgtgggagtgagtaagcataatatttgccacacttgaatttgaagttcaggggaatgttgtttcccgtttacaactttatatattatatatattcatgcacaaacatacatatgtacacatacacataatacacacatatgcatacacagacatacacatctatatacacacaaatatatgtaattcgagttctggtcctgatttactggaaaaaattttctagttcacatatcaatttacattttctagcaaggaaatcgaaacagttattaaagagtgcatttattttgtgtttgagcaaaagattttgcattttggtatgtacaaagaaagcaaaatagcccattatggtatttagaaaaggaattaacacttcttttcatactttaaaaagttattctgaaatcttgagattcaatgaaaattatcaaaaatattataaaaggttttctagttttgcatgtctctaaattgtagagttgcttaaggattattcatttgactatctttgatagcataaaaaattgacaatttctatccaaaaattggtttgaaatatcctaagccttcatacataatcaacaagtacgaataatgcaccttaagtaatgtgtttgaatactgggtattcaaactgggtatcctgataaaatgttggtactggatttgaatactagataagtttggggacaccaacatatctttgtcccctatacctgatgtggtacacttcattcttcttgcatgctttagcattttaataagtgtttttgtatcgctatacatgctcatgggtgtgttacatctaactatatagtgtcctatttctgtttcccttcattaaagctggtattcttccacctgatgtaggtgcaggcaaaggtaaaataattcatctgcatgactttatacatgtgtgaaatttgcaatgtgaaacatggggaagtgcagcatgggtaaaacagagaaaatatgctttgaaccaccaaaagaagagaagatctcatccaatcttggctttaaaattaatttctagtcctttctttacaagtagaaagccacatattgaattctcaaaaaattttttcttgagacttatccctggtacaaatcctaatcttagcttctaatactatgattttggctggatcagacaggaccaaaactgtgtatttgtcacagatcctctatatggccatgccacattatttggggttcagaaatattagccctgtgatgaaaacagcctggtagaaatcagatcaaccaagcttcctgttctattctgatttagctgctctccttgtagacacagtgtacactcggctgccattgcacaaaaccgtccatttggaattacagcgtagcaatgccctccaactggtttgggactaagtctccccgagcttagggtcccctgcaagtgagtcttccaggtgacccatatgctcttctcaaatgtgttatcccacccatcctgtcttcacccagctgcctaagtctcttcctcctgagtaatagccaacaatccacaatggattttgttctcctttatttctgacagctctctgggtcagaaagatttgttgggagaatggtgcttgaataagttgtaatatgtcttccattagtggcaatgccaaagatgccccagtctttgacccctggctgctggttgaccagtcagctttttagagagcagtggagtacctgccactgggcactgttttcacgtggcatgcccatggtcaggggctttcgcacatcaggtgagtataaacaggaatgaagaaaaggaagaccaagagaaaaatgtgctttgccctatgttattcaactcctgtgagcttagacttgatagatttattctatttgcttagaaatttgcttatattcagagctttggtaaattacaaaatatcgatcagatagattttggagttattgaataaggactgtagccattttcagtaatcttaagagtattatatttgtgtttttagccttgacgaagttgtaaaaattcaaaatttctatatcacagagcgatgtaaacttacttctatttatttgtatacttccttcctatgataattagatatcaattaaaatcattagtagttttacaataatatattgctttataacttcaattggagcatttcactaaaagcctggccttgtttcctatgcagtggacatgtcactgtggctgtgcctagagctgatagcagagaaattgtgcttcagcaggactgtctgtgaagcaagtctgaattctcagtggacttgtcacgttagaagtagatatgcactccactggaaaaacatcacccctctgtttttaataaattaaaactaaattctatatttaaagagttttggttttaccatttgatgttactaatttgaattgtgagctacttatgattagagagacaagcaaaaatggagtgtctgaaagttcattaagcccccagtattaaaatctgatggatcttagataagaaaagaatagcgtttaaataagggggaaaaaagctaactctgaccttaattttaatatggtttattttaatagtatagcagtagttaagtatggcttacataagaggatattttgccagtaagactttaaactgctcaagcataatttgtgatcctgggttttccttccttaaaaatacttctttttttcaatctgaaaatgaattctatcctcttcactatttcccttctccatatggaatttaactgctctgtgacaggagaaaaattgaagttctccactatcctcccaaattttaattttttaaatgtatcttttacatttttatttaaatcaggacaatagggaataaataagagatgaataaagaggaaacatgtgatatccttagctatagaagcatcaatatggccgggcgtggtggctcacacctgtaatcccaacagtttgggaggctgaggcgggcagatcacatgaggtcaggagttcaagaccagcctggccagcatgatgaaaccccatctctactaaaaatataaaaattagctgggcgtgttgttgggcgcctgtaatcccagctactcaggaggctgaggcaggaaaactgtttgaactcaggaggtagaggttgcagtgagctgagattgcaccattgcactccagcctgggcaacgagcaaaactccatctcaaaaaaaaaaaaaaaaaatcaacatctcataagattttattatgaattatgatttcatgaaaagtggttttaattcatttctggtcaaagaggggaaaagaaatgcatctgagtttacatttttaaactttcttacagattttaagagatgttaatgaaacctaagttttcaaatgtataattacaaaaggattataaacctgaaggaaaacccaggataattcaattaactatatgatgccatactaacccttcttcttaccattctcctcaagataattacatacgcgagacctttgagtcatttatttttgtccttttctttgttggattaaagctctcaatatttgtgtaggaattatagttgattggcatattttttcaatttctatgtctctttaaatgaggctgggtgtggtggctcatgcctgtaatcccagcactttgggaagctgaggcaggcagatcacttgaggtcaggaattcgagaccagcctggccaacatggtgaaaccccatctctactaaaaataccaaaattagccaggcgtggtagtacacacctgtagtcctagctgcccgggaggcggaggcaggagaattgttttaacccaggaggcagaggctgcagtgagctggaggctgcactgagccaagattgcaccactgcaccccagcctgggcgacagaacgagactccatttcataaataaataaataaataaataaatgatttcagggtctggaattctaggaagtagactgtgaaggcatgtatagaaatgaaccaaaaatgtgcaggctcaaaaagatttatgttcccagtattgctgatgatccacaatgccatatccattgcatgtaatctggcgctctgaggaccaagcatcaaaatacttttatagggtaattagttggaatacagaaacagggataaactaactggcaaagcaggaatctgcattcttgacctaacttgcagcctactatggtcaaccaattaggagtgagcagagaagagcattgaggatcagctagtggtgaatcccttctgtgatctgactctcactacattattttactaaagaaccagtaaataaaaaataaaattccttttttggcctatacgaaaacaaaacaagacatctagaagcatagaagtttcaatcagttcaacagtgaatgtctctctggcacataaaatgcacccgtgtttgtttaagaagctgtgtataaagacagtaagacaaaccctggccttgacatgcttgaaatctggcaggtaagaccaacgtatagaaagagtaataaattaatgctaaactagaaattggagcaaaatgttatctgaatatagaggtgtgaaccattttttttgccaagcaggatcaggaaaagcttcacaaagaaaataatattgaactgggccttgaagcccagtttttgttttatttttgtcagatgagtcagggagttgcagtgtgtaaagtcttggtaggggtcataagcacatggcgtttgaaaacataccggatgtctgggttataccaagcggtccacttaggctgacttgtagagagtgtgtggaaaagagaagaccctgagatgggactggagcagtgggcggggccagatggtaacagctctgaagggccatgaatgctttgctaaggaatttgtatttacctgtaggcagagttttaaacagagaagtggctagataagagttgtagtttcagcagctaaaatgtaggtaactacactggcggtatctacagaggaagacttacagttgggcgaggcacaccggaagcagcccgttgggaaagcccagagaaaggggacactacagctcccttgtatggtacaacataggtgctctgtgagtgagaaggtggatgagtggggattaaaaggaaggagagttcgaattccctatggtaaaagtggctaaacagcatgccttaggaaattgtggtatcttttctgggtatctttaagaataagctaaatgcaaatttccagtgtataatactttattattaactataattagtaatataatgctgtacattagatctctagaacttgttcatcttataactgaaagtttgtaccctttgaccaacatctcccatttccccaacccccaccccacctctagcccctggcaaccactattctacactcgttctctaagtacgacttttttagattccacatgtgaaccccgaaaatctgagacaggtttcagttaatttagaaagtttatttgcccaggttgagaacatatgcccgtgacatacccatagctcaggagaccctgaagacatgtgcccaaggtggccagagcacagtttggttttatacactttagggagttatgacacatcaatcaacacatgtgagatgaacattggtttggtctggaaaggagggacaactcgaagcagggagtttctaggtcataggtaggtgagagacaaacggttgcattctttttgagtttctgatgagactctccgaaggaggcaatcagatacgcatttatctcagtgagcagagggatgactttgaaaagaatgggaggcaggtttgtcctaagcagttcccagattgacttttccctttagcttagtgattctggggcccaaagatttattttcctttcacacacatttaagtgagatcacgcaatatttgcctttctgtgtctggattattttacttagcatagtatcctccaggttcatccatgttgttgcaaatggcaggatttcctttttttttaaagtcggaataatattccattgtgtaaatatatatatatatggtaatttctttatccattcatctgtcaatggatatttaggttgttttcatgtcttgactattgtgaataatgctgcaatgaatttaggagagtcgatactcgtagagataatgatttcatttcaataaaactagaaacaaaataataataatgaacagtttagagaagaaactctgagaagggagcacccatagaaaccaatgtaaaatataagaagaaactaaatgcttttccgttagaagtattttgctcttctgttagtaaatgctcttgtgttagaagtattatgtttctgccttgaacatcttccatattactccaagattaaattcctgtttcaatattccaaaattttttaagaaaattaatgtttttcctgggttgccattgatgttttacacatgtgtgcatatttactgtcattgattgatcatattcctattattttacctataagaagaaaatctcggaaaactaaaattaattaggtccacagaaggactctgcataattcagtaatcagttttgccctctgctgtttccccatgcttagcacaaagagatacaaaatttgcatgtgttgttgaattatatttcagaagtcaaaagcattatttaactgctttaatatctttcttttcttaattctaagaaatgtaattttattacatttatttgaacaaaggtctttagcgtctacattttataaacatatcttagaatataattttagtgtcttggtaaacctattgatgctgtctgattgactatcctagtaaattttatgtgagataataaattgatcttcttttttaactacccaaattaacacatctgtaaatgtttcatttttagtttaagctattgaggtaggactgatagaattgcctgcctcaggtattcaaataacattttttaatgactttagatgttgtctttacccagtagcaaacatgtagcatcatctggtctccataatttggatttttaagaagctatttaggttgcactatgatttttcagaaaatgctttgtaacaaacagttaacaggtaagattgtcttgctctctaggaaatgttacatgaaatagtttttactccttttatttattctttcttaacttctgatagaacacatctggaaattccttttgcagcttctcttccaacatacccttaccatccatcattctctaaagcaggggtttcttacctggggtccctgagtttcccagtgatactcaaagaagtctgttttttaaaacagatcaaaaacgctgttcaaaggggcattctctgtcacaccaacacagattttttaaagacctgcattgagatgacaaataggtttgaaaagtagccacatagtattgggttttaccttggcgtctctgacattccatgatgacgtctgtccctgggattgttcagcaatccccctctccatcacactttagtaaatgaagacggtgacatttcccgggactgtatctaatggacaacagttaacattgttcagaacccatataatagaactcacaaattttaatattatgcgtcattatttctgattattaatttcctagtgctgaatttaagaaacaaaaacctttctgtaatgaaagcaaagcatgagtgaaccctaaattgtagcagtaaattctatttaattctatttgcacaatttcagagtatttaaacttattttatattcgtgtgtatggtgttgcaatatgattgtttgttttatttttctattgtatgtttagttcaagcagtaaatcccaggatcagcaatcttactgctgcagctgctgagacctatgccaatatcagttgggaatatgagggaccagagcatgtgaacttttatgttgaatatggtgtagcaggcagtaagaaacaatttcattacccgatttttaatttgggggatgcattttttaaaagattaaaaacattcttaagaatttactacggatcatcttgaaaaataacttgatccaattaaatgaatgagttatctaaaaaaattatagtgaaccatcagcctaccacatattatatgcacgactaggaattgcttttttatgttattaataacagagggcatatgttccattacgtatgttattttcatatcatagtacttgaaactagttctgtgcccacaacacataaacaagagtaagaaggaataattatatttgcaagtacaatagaaaagaagaaaaggtttttttttcaaattggatcttgaagtaacagaaatcaaactgacttgaaagtattcattttgccctgactagcccaacagaattttataagaaaccgcagaaaattaatactttgggagagcattcattatgttttaacgtttgatgtattctcaagtcaggcactcttcgtagatcctggccacatctactgggagatggggcagctttcactttcagcagtttatgaaaagccagtacccccctcctaagtgcagtgtgcttacatagaacaaatgaggtggccaataaatgtttgtgacaaaatgttgaacagagtccaactttctgtttaagcctttatcatgcaagtaaatgtttttagaaatgacgatccctttagaaaaaccggtacttgggaaaggttgaatcgattaattggatacgttggaaggcatttaagtttactaaaagattcatcttgtgaatcataaaaaaacaattcttcccatagttcacttaagctaattaatgtgtatcagttcttttgagaaacatctttagagaaactcaacagtttcataaggcaaggtgcagataaagaaccttcctttgtattaaagaggagaattaatacaatgggaatatatacaattaataaacaagctagatacccagtctatttttctttgaggatattttcctgtaggtcattttaattgatttgtttgacatgactacatttataataatctaaaatggtaaacctaagcatcctacatcttgtctttagcttataaagaattttcctttcttgaagcattaagtgacttctggtcccttaaaatattcaaatgtgttgtttttgcaaaatttccataggcaaagaagaatggagaaaagaaattgtaaatggttctcggagcttctttgggttaaagggtctaatgccaggaacagcatacaaagttcgagttggtgctgtgggggactctggttttgtgagttcagaggatgtgtttgagacaggcccaggtgaggctcacaccacacctgttctggctcccgctcagaggtggaggccgccaggtgctccagctggagatgggggctggtggagctgtgttatgggtagggcatgaatgtctttctatggggccctgttgggttgggagttttggtttttgtctttggttctttatatcaaatgaattacggaatttagcaaatcatctagccacattattaccaaaaaccatcagaaaaatagacttaaatatgattttaacttatattatttaaagaattcaattgttcatatcacatgtataaactttccctcagtgttaaactgaaattttttaagtgcttttgaagatgaaagaacttataagaaagtcacaattctggccgggcgcggtagctcacgcctgtaatcctagcacttagggaggccgaggcaggcggatcacctgaggtcaggagttcgagaccagcctggccaacatgatgaaaccccgtctctactaaaaatacaataattagctgggcatggtggtgggcgcctgtaatcccagctactcaggaggctgaggcaggagaatcacttgaacccgggaggcagaggttgcggtgagccaagattgcgccattgctctctagcctgggtgacagagtaagactccgtctcaaaaaaaaaaaaaaaaagaaaagaaagaaagtcacaattctttatttcaaaatggcctacaacccagcagaaccctgcagtcagcttagacaactgatacagatattattacatttgtatggaacaagaacttgtacaattcatatgctacattttttatcacaccaaattttactgcctgtatatatttacttatgtgaatattaacaaaatatgcaagtaaaaagtgaagtttctaaaataaagaaaaatgttcatgtgaaacatgagagcattcgtatttgctcgctagatggagaacaatccctgcttacttacatttcaacaagagttgtttgtggtacatgttcactctgtggttcatacccccatgttattttcattcactccatgcattcttaaagaaatgtgcatatcctgtagaatacattacacaatgtattttttgtgactttcattaacaaagcattatgatttttaaagtcagtttttacaatttagaaaaatataaatcataagtggtttttaaaaagaaacaacaataatgtattaaactatattttaaagatattcatttgctaaaatcataatgttttaagaaaaccacacattttattctgttctttgtatttcatatccatttatgtatatagtcctgggaaaccagtgtgttaagcttaaaaggggaatatctaatcaattcatagctagtttacaaggtttttgtttgttattgataacttttattttcaaaatactaaaagtcaagtagatattatcttcatatatagctggaatgctaataatagtaatgggactagcatttagtcagctctcctatacagcaggaagtggttttctcattcagtccttacaacaatcctatgatgtaggcaccattattactccacttacccctcaagtcagagaggtcgagtacctgccaggtcgcccagtaggaacgtgacagagctgggattagaagcttgtcgttccatctccagaagaaaggcctcactatacccccactgcagggtcacaaaggtccacaggccaaggaggacaggctgtctcagaaagggcagcttcggtcaacacttggtatatccaatcagtgattctggacccctgcaggctgcatgtggttactggctctggattatttatgaagaatctactatgtataaaaatgacctgttgttaaaattgttagaaatgtttaggaaaggaaaaagtgactttatccaaagttagattcaccctcaaaatcaagttgtagcatttgttgtccttctataggacaaaagacaactcctttagaaaattatttttcactcagcagtgtaatgcctacagttccagcagcaactgccagatagtttgaggtgaggaatcgtgataggtgggccttcttgtgtgccagtgatggagagacaggacaaggtcacaaccagttcttgtcactttttacatataaatgtattaaaaagaacaaatattgattcacctctagtgaccttagttaacacatcgcctgtaagagcaaatgctgccagcattctagaatgcctcagtttaccattacgctgcctcccttttcccagttcacaatgcttcatcctttggggctgctgggttaactccagtgtgaaagcaccgtcttccactgcccctgctcctgctcctgctcctcctctcctctcctctcctctcctctcctcccgctgggttccgcggtgtaaggatgtcaatatttggcatgaaagcctatcgttggctaatttttaaactctgcattcatgatctacttctctctctttctctgatttctgctaattttaggacactggactcaactttatctatagttatttcatcaatcttcctaccattacaccatctctcccttttataccctggatttctaaggtatatttcttaatttttttcctatggcacaaactgaaaaacagacgagataggcggtgtcctgatgctgcgcttcttccccgtactactggtatgacctctcattaccccaccccacctggtatgacctctcactaccccaccccacctggtatgacctctcattaccccaccccacccggtatgacctctcattaccgccaccccacccggtatgacctctcattaccccaccccacccggtatgacctctcactaccccaccccacctggtatgacctctcattaccgccaccccacccggtatgacctctcactaccccaccccacccggtatgacctctcattaccgccaccccacccggtatgacctctcattaccgccaccccacccggtatgacctctcattaccgccaccccacccggtatgacctctcattaccgccaccccacccggtatgacctctcattaccgccaccccacctggtatgactgctcattagcgccactccctgcccccgtttgacctctctttagtgccaccccatctggtatgaccagacgtgacctctcattaatgccatccacctccccttcctcttttacctctgtccctcaattacccagtctttcttatcatcacaaaggatttaaaacagatttgttttcacgaggcccaacagcttttttgtcagttgtctccaaactttggttaaggtcacattttgctcttcctaaacacatctaagcgtttgatgtctaagcatttgaacaggacattttcatccatagtgcattcttcataaatagtagagaacaaataaccatttccctcaccctgtctctcttctgtgttgattctatggttctgaggactcaagagcattttcctcagagacctcctaccacagagcacagatatccatgacagcaagcaacgccagagcagaagactgttgtaaagctgacttccagaaaacaaagcaaatctcattctcctgccatattttctgttttcatgttctttatatgtgtttaatttatcattttgtggattactcaaataatacatgaatataattttattgttaaaaaaaatcaagtaatgaagattctcttttactccgctacccagcccttcaatgggtgatatccacccactgaaactgattctagaaggaaaactcccataggtttaattctctctctgtggggtatatgtgtgtgtatgcgcatgtgtgtgtatgtgtgtgtgatgcatgatcatggttatggcttggatttgtatgtcccaggtgattttagattgtcctgaaaaggcttcatgcctattttaatcattctggaatttaaatcttttcttttatggatggaaagtcaatagaaatttttattccatttacacagtttctgttttatatcaatttctggtgtacttgtgtgtgtgtgaatgtgactgtgtgtgtgcacacatgcacctattaccatattgtgtctgcctattttaaataatagggcagtgaaatattcgatacttttttctttagacacagaggcagaaattcaaagtcagtgaatgtggatgtttgtgtaccacccatcaaacatccatccagtttttccatggttgcatagcagcaaactgccagtcagtagttcgattttggcagtcaccatccttgtagaacaatatctctgctagtacctgagtatcttgtttttccctttttagttgcatttaattagatgaaaaatgtaaatgctgaatgtatttatgacaaggctgtaaatcagcacactgaaaacaagaactatagtcaaatgcttaagagacttaatgccatttggtttttggttcagttttgaagaaaaagcacagaccaggcattaattgaaagaaatatgttgccaaagaggatgtaatgatggacttttaatacctttttgcctgtctcagaataggaagtgcctatagcattttattctttaacttaagatttttgcagatttggtatctggattgtttttaggaatgcattacagcagtataatataatggctagtagcatattttctggagtcagacacaggttgctccaactcttgggcaagttcttaaccttctctgggcatggatttatttctgatgcctacctcagagaattgttgtaaagattaaatgagatgtgccttcagcacagtgcctagcctatggtaagggtccaaaactgttagccatcagtgctattaccattgtcctcatcttcatcatcatgactatggtatgtgtatggaaaggggaaactgcctaaactgatgctttacttgtgtgtggctatgatacagctcaaaacttctctaataaggcacgagggcctattgggaaaaggctaccagcctttgacttgtatttcaaataaggtatttttgcttctcattttatttcttctacatatgtccatattttttttaaccttcctcttcacacttgatttttagcatttcctttttctccctaaactttgtatggagaaaaagaggcaatgagatgctatttttgcaacattagctgaacctgggatatgcgtagtcatgtttatttctgcatccagagatcacacacacctaactcaactgtgtaaaatatattcggaagaaattcagtcaaattaaaagcatgatataagcatgcttatagagtcaaaagaagaaaatgttttatcttgattatggtcaaaagagagaaaataaaggtcttttaaaaaagaatttatactagttaattaagcaaatctgcatgggcatgtctgaatagccattgatgctgcactttttcccataagattgatactttaaaataatacccgaaatgctcattattctgtggttttcttagaaattttgcatattatgactgatggaataaggggtttcacatttattaaacagaatagatgcaaactgaaaggatatgtatacacctaagtgagtactttcttttcaaactggtcatgtaggcaaataatgagttcactgactgagagatattccggtcttttgaatggatccttagcaataacgaatattgattctttgagggtggatttggtttttcagaaatttccactcagaaccaactcttgtgaatgagatgaataacaaatctaagtaatattttgggtgcaaattgagatgttatataaaacaatatggctgttttcctgatctggaaaggtttcttgtgtggaccgttttcttttttaacagatttctaaaaaatactgaaaatggcaacagccttgcaaggacagtttagcctctaaaagcagttcctttgaagagaaaatactcaattagatgtatacattctgttctgtttaaaactcagttttgtatttttctcattatacttaatgtaaaatgtatcctgttaacagtgaatactttaattggtttgggaatttgtttttattgagaatatatagtgaaaataactgtgaacacagtgttcaccaggggtttttagcatttaatgtgatgattattcagatttctctacttgaattttttaatgaatgaagatttttcaaagttaattattcatataattcctgattaataattgacagatcctaatttggggccacatgtaaaatatatgaaagctcacataacgtggcaattttttactctgagagactgcagcagttcccatctccccttaacctattgccaccaacaccattgatttgttttccagcgatggcaagccggcaggtggatattgcaactcagggctggttcattggtctgatgtgtgctgttgctctccttatcttaattttgctgattgtttgcttcatcagaagaaacaagggtggtaaatatccaggtaagaaagaaagattaaaattgctttataatgctacataataatccattaaactaaaaagatcatgggggaaatcatgtagattgtaatattttgtcttcccagagccatgagtttggactttctcttcaaatgacttttgatccctttttatataatggcaatctaaacattgtcaatgatcataaggcatttggaggagtaaatcaatcagttctctgaaaacattagtgagcctactttcttagactccacataagttatggatgctgaagtaacacctaaaaccaactggcaaggagagagttgcagggaaggttcatggagtttttcaaaggaagtaatgcatgaactaagtcttcatattgtgatgtgtaacattgctttccctataaggtaatggtttattcaatttagtgggcccattaaatttatattttctttacctgaccattttcccttcagtgacaagaaaaaaaaaatctgtgagagaatactcttacaaaaacaatttgcaaccattaatatagttaacaaatagattggtaaaatagggggaaatcttagaaacttaaaaattatttatcaggtgagaaactagtcaactttatgtgttaaaaaatgtacattctattgggttgcctcaaaaataactaaaataccaaaatatatgcatggccaccatatatatggttatacaacatctacttgtgtatggaattatttttcactgctgtatatctcaaagaatgctttcatggactttgaataagaaagaacaggatcaacagataataataccattttggcattttttagttaaagaaaaggaagatgcccatgctgaccctgaaatccagcctatgaaggaagatgatgggacatttggagaatacaggtgagcccctgcttctctgctcttcatcttctctgcccacatgaacacagtcccgagaatagaactcagccagaatatgctctgcctggcatctcatattttcctcaaatagaagtttagggatacttccatgtatcagtgtttacatgtccctcatggtcaaacattttcatttttcattgaaaaactaaattttgattttagtcataattttggagatggaatgtctcccactttgtcatattttccatgggaccatgctgtattgatcaatctagcaaagccaatatgctactatgagcattaaaacaacaaaaaagaacctccaatgcctgcattgtaaagaaagctatacttgttatcttctaaacatgctgtaataaaaccagtgtaaacacactttttcatctagaatttgaaactagttttcctaaacaatacccatacccttgccctttaatcatgaaatggtgactagattgttttacaagctgttacttattaagaaatgtcgtagccctctaggcaatgtgttactcacagaactttgataatacattcttggcttgactccatcattaagggaaaatgttaatataacctatgtgctaaattttttaaaaatcttctctttaaacaaagataaatcttttcaagagaaggaaaagattactttagatttgtttaaattaaacagaaacaaagtacgtatttatttaaataaaatgtgggcattctgttattctaaaagtatacctttttaaaataccttttgtaccttgtttttttctttttagaagccccttgcttatataaaataccttttaaatatgcattaagcccattttgagacattgtttgcaagatgaagaggcttttaggtgaaataaaatatttcactattgggattaccaggcaacatttgtagagaagatatttatgttaagttttacctgtctctagagctcatttttggtttttccatgtcactatcatgtcaatatcatagaatttcatgtgacataatcctaaggataaaaaatgtagaactgattgagaaaaagacatatattttcaataaaatcattttcatatcattttccaggcagatacctgtgtttttcctttattatctcagcccctaagtttttatattgtgatctcttaaagagagataactatggtttcaaaaagttctcagaatttctgtatctcatggtacagaaaaatgcatagtgagggttgtcttgatgtcagaagttggttctggagctgaaggtgtatgaaaacctcatgcagcgtccacacccagttcacccaagagggttttgtaacacattagagcagcctacagaagcccgtagcctagggcatctggatgagtagaactttgctgaaataattcacccttctacatgtttctcctgtaaagcaggtaagcttacaattactaaataacttcttatttctaagagttcttgtggctgtaattatctacaggatatgcataccactcccttatgtattgtgatgaagcaaaatctttaatgtggccctgaaaaaaaatgtatttgcatgaattggaaataaagcattgtccttcatacattctccacatggtgatgggttcctgttctacattatcatgcctcagtgaatctagcaacatactactcaccacctgggtctcaaacatcagcttgctcttacagcgatgtgaaaccatgatctgaggtcatgtgactttcccagataactgctgcctactccattaaaacttgactaaaatcaaggttgatatttgggtgatggtatactggaagcccaaaccccaccactatacaatgtatccacgtaacaaacttgcacatgtaccccctggatctgttctaaaaaatggaggttgagttttatgaactagcttggaatcaaaagactgttagttttactttcaactcagccattgcctgtgattcatagttctatgatttctgttttcttctatgagccatctactaacaactttaatagaattttgtgtctggagtagtacgtggcaagtatttggttactggcctcataagcactgtgtttacatctatttggtcatatgtctttgtcttagtgttaatttatatgtgctatgttggtaaagtgttttcaaatagctgtctttaggccttagtttctcaggaaagaaagactttgcatttgggcttcttgagtgcaaacccaattgacacgaagacaaaaacacttgtacatttgtcatacatgtaatgacataaacttgggaggtgctaagggaaataaggttctgatgggtgtcttcaacttgaaacataactcaatgatgtaattttttcaatgaaactaaaagttcataaggacaatcccacaagcaaaatcacttccccaaaattccaaccacattttttactttgatttacaaagatacggctttgtcctttgatttcctgacactacctcagaatgttttccctttggtttattttctatttgaagaaatccaaaaagtgtttattatcttagaggctgtaattaatgaaaacagttccaactgtttattaacagaatcttttatttttaatacatttaagtgtcattcacttcctgagatcaccaggttcctgtctctgttttgcactttctggaagttttgagctctgtattatttattgattcttattctctttcattccaaaaataaattattatgctgaccagacacatacaaaattaggactattgcctaggtgtaaattaattccatttctgatttgctcattctccagtttgatgatgaaaccgtttctacatggctggctctaagccagatgatatttcatagtgcaaagagggatagaacctcactggtggccaaatgtgattatatgctataaccctgtgcccctactctgacacccacccccaagcagttaccctctgttggaagcctgcagctttctttgtttgtttctttaattatacagacagtaggatctgcatccttactagcatatagaaaaatcagagaaacaatgcaaccaagagtgtaagtatttttttattctttagatccattttccttaaaaccagaataaacctaggtcataaaccatatgcccatgttacttgaactcataacttactacataattggtggctcttgccacatgaatcttgtcattcatgtgaacatgggcttgtggcaagcatgctaacccatgctcataaggcttgaatgatgccaagatgtgtcacattcgttatatacattagagttattttgctctcaaatgtgaactggcttgtgagtaaaataataatggacttttagcgagtgggtaggaaagagtatttgggtcatgaatgttacttgagctgcaatgtggtttggccatgggagggtggtaacaacaggaaaatcagacagaattatcacagatttacctgctgttgccgaattttactcagtaggatttaacagatgtgcacacttctgaacaaagtgctattgaaaaacaatttgaactccctaaaaatttattcttagggaaagagaaaggaaaggatatattccaatgatttgtctgctgtcataaaactgagggaatgaaatgttttatgttagaatttttaaaaaaattttctaaaatgcccactgtctcctctattattttacagtgaactcattctgccagtatttatgagtgcctactgtatgccaggccttgggaatattcaaaccaatagaatttggtcccacacagggagtttatagcctagtgatggatgcagggaagtaaaagaacaatgaccagagtgtgaaaagtgctatgaaagagatataactaaggtaccaagggaacagaagcaggaaggtaaagccaggtgggcagcataggaggaggatggtacagggagtcttcccaggggaagtcatgcagttttagcattgtgataggaacatttctttccactgcacaatgatcctgattcatgaatctaagtatcaagaatatacttgatattgtatcaatacttgtatactggatactttgtaggtgcatatatatatatgccagcactgtgaatatgatttatataatatgtatatattttattttgaaatccattcaacctttgacatccaaaactaataattaatgtctgatacacaccatccttaaactttctcattaaaatgtgaatgaatttttacctgttttgtaaagctttgaatactactgctgcctactccattaaaacttgattaaaatcaaggtctgctatatgtgtgtgtgtgtgtgtgtgtgtgtgtgtgtgtatgtatgtatatatatatatatatgacttttaaatcatcttctatgacttcttgattcatatcatttgggaaactctcctttcatatttaaacttgacatggcaacttcactgaatacaatgtcaaaaagttatttactatttcattacaaaattcatcttggaattgaaaaaggcaagccctcatactgtgcttctcatagagtcataaccactcactacacctggaaagttccgcgtgtgtgttgcacaaggtatttcttaggaaaaaaaaatctctctgaagtagggacctggagtggagagaagagatgtgatgggagatggacatgtatgcttgttgaacacaaacccagcactgtgtgtatgacttatataattttttctcatttaaccggattctaattattgaagtatatgatattatatcacaccacttattaaagactggtcttcaaaagatctcactgcctttgaatggcttttcctggaaagactctgttggaggagggagaatcccacttccttctcttctttcaagcacagcccgtgttgctgttgattctctcctccaccacagccgttaagctggcgtgaatggatgttttgggggagccccttcttggctggtcattaatgataactgttatgattttgtatgtaaaaacccacatgaatcaacaagcaaatattataataagagagtttagtaatgttgctcgacacaaaattaacataaaagtcttatatttctatgtatcagcaagcaattggaaaataagactttaaaacttattctagttatgatagcataaaaatatgacataggaataaagctaacaaaaagatcttccaccagtttcaagaccctatattccattccattggtcaatctgtctatctctgcaccaagactataatgtcttaataatataggttttaataagtcttgatatctgctaggtccagttctctaactttagttgtcttcttcaagaaccttttaaatattcttagcccttttcatttatttgtacatcatagaatcagcctgccaagatccacataaaaacctgctgagctgttactggaaataaattgcagctaaagggcaatatggggaaggttaacatatttactatatttgagtcttctatccatggatgtagaacattcctccattcattcagatcttctttaataactctgaaagttttattttcttcggaggtcttacacatatttttgttggatttgtctttatatacttcatgtttatggtctcataaatggaataatattttgaattttatttcctaattttttgcaagaacataagtagaattgacttttatgctaatcttgtatcaagcaacattattaaaatctctttatattctaacatttacctgtagattcttctggattttttatatgcacaatcatatcagttatgaataatgatagcttcctttcatctatttctttttcttatcaagttgcttaggacttttaattcagttttgattagaagtggtgatagcagccatcattattattatttctgatttcaaacaaagttttcagtgttcaccattaaggatgatgtttactttaggtttcttgttgctacccttaatcaggttaatgaagatacattctattcctaatgttaggaataaaaatacattctattcctaatgtttttatcatgaatgggtgttgagttttttcatatacctctttctaaatttactgagattatcatatttctattttcttctgctaaaataatgaattatatgaattgatgttttaatgctaaaataagcctgcattcttggaataaacccaacctggatatgaaatattatctttttcatagattgctaaatttggtttggtcatggtttgtttggggttttttcatctatgttcatgaatgagattagcctgtagtttgactttcttaaagcgttcttattggttttggatatcaatgttatactagcctcaaaaaatgattaaaggagtggttctcatgacatattcaaactttaatatctcaaaatggaaccattgattttcccctcccaacatgctccactccatagtaacagtacttccaagcttcctgttgctcaaaccaaaaatcctggcaccatctttttctctgttattccatatctaacctatcagaaaatcctgttggctctaccttcaaaatatgttcataatctgagcattttataccacctccagtgttccactctggtccaagtcacagtcatctcactcctggattattgtaatattctcccctgactctatagagcagaggttggccaactaaatattttagactttacaggccgcgcggtctctgctgcaactctgcaattctgctattgtagcgctaaagcagccatagacattatgtgataaatgggcgtggcctaattttactgtagtttaccaaccccagccctctaaggtaggctattctcaacactgatggcagagtagtgcttttaaaatataagtcagagcatgtcacttattctttgaaaaccctcccagggcttcctgtctcactcagagttaaaggcagcgtccttacaatgttccacaagccctgatttagccgtgccactccccttacttaactcctacttttctctctctctctctccctccccccagccacaccaagctccttagtgttcctagaacctgccaggcttcccctcaccccgagacatttatactgcttgttactcctgcaggaactgctctccctccaactattcaccttgctaactcaactcttttaaagttgttgaccagatattactgcttgatgaggtcttcctggacatcttattaaatgccagctctccatcccttctccaacaccttctgcagtctttactcagctctatactttgcatagtgctaatcctcttctgacataatatatatgtaattttttttattatgttgattgttaattgtattttcttccactagaaataaagccagtgaggtgagggttttagtctgttttgtttgctgctatattcccagtgccgagaacaatctatcttagagtagtcactcaataaacatttattggatgaaggcatgggtggatagatggctagaccaaagaaatgccacagatgacaaatttccagcagtgtattccttgggacactagttctacagagcagaataagactagtcattggaatccaggtgacaaattctgcctgttattgaactcttcagctgaattaactgtcacactgaaacatgaactatatttcacaagaaggatttaataattaaaccccagagatgttgtgtaggctattttcataacaggttagacactcaatgctatgtcctctgaaatgctcacaaacacagaccaccccaagatgatacctctccagttgtttattagcagtggtgaaaatatagtttattcagtttgcaataagaaattgtgtattactgaaacaggttgttttcagtggcatatgccagtgtcatattatgctagcattatttcccagtcttcagattttcttcttggagaaaaattgaaatccctagtaaaagttattgtgaaaagagccaggatacttgtgcatcttgaaatgtttgtatcttggcttgaaaaaaaaagtcactgtctgaaacagagggagcagtaaagtcttagcagaaattgctagattaaatactgcagccagtgataccttttgtatgttaaggctttttcatttttacattagtaaaaatgtatatgtttcctattttgccttgcatttttgttctttgaaagaaaacaaaatgttagatcctgtcattgcctttttctatttttttcccaaatgttacctattaaaaaataggtcaatatgcataactaggtatttgaccgtatgggtgaacattcaaaaacataatgattactctttgtcttccagaaattgtgcttacgggttcaacagagaaataagcaaaaattgtaataatggaatcttgtaaagtcgtattaaagtacactcctcagattcccatccagtatagtcaggctgcataacacacaaggaagaagggagctggggggttaacatgagtgtaggaagcatttgctattacatgtttggagtcattcacattctttagaatatattggcatgccattcatagtacaaatgtagagcttttaagttaaagtgcgtctctttccagattaataaatctttactcattaactaaaatttttaccaaaaaaacaaaaaaatactgtgtactatcagtataaggattttgcttttcttcttaggctgttttcatttgtttcttctgcatccttttaatggaattttgtaggtctcttgaaaggtaaggttgaagtttacagtctggcctgcattgataacaaaattatttgaaatgcaggattttgcttctccttctggctcagaaaaaaaaaatccacatttcacacttaaccaaaatcatggtccattcacaaccaaggaatcagagatattatgcagtttaacatactaacttctttacttgccataagcttttgcctttttgaattcaaaatagtgatgatttttctacttttctgaattctttcttatttaatgcttgtgattatttctggattgctttcaactcaggaatcagaatttgtcattgaaattaacaaacactattgggagccatccactctactgaagacttcatgattcaaccatttctgctcctgatttccattccaactcatcctcgtcattggagtcaacctgaaaattagatttggccagagaagcccaggactccaaatgctttctcataatttgcatgcatggtctttaaaaacagaaaatgttacctaaatgccaatcttgacaaaaatgttttctctttcttccagtgatgcagaagaccacaagcctttgaaaaaaggaagtcgaactccttcagacaggactgtgaaaaaagaagatagtgacgacagcctagttgactatggagaaggggttaatggccagttcaatgaggatggctcctttattggacaatacagtggtaagaaagagaaagagccggctgaaggaaacgaaagctcagaggcaccttctcctgtcaacgccatgaattcctttgtttaatttttaagctctttgccaatattccatttctctagaatgtttatcctaagcacttgtttgtcagccctctcatactatgaacatatgggtagagagtatattttctgctgtatgttagtattatgagaatagttacagcaaaaacataactcagtcaaatgatatgttaatatgaactggaatgcaaagtgcatactttttcattcaaaatgggtattcttgatttcctcagaactgataaaaaataatgcaacatcaccaacagatcctgttatttcctctgcaggatacagttcaatatgatgcatgaaaaatgctccacatttaaaggacatacccgtgtatgttatgaaaacatggtttgatactttgtttatactaccctcagctgaacccctatatatgaattccgttttcattgtcaagagtgttactgtagtattctctagaacttcaatgtctttgtggacattgttgtgaaattggtgactatgtatagctgtcgttagtctttttgggagactgttaggaacagtttgtacagtatatacttgctaaatgagttcattatgacagtcacattgctgatgcttactgagaactattacctactcttggctcctgttactccgtaggcttcttaatcttccaggcattacagcagcacagtgttctactttttacatcatttctatgttcggttgtttttaggcataaacaatgtgtattgcagtgcatttcggcatttgtgccatactgaaagaatcaaaaacaaatcatccaaattaaatttcaaacattatttcagagaacacagggcaagacacatacagtgccttcagatattaagcattccacaacatcgtgcattctgtatcagctggtccagtccattctgggtcctagattactgtcattgtctaaaagtaacttttaaaaagcagagttcatgaaaactgcaatgctgggaaaagaaggaaacatgaaaataaaaataagacagtttattagaaatagcatttcctcataagcataaaaagaaaatctttgttgccaactgaagcacatgatgattttgtggtcctttatggtttctattacatgcagtaagaaagatgtcaacatgctagaaaattaattttaaaactaagttattccaacactaaaagcatacaacagcatgccaacagtaatatattattctccaagactttacctatgtaagtgttcaaaactctgcagcattaaacaacgtgtatgcaaattgttatggatacatttcagaatctaagaaatcaggcaagtgcttaaaaggccaacggtccaagggattacatctgcagtttaaaaagtaaatatatattctatcgtattcataaacaatatctatcaaatgggttacctccaaatatgaaaatctataacaacctatggttgaaggaatgctcagtttcatttgccaataaattggtttctcataacttgcatcaagtttaattttaagtaaagctttttatatgtagatattttgttgaatttgtaaatacacttaaaatgtagatgctatatgcttataggtgttacatacaaataaacatgcaatgtttatgttgtactgtataagaggtaagctaattaatgcagtgaatgggattggaaagcatctacttaaatatctattgggttcccccctccccccaccttttttgctgtgaaactgaaatagtgaacttttctacgtattgacagcagatttttcgatgaaatcttcagagctttgcctatggggcacagtaggcctagtaacctggcatgtttgatatatgtaggtaaagcataatttaaagtaatcccaggtaaagatggccctaaatactttcatgtctctatattcatttttcacagatccacctgtctcttgaaaatataaaaagacaaaacaggtttgccttggcatcagagagcacaaagattaaaagttactttaaatttgccaatattttgggagaacaataaaactacattttttcctcttccatactggtagatgcgaaatttatctgtgcatgaaagggtcacttctgtaatagtgcaacagatttggtattaaaaattaaatgtggttttaaaagttcctctctcttttgtaatttatgttcccaattgagtgtgaatgtccaagtaatggtgtatgtaatggtacaggcaaatgtgactggatttccctcaaaaaagtaactattaaacagtcttgatctctttgtgacttttaactttttcaaacatatattgcctaatgttttaaaatggtgaaaaattttattttttactttcaaaaggctgttctatgcagagaaaattaaaacaaaatataaaacagatctaataggacatatcaaaaacatttgaatgaaaaacaggactagatattcccagccttttgagaaaagttcaagaaatcaggtggtgcctcctttcccaaagcctggctcctggtgtctgcctgggcccggcgcttctcttctgcttgcctggactctgccctcccgaatcacaggcgacttagatttcttaactctcctgtctgaagagggacactacaggtatcgaatgtatgtcaccctctcccttctctccacccccatgcttctaatcttctcaaaccctctggcaaacagccaagccctggcgtgttcccatgttccaccacctgccccttattctccagccccctagtcccagcatcacactgacaagacctcctgctggctcagagctgccctcctccatggtgatttgcatcacatgttatataagtgaaccttaaagtgctatgtagagcttggtgtttccacctggagggcatgtctgtcactcacttcagaacagcacttcagggcctctcctcccctctacaacgtccgccaaattcacagtccatagctttgtcctcatcatcagtcctggggctctttagcaaaaagggtctggagaaatgcaatcttgaccccaaaaagcattggtccattgatggtatgaactttcttgttcagatggcttacaacaggcctggtttacctctaatggctgattttgttttgttttgagacagagtctcattctctcacccaggctggagagcagaggcactcactgcagcctctgcctcctgggttggttcaagcaattctcgtgtctcagcctcccaagtaactgggattacaggtgtgtgccaccatgcccggctaatttttgtatttttagtagagacaggggttttgccatgttggccaggctggtctcaaactcttgacctcaagtgacctacccaccttggcctcccaaagtgctgggattagaggtatgagccaccgcgccccgcaattttggaaaaggcttatggaggcaagggaaaagaatatgaagaattcttacccaaattaagcaaatccctcccgctcaggaaattttcctacagattaccaccagagggctcccctgctctatgcagtgtgagagaaacctgcttgcaggaaaaagtggcctctggacacagtgcaaaccagttttgataatcagcttgtgatctgatcatgcaaaaaatgattgcctgctgcaacaggggaaaatgggatttgcagctttctctgacgagtccacagcatccagggagcaagcatgtgtccctgtgagccttgttaagcttcttcctcttaatgattgtggcccgggaggttcggtattgggagaggaaggaggagtgtgcctcctgggtcctactaagcatccctatcacggctgcaagtcggtagggatgaggagaggcacgtcattaaaatggcatctccctcttctccagagtatgctattttatctgccaatggtttgatgttttgtgatggtatagcaccccccaaaaaagcacagtttaagcacagctcttttcactaaaaaaaaaaaaaaaaagcaagagagggagagaatactacttgaatatttatactaaataaataaatagttcctaggtggaggtggaaaattcactggaccggaaagagatggggatttgtcatagcaacataaccccaattacttcaggaagcccccaaacctgtgaaattaacctgtgctcgcatctgcgcttgcttacagagaggaaggccggatgccagtaaccatgaagtagctcagcagtactgccccgacctgaattcttgcttcattaccatgctaagacctctgcccaggggccagaaatgta

SEQ ID NO: 12449 - DNA, 146039 bp, Human
  misc_feature (1)...(146039): n = A,T,C or G
aggcaaggaagagcaggtcgcatcttacatggatgacagcaggcaaaaagagagagagcttgtgcagggaaactcctccttttaaaaccatcagatcttgtgagacttattcactatcacaagaacagcatgggaaagatctgcccccatgattcaattacctcccaccgggtccttcccacaacatgtgggaattatgagagtacaattcaagatgagatttgagtggggacatagagccaaaccatattattccacccctggcccctcccaaatttcatgtcctcacatttcaaaaccaatcatgcctttctaacagtcccccaaagtcttaactcatttcagcattaacttaaaagtccacagtccaaattctcatctgagacaaggcaagtccctctgcctatgagcctgtaaaatcaaaagcaagttagttacttcctagatacagtgggggtacagggattgggtaaatacaggcattccaagtgggagaaattggccaaataaaagggctacaggccccatgcaagtccgaaatccagcagggccgtcaaatcttaaagctccaaaatgatctcctttgattccatgtctcacatccaggtcatgctgatacaagaggtggggtcccatggtcttggacagctccgccccctgtggctttgcagggtacagcctccctcccagctgctttcatgggctgttgttgagtgtctgtggcttttccaggcaaaagatgcaagctgtcggtggatctactattctgggggctggaggacagtggccctcttctcacagctctactaggcagtgcccccgaagggactctgtgtgaggtctccgacccaaccccacatttcccttacacactgtacttgcagaggttctctatgagggtcccgcccctgcagcaaacttctgcctggatatccaggagttttcatacatcctctgaaatccaggcataggttcccaaactccaatccttgacttctgtacacttgcaggctcaacacctttgtggaagctgctaaggcttggggcttgcagcccctgaagccatggcccgagctctgtgttggcccctttcagccacagctggagcagctgggatacagggcaccaagcccctaggctgtgcccagcacagggaccctgggcccagcccttgaaacctcctaggtctccaggcctatgatgggaggggctactgtgaagacctctgacatgccctggagacattttttccattgtcttggggattaacattcgtctccttgttgcttatgcaaatttctgcagccagcttgaagttttcctcagaaaatgggattttcttttctgttgcattatcaggctgcaaattttccaaactttcatgttttccttcccttataaaacaatgcctttaacagcacccaagtcacctcttgaatgctttgctgcttagaaatttcttctgccagataccctaaatcatctctctcaagttcaaagttccacaaatctctagggcaggggcaaaatgccaccagtctctttgccgaagcataacaagagtcacctttgctccagttcccaacaagtttcttatttccacctgagaccacatcaacctggactttattgtccatatcactatcagcattttgggcaaagccattcatcaagtctcttggaagttccaaactttcctacattttcccgtcttcttttgagccctccaaactgttccaaccccagcctattacccagttccaaagtcacttccacatttttaggtatcttttcagcagcaccccactcctggtaccaatttactatattagtccattttcatgctgctgataaggacatactcaagactgggaagaaaagaggtttcggtggacttacagatctatgtggctggggaggcctcacaaccatggcagaaggcaaggaggagcaagtcatgtcttacatggataacagcagtcaaagagtgagagagcttgtgcagtggaattcctctttttttaaacccccagacctaatgagacttattcactatcacaagaacagcaccggaaagacctgcccgcatgattcagttacctcccactaggttcctcccacaacatgtgggagttatgagagtacaattcaagatgagatttgggtggggacacagccaaaccatatcagctgtgtttaaggtgccttttttatgttctcttttctttgttttttctttatttattaaggtgcttctaaatctgttcattgacttattaattttggtaattgttaatagtttaaccaaaactactaaccaagtgttttttttcctccagttttagaatttctagtgtgtgtgtgtgtgtgtgtgtgtgtgtgtgtgtttcctccgagatttgcactgaacggtttccaatagtggaaaaaaatttcttttaaacaaataattttataatttacctggtaattctctctcaagtttctgttacatgttgttaatgtcatttcttgttcacgttggctcttttcttggtgtactattatatttcaatgaatactggatgctgtgtttggaaaattatttctagaaataatttggggtctagtataatgttatcttcctctagagaggatttttgtttgcttctgcgagatgcccgagggcactagcaatcctggatcatcttaatccaatttaaggtttatttatttatttatttatttattttagtatttattgatcattcttgggtgtttctcagagagggggatgtggcagggtcataggataatagtggagagaaggtcagcagataaacacgagaacaaaggtctctggttttcctaggcagaggtccctgcggccttcggccctgtttgtgtccctgggtacttgagattagggagtggtgatgactcttaacgagcatgctgtcttcaagcatctgtttaacaaagcacatcttgcaccgcccttaatccatttaaccctgagtggacacagcacatgtttcagagagcatggggttgggggtaagttaaagattaacagcatcccaaggcagaagaatttttcttagtacagaacaaaatggagtctcctatgtctacttctttctacacagacacagtacaaatctgacctctcttccttttccccacatttcccccttttcttttcgacaaaaccgccatcgtcatcatggcccgctctcgatggtcgctgtctcttcggagctgttgggtacacttcccagacggggcggccgagcagaggcgctccccacttcccagacggggtggccgggcagaggcgcacctcacttcccagacggggtggtggccggacagaggcgctcctcacctcccagacggggtggcggccgggcagaggcgctcctcacatcccagacaatgggcggccgagcagaggtgctcctcacctcccagacggggcggccgggcagaggcgctccccacctcccagacggggcggccgggcagagggctgctcacatcccagacgatgggcggccaggcagagacgctcctcacttcctagacggggtggcggctgggcagaggcgctcctcacttcccagacggggcgggcgggcagaggggctcctcacatcccagacgatgggcggccaggcagagacgctgctcacttcctagacggggtggcgggcgggcagaggctgtaatcttagcactttgggaggccaaggcaggcagctgggaggtggaggttgtagcgagccaagatcacgccactgtactccagcctgggcaacattgagcattgagtgagcgagactccgtctgcaatcccagcacctcgggaggccgaggtgggcagatcacccgaggccaggagctggagaccagcccggtcaacacggcgaaaccccgtctccaccaaaaatacgaaaaccagtcaggagtggcggcgtgtgcctggaatcccaggcactcgccaggccgaggcaggagaatcaccggagcccagggcagggaggttgcagggagcggagatcttggcagtacagtccaggctccccaagagagggagacagtggagacgggaaagggggagggggagggggaaagggagggagagggtaggggagagggagagggagagggatccaatttaaggttttaaaattttctgggctactaaatgacttaaagctgggctacattttatatctttcactttcctgtttacattgaacatttagcaccatggtgaaaagacttcatataaaccatgcctgaatgggtatggtattagatattgatcttagaaggtatttagaaaagctagacaagaaattaatgatgaggagtggccaaaatactacatgttttgaatatatgctgtatttaagaagaggaagacagattcaatgaacaacaactttattactgtcagttactgtccactgtgtatttccggagtggtgaatttaaaaataagtcttaggggcaaaacacttgaaatgtttgtaaaatatattttgtgaaatgcttatgtgtcccagcagagggcatcttgacataatgaatccaggtccactgcttttctatgaaggaagatggttttaagacatggctttgctgtattactgtactgctttgtgatagtgttaagaccaggcaaagactttaatttgacccctttgtgtggcacatgtggaaagtgagacacagctggtagaaatgacttccatttgatcatttaatattcaattattgaggaattataatgtatagtacatatatgtaacctatgtagatactatgcacaaggcaggcaagagtttgcttcttaggagtgcgaaaggcttattggggggagaaaagagtttgtttctgaaggagctttcatccagtggtgggggagagctaccaataataaagtaaaataatttgagaaagcattggatgctctgaataaaataatgcgggaaggtaatggagagagaaggacagcagattgctgctagtttgggtggtctgggaaggcttctctgaggaggaaggttgtgactgacaggcagttaggtgtcagcaaagggaagtgcatttcagactgagaaacattgaaagcaaggacttgcagatgggaaatgggaaggaggccagtgtggttggagccttgtgaggcaggcatgagtcagaccacccagggcctaggggctgtgtgtggtaaggaatttcgagaggcagcagagcacagggcttacctgcccaggctctggaatcaggcttcctgggttggaatcccaactccacttaaccagcgtggggatttttctgaggagctggtctgtagcattcatcatatctgaaaggtgacccagaaaaggtaaatgaccattcactatattgtgttgcctgtcagaaacacttctaattctctgcagcacagacagcccctgattattgttgattttcaagaaaaaaaagtttatttgtagtgcaactaaacgaaatcttcaagtaataaaaacaatatctcaagttggttgacctcttttagtatcaatcaccagtatgttgtttgttgttgttgttgttgttggttttttttgagacagggtttcactctgttgtccagactggagtgcagtggtacaatcatggcttactgcagcctcaacctccttgggctcagatgatcctcccacctcatcctcgtggacaggtgcacgccaccatgcccagctaattttttaaatttttgcagacatgccgttttgccatgttgcccagggctggtcttgaactccggggctcaagtgatcctcctgccttggcctcccagagtgttgggattacaggcgtgagccactgggcctagccctagaggacttctttttaaacaaaattggatttattatttcattttctttgaaatgataaaggataggttaataaagaagtggagaaagattcacgtggtctatagacgtaattaatatcttgagagtgatagttttggtaaattgtgcagcaagtagaaaatacttgaatatttgaatcatatggagaagtatcaagattgacataacaaatgcatgtgcacccactgcccagctttgtcagttattactgctttcacatgtttgcatcaaatgttttttaagaaataaaaagtacagatatggttgaaattctcagtggaactctttctaatcctgctcccttccctccctccctccactggggtaaccagtattctagatttggtctttgtcattctcttgcatttgtctatatttgctattatgtgtctgtatgattaaacaatatttagcattgttttgcatgtgttaaattttatattaatggtatcactctgatactatgtttctgtaatatgtttatctcgttcaacatttttctgagattcacccatgttgataatgtggctgtttttaactgttatatggtattccattcattatctgagtatttctttttctgttgttgttttttgagatggagtttcactctgttgccctggctggagtgcagtggcacgatctctgctcactgcaacctctgcctcctgggttcaagcaattctcctgcctcagcctcctgagtagctgggactagaggcacacaccaccatacctggctaatttttgtatttttagtagagatggggtttaccatgttggccaggctggtctcgaactcctgacctcaagtgatctgcctaccccagcctcccaaagtgttgggattacaggcgagagccaccgcatccagcctgaatatttcacatattggtagataatcaggttgtttgtaattttttctgttttgacaatgtagcacagtaatacattttacattgtgacccagaataaatgagtacacatatagccaaaactacaatttttaatgaaataatacttaacccctactgcaaattgtatactctgtgatatgttctagtctgttctattttattagaaaaaaatacactcatgagtcactgaaaggtcatactagctgtagcttgaaaagtactactggaagatatacccaggaggggaattggagggccaaagatgtccattttcaactttactagatattgctaaatgtctttccaaatcctgttcatttacatccccacaagcagtatgctgtagcgcctgttacttctcattctcaccatcggtgttaccagtctttttcatttttgcagatctggtaggtataaaatggcatctcagtgttggtttaatttgtgtttttgagctagaggttccagcgagtgcagtaagacaaagtagagcaccattttggatctttattgacgtctcaattttctttctttgcctatttcctgtttatacctttgcccatttcccaactcagttttttggtcttttttatgtcaatttataaaaattattgatctatattttgtattcctttcccaataatatgtattgtaattattttctcccagtttgttgcccacccccatttatttatttttttgttcatgaaggtttttatttatattattgtgaaatttattaatcttttaccttatagtttatcctttcgggatcttgtttaaggaattcttcttaactctgactttataaaatattctatagtagtttattgtagaagttataatttttttaattttcaattttaaaggtatttatttatttatttatttatttatttatttattagagataggatcttactctgtcacccaggctggagtgcagtgatgcaatcatagttctctgcagcctcaaactcttagtctcaagtgatcctcctgcctcagcctcccaagtagctaggacctcaggtgtgcagcaccatgcctggttttaaatttttttgtagatacggagtcttgctatggtgcccaggctagtcttgaactcctggcctcaagcagtcctcctgccttgtccttccaaagtgctggattacaagctttcttttgtttttcattgttttattgaggttattgttttacatttaggcctttaatccacctgtaatttatttttgtatgtaaggatctaatttcattatttttccatatggataaccagcatcatatatttaatagcccatacttttttttatctttctgacacaggaggatgtttatgaaatctgcaattcagttgctttgatttgtctatccctgagtcagttccacactagtttaatgactatagttatgctcttatttatttatctcatctcatccttctaatcagtggagatataaccttaatgagtatagccttgtaattactaatatgtggtaggatgaatgccttcaaattcttaaaatcttatgaattgttttggctatttttggccatttgcacttctatttaaatactgggatcagtttatcaaattccacaaaatcccatgttgagagttttatttgaactgtattaaatttataaatcaatcaaatcaagcagctttatgcacagtagcctaaaactggaaatagtccaagtatccatcagatagaagaataggtaaacaaactggtttatccaaacaatggaatattacttggcaacaaaaaggaaaaaacaactggttcatgtggcagcatggatgaatctagaaacattattctaagtgaagttttaagtgaaagagtattactatatgatttactacttactatatgattccatttatttaaagctctagaataggcaaaactctaatgtatggtgaaaaaaagaagaattctaggtattgctgagaagtaaggatgggaattgactgagaagggacatgaaaggactttctggagtgatgttataggtcttgagtttcctctcctttcccctcccctcccctcctgtctcctctccttttttgagacggagtcttgctccttcacccaggccagagtgcagtggagtgatctcggttcactgcaacctccacctcccagattcaagcgattttcctgcctcagtctcctgagtagctgggactacagaggtgcaccaccatgcccagctaattttgtatttttagtagagatggggtttcaccatattggccaggctggtctcaaactcctgaccttaggtgatcctcccacctcagcctcccaaagtgctgagattacaggtgtgagccactgcgcctggccagatcttgagttttatgagtatatacatttttaaaatgtattgaatgtatacttggatttgtatacttcactatatgcaaattttacctcaaaagaaaaaaattataaaatattgaactctagctaatgctatgcctgctgaagtatttagggggatcatattgatatttgcagtttgctttgaaacacattttaaaaaccccagtgtgagttgatgaatggatagaacgatggatagatatgtataataagatgttaaaattcaactttgcacatatgtttttaagttttcataataaaatattggactcctacaactcagctgcaagaaaccaaataactcaatataaaaaatgggcaagggactcgaataaacatctctgtaaggaagacttagaaatcaccaacaggttagatgctcaactattatcaaaaatataaactagtggcggtgaggtcgtagagcaactggaacccttatatactataggtgggaatgtacagtggtccagccgctctggaaaacagtatggagattcctccaaaaaattaaaaatagaactaccatatatgatcctggtgtctcacttctgggtatttatccaacagaattgaaatcaggaccccaaagagatatccacactcccttgttcattgttgtattattcacaatagcaagatgtgaaaatagcctaaatgcccaccagcggatgaatggctaaagcaaatgtgatctgtatgtacaatggaacattattcacccttaaaaacacaaggaaatgctgtcatatgtgacaacatggttcaaccttggggacattatgataagtgaaacaaaccagtcatagaaagacaaatactgcatgattctacttatagaaggtatctaaaatagtcatagaaacagaggagaatggtggttgccagggtctgggggtgagggacagatggggagttgctcttcagtgatgcaaggggaataagttctggatagccgtacaacattgggcttatagttagcaatgatgtgttgtccactttacattttaagagagtagataacaaacatgttaagtgttcttaccacaattttgaaaaataagtaaaatgttggtaaatgcagccataaaattttttctgtaacagctatttatgatggaaagaaaggtaaaaagcagttgcttattttttatttgctttgaggttctttagaggggtttaagtcaggctgattatattactaacaacatgtagaaaagttcatttaggtttacagggaggtttattttatttgagccacttagaatatatatgccaatatacagatgagcaatttaatttttatttaagccttttacaagattcataaataaggataaaggtaaaatgtctttttaaaaagattgtctttgatatgttgaggtcccaggaatcagagacttcaatagttcctttgagtctaccctccatctacccttcaaaagacaaaacaagacattatacattagtttcaaggcaagccagactaacttttattaacattttctcagagtgggaaagttatctcttttctgccagaatgccttcatcaacttgaccttgtgttgaacatctccatttttggcacaattcccagatgtagaagaaaattttttcaattaagatgttattcattcagatactcctttaggtgttgttggagttccaaatgtgagtgattatctccaacttccttaacttggcattgtcttggagtaatggaaacaggggtacagggatagaagtaaatactgaaatctgtaaattttttcaattttggcaaacttctcctctcagtgctacaatttttcctagcacctctaagaatattgcctttacagtatgggcatgctggcaaaacaaagccaaagaaaaacaacattatacaaaattcaaactagtgtgtgatggggaggtgtaagtcatttgcttttttaaaagattcattgtatgttttattggtaaatcataatatgaatcatgttaaacaatagtgaagtatattgataatatcaggatcattctttatttaccgacaacaatattaggaaagcagtgctaccttttttgtacctttaattgtttctgtcttgaacagtttacaggcagctgcctaatctcagcacatacgttattatttcaggtcctgtgggaatggccgctgctgctgctgtggcaacaggaaagaaacggaaacggcctcatgtatttgagtctaatccatctatccggaagaggcaacaaacacgtttgcttcggtgagggctcccttatccatattgttactattcctcaaatacttcctgtggatgacagacttagaacatatgtgattaggtttgtcaaggatgcttggttcgattccttgatgacagatgtagacttaaaagtattcttacaaaattaaatgcatgaaaacaaagaaatacgatttaacagatacgtaatatcacattaattcattcagaaaagttgtatgcctgctatgtgcaagccattgttgtagacattgggcatggaagagtgaacaaaacaaattgccttaaagagcttgtatcctgctagagggggaaagaaaaaaacaatatgcaatatgtcagctgatgataagtgcaatgggaaaaaaatacagtggagtaaggaaaatagaaaagtcaggaggtagggggatatagtcagttttctctattacggggatggtctgggaaatcctttttgttaaggcagcctttgaacagagacttgaaggtgctgaaagagcacacatgttgatgctggggggaagaacatctcaggcagggtgagtatcaagagcaaaggccccgaggtgtgaatgtggtagttgtgtttgaggaacagccagggagatatgagaggatgttcagagcagtagagaagagccacgccaggagatcttttttttttttttttttttttgatagatgtggtcttgctatgttgtccaggctggtctgggactcctggcctcaagcgatcctcgtgcctcagcccccaaaatgctgggattacaggtgtgggtcacttcacccagcctaggagatcttatagtccaatatcaggggcttgactcttactctgagtgagatgagatgtcattgtaggcttttgaccagagcagtagtatcatctgacttatatttttaaagaatcactcaggctactgtgttgagaatagactgtggggatacaagaatggaatcagggagaccaattaggtggtgattatagtaatctaggccagaaatgatagtgtcttaaaaccaacatggcagcatcatggatagtaagaagtgatcaggttctagatgtatttcgaaagtcaactcatcatgattcattgacatggagtttgagagaaaggagtgctgggtgatttttggtctgattactagaaggattgcgatgacatttactggaggaggagcgagcatggcagtgagggtgaggcagaatcaggaatttggttttggacatggtaagtttgtgatgcctctaaccattaagtggagatacaaaataagcagttggatatatgagtctggaattgaaatgagaggccttagctgaagatattataagcatataggtagtatttagaactaggagactggatgaggtcacttagggagtgagtatggactgaggcctgaagcactccaccttttagaggttagagagattaaaggaaccagcaaaagaatctaagaagcaaccagtgagtcaggaaacaaaccaagagagtggtatcctggaaaccaggtacaaaaagtgtgtcaggaaggagagcatgtgatcagctatcaaatgctgctgatgggttgaaaaagatgccaactgactattagatttagtaacatggagttcatgattgaacttgacaagagtatattcaaaggagtggtaagggtgaaaagattggaatagctttaagagagaatagggagagaggaattggagacagtgaatataaaccattgtttcaaggaattccatcagatttcttgtttgataagtggtcctttgcccaccacatttcagaattctgaaatgtagaactttgaaatcatctcccatgatttcagagggaagaggcagtgtttctgtttcatccattgttactatattttaaaaagctgttttcggggtcgggcgcggtggctcacgcctgtaatcccagcactttgggaggccgaggcgggcggatcacgaggtcaggagatcgagaccatggtgaaacctcgtctctactaaaaatacaaaaaattagccggnnnnnnnnnnnnnnnnnnnnaatggcgtgaacccgggaggcggagcttgcagtgagcggagatcgcgccacagcactcccgcctgggcgacagaacgaggactccgtctcaaaaaaaaaaaaaaaaaaaagctgttttcggtttgatgggtgcagcagaccaccatgtcacatgtatacctttgtaacaaacctgcacatgtatcccagaacttaaagtaaaattaaaaaaaaatttttttaagctgtttttggctgggcatggtggctcatgcctataatcccagcactttgggaggccgaggtgggcggatcacctgaggtcgggagtttgagaccagcttggccaccatggtgaaaccccatctctactaaaaatagaaaatataagccaggcatggtggcaggcacctacaatcccagctagtcgggaggctgaggcaggagaatagctttaacccaggaggcggaggctgcagtgagccgagatcgcaccactgtactttagcctaggcgacagagtgaaactccatctaaaaaaaaaaaaaagctgttttcatttcatcctcacttgtgaaatactgtaggactaagaataattatttatatcacaatgaaaatctgaagctacaacattttaaaagcataggtatacctcagagatattgcaggtttggttccagaccactacaataaagcaagtatcacaataagtcacagaaattttttggtttctcagtacataaaaaagttgtgttaacactatactctgttaagtgttgcagtggtattatatctaaaaaaaaaaagcaatgtacataccgtaattttaaaatactttttttttggagacagagtctagctctgctgtccaagctagagtgcagtggtgtgatcatggctcactgcagcctcaatctcctgggctcaagtgatcctctcacttagcctcccaagtagttgggacaataggtgcatgtcaccatacctggcgaattttttcttctttctgtaaagacggggtctcactatgttgcccaggctgggcttgaactcctgggctcaagcaatcctcccacctcaacctcccaaagtgctgggattacaggtgtgagccactgggcctgaccactaaaacacttaattgctaaaagatgttagggctcatctgagcctgcagtgactcataatcttattgctggttgacggtcttgcctcgatgttgatgactgctgactgatcagggtggttgttgctgaaggttggggtggctgcggcaatttcttaaaaataatacaacaaatttggccctatcgattgactcttcctttcctgaacgatttctctgtaacgtggtgctgtttgatagcattttacccacagtaagactttcaaaattggagttaatcccctccaactctgctgctgcttcataaattcagtttgtgtaatattctaaatcttttattgtcatttcaacaatatacataacatcttcatcaggagtggatttcatctcaggaaaccgctttctttgctcatcaataagaagcacctctcatccattggaattttatcatgatattgtagcaattcagtcccattttcagggtccacttttaattctggttctttcactgtttctactgcatccgcagttacttcctccactgaagtgttgaactccttaaaatcatccgtaaggcttggaatcaagttcttccaaacttccattaatgttgatagtttgacctcctcccatgtacttgcacatgaattacaagtactcttaatggcatcttgaatggtgaatccgttctagaaggttttcaatttattttacccagatccatcagaggaatcactatagcagctatatcctttcaaaatgtatttcttacataaaaagacctgaatgttgaaatgactccttgatccatgggctgcagaatggatgttatcttagcaggcatgaaaacagcattaatctccttgtacgtctccgttagagctcttgggtgactaggtgcattgtcaatgtgcaacaatagtttgaaaggaatttttttttctgagcagtgggtctcaacagtggtcttaaaatattccataaaccatgctgtaaacagatgtactgccatccaggttttattgttctatttatagaggacaggcagagtagatttagcatgatttttaaaggaccctaaagtcactagctgcattagcccctaacaagagagtcaacctgtcctttgaagctttgaaacctggcattgacttctcctctctagctaggaaagtcctagattgtatcttcttccagtagaaggctgttttatctacattgaaaatctgttgtttagtgtagccacttatctagatcttctggataacttgctccagcttctacatcagcacttgcagcttcactttgtacttttatgtaatggagatggcttctttccttgaacctcatgaaccaacctctgaaagagtcagggctttgctctgcattaggctttggcctatgagaatgttgtggctggtttgatcttttatccggaccactaaaactttctccatatcagcaataaaactgttttgctttcttatcatttgtgtgttcattggagtagcatttgtaatttccctcaaggacttttctttgcattaacaacgtggccaactgtttggcataagcggccttgctgtcagcctatcttggctttcaacatgccttcctcactaagcttagtcatgtctagcttttgattaaaagtgggagatgtgcgactcttccttaaagttgaacacttagaggccattgtagggttatcagttggcctaatttcaatactgtgtctcagggaacaggaaggcctgaggagtgggagagaggcaggaaacagttggtcagtggggcattcagaacacacacaacatttatcagtcaagtttgccatcttttgtgggcactgtcgtgccccaaaacaattaaaatagtaacatcgaagatcactgatcacagatcactataacagattataataatgaagaagtttgaaatattgctagagttaccaaaatgtgacacagagacacgaagtgagcacatgctgttggaaaaaaatggcactgatcaacttgcttgacatagggttgccacaaacctttaatttgttttaaagaaagatcccagatagtatctgtgaaacacaaaataacaaagcacaataaaactaggtatgcttgtagtatttttggacaaaattatctcaatgaaatataaacaatgagatataaacaatcaataaaagatagtaaaagcaaatcatttgaaccccttttattaagcatggagatgatataataaattctgtaagagcacatcttggttgcatttttttttttttttttttttttttgagaaaaagtcttgctctgttgctcaggctggagtgcagtggcaccatcttggttcactgcaacctccacctcctggattcaagcaattctcgtgcctcagcctcccaagaatctaggattacaggcgtgtgccaccatgtctgggtaatgtttttgtatttttagtagagacgggttttacaccatgttggccaggctggtctcgaactcgtggcctcaagtgatccgcctgccttggcctcccaaagtgctgggattacagcaggcatgagccaccatgcctggccagttgtaatctttataattgtaagtagcagtaagtgatgttgctcagatcaagaagaatgataccatgttcaaaattgtgtcatggctatgtcccaaagcaaaaccttcagttgagccttctatcagtagtctttaagaaaaaggtatgtacatatttctgctgaataggatagcaaacctcacattccccttttcacattttacgtaaaagagcatatctgatcagaataaactgtcttacctcatttgtgtctatgtcactgtaatttccgtctttttaaaactttttattcttgtttccttttctgattcaggaaacttcgagccacgttagatgaatatactactcgtgtgggacagcaagctattgtcctctgtatctcaccctccaaacctaaccctgtctttaaagtgtttggtgcagcacctttggagaatgtggtaagtcagaaccaagctgttctcatttgccctttgctttctgtcggctgcttccattcttctgatcctctgtcaagtataacagttggcatttctgttaccccctaatccaggcatgggagtggggactagttttcagactgctttatgcatatcaaaacaaaatgatcattactctttttacttcctacgtcaaggtattttacctccccagatgcaatgggtggccgggggaaggggggagggggcggggaaacaaggtgttttgtttgttaggaaaccaatgcaggattttctaagaaaattactgatttatatcagaaacaaaataatagataattccaaggtgtcaacttcctgagggaaacctgggggcattttattgatcagtttatttgagttacatatttgaaatatcttacatttatcaaagaattgatttaatactgtgctccaaatatagaactatatttgaacattttgattgtataactatccagagctaattttataaaaatagtcttttgcccctgcatacttatacaataggaactattctttcttgcgccaaattaactttgaatcattagtagattaatgatctgtaaagatttaaattgcattttgtttttattagggtaaaatttattagcttaaaatgacatttattagatgtctcccatattgaatataggcattttttgagttcagaattagtaatcaattgatcgaaattctgtttgttgtatttttttcacaccatcttcctgtccctgaaatgttgtgggtatttcttaacatttttgagttctgttttgagtttttccaaaaattcctgaagccctacaattaggatgtgttaggacctttccttagaagaatatagtagaaggctcctagttcaaaatggtgcctgagaaatagcctttactgtcacactgttgacaaacatgaaatctgggcatttcttctcttctttagtactgaaaatctaaaacaatactactactggtagtagtaaagatgatgcaatctatgaaaaagattcatctagaagactcagaaaaatacttcagaaaattactcactgcaaaaaaaactttttaagttttgggaaactgttggagtcctccatagaatacaagaagatatagactctgttaaacaggatgcactagactgagataaaaagcattttacctttgactgacattgataaatacaggttagggacttgcaagtaccagtaaaattagaagcagaatatatcttccagagcaccgaagaaaaaaaacaaaaccaagtctctgtataaaagatagaaaacaaggaagaaatgtttaaaaactgaataaaacacatagtctagaacacaataatacaagtgaggccagttaattctgttataaaccatacatataaatgggttaaagtgccttgttaaaggcatagatgttctttcaggttggaacaacaatccaaatcaaaccttcctctattcaatgtatgtgtcatactcacagccactcacaaatgttaaaagcagctgcaagtaatagaatcaagaaagtgaaaagacaacatgcagagtgggagaaatatttgcaaatcatgtctgataaaaaaacttttatcatatgtagagaatatataaagaattctgatatgtctgataaaaaaactgatatatattgagaatatataaagaattcttacaactcaacaataaaaagcaggcagatcatgaggtcaggagttcgagaccagcctggccaatatggtgaaaccccatctctactaaaaatacaaaaaaacttagccgggcctggtggcacatgcctgtagtcccagctactcgggaggctgaggcagaagaatctcttgaacccaggaggcagaggttgcagtgagccaagatcgtgccactgcactccagcctgggcaacagatcaagactccatctcaaaaaaaagaaagaaagaaaagaaagacaacccaatttaaaaataggcaaaagggccacacacagtggctcacgcctgtaatcctagcactttgggaggccaaggtgggtagatcacttgaagtcaggagttcaagaccagcctggccaatatggtgaaaccccatctctactaaaaatacaaaaattagccagacgtggtggcgggcgcctgtaatcccagctactctggaggctgaggcaggaaaatctcttgaacccaggaggcagaggttgcagtgagcccagatcacatgccactgcactccagcctgggcaacacagccagactctgtctcaaaaaaataataataataaaaataaaaataggcaaaaggtctgaatagatatttcttcaaagaagatgtagaaatgtccaacaagcacatgagaactaatgataaataattatttatcattaatcattattatagtcatttatcattaataatcacatttcgattttcatttccctaatgctgatgattaataatcatagtcattagggaaatgaaaataaaaaccacagtaagatacctcttcatacccacagggatggtgaagttggtgaagatttggagaaagaaaaagcaaaatggtacagctgctttggaaaacaatttgtcagtctctcaaaatggtaaaagtaaagttgccatgtgtcctagcagttctattcctaagttatacccaagagaactgaaagcatatgttcatacacaaacttgtatacagtgtttatagcagcattatttataattgccaaaaagtggaaacaactcaaatgttcatcggctgatgaatggataaataaaatgtggcatatccataggatggaatattattcagcaagaaaaagggaagaagtactgatattatactacagcatggatgaacctttaaaacattgtgctaagcaaaagaacccagtcacaaaagatcacatgttgtatgattccatttatatgcaatgtccaggatagataaatcttatttatagaaagagagtggattagtggttgccagagactggggaaggggaagagagtgacgccagtgggcatggggtttcttttaggtggaatgaaatgctctaaaattagattttggtggtaattttaggaccctatgagtataaagtcttaccctttaaatgggtgaattgtatggtatgacaaactaaataatgacccccagagatgtgcaggtcccatccctggaacctgtgactattaccttatacagcaaaagtgcagttgtaattaaaagggtcttgaatggggagattattctcgattatccaggtaggccctaaatgtaatcacaagtgtctttataagagggaagcaaagggagattggcatagaagtagatgtgttggtggaagcaagaggttggatgcaaggagggggtccggagccagtgatacaggctagacagaagctagacaaggcaaagaaacaattctgtcttagagatgctcccttagagactgcagaaggacctggccctgccaacaccttgactttagccaagtgaaaccaagaaaataaatttgtatgggtttaaaccacccagtttgtggtgattcgtgggagccataggaaacaaatacatatggtgtgtgaactatgtatcagtaaatctgttacaaatgttgaatgtaaaataacaggcaaaagtttgtcagaaaaatgcctacgaaaataaatcatggatcacggcattaatatcagacaaagcctaattgtcaaggcaaaaaagtattaactggcaaccaggggtcatttaatattgataagaagtatttatttattaatttatttatttagagacaaggtcgcactcagttgcccaccttagagtgtagtggcacaatctcagctcactgcaatctcctcctcttgggttcaagcgatcctcccgcctcagcctcctgagtagctggaactataggcaggtgccgccacacccagctaagataagaagtacatatttatcatgaacctttatattcttcaagtaactttaaagcaaaacatggggccaggtacagtggctcatgcctgtaatcccagcactttggaaggctgaggtgggaggattgcttgaggccaagagttcaagacaagcctgggcaacatagtgggacctcatctctacaaaaaaaaaaaaagccaggcatactggcccacatctgtactcccagctacttgggaggctgaggcaggaggattgcttgagcccaggagatcaaggctacagtgagccataatgatgccactgcactccagcctgggtgacagagtgagaccctgtctcaatctagtcagtcaaccagacatatatacataccaaagcatgtagatcaaaaagttagaaatgtaaggaaaaaagatagttaaaacccacaatgggggggcatggtggcacatatgtataatcccagcactttgggagctgaggtgggaggattggttgaggccaggagtttgagaccagcccaggcaacataatgagacttcatctctacaaaaaatttaaaaattagccagatgtggtagcacatgcttataatcttagcttcttgggaggctgagatgtgaagattgcttgagcccagaggtcaagtctgcagtgagctgtgattgcaccactgcactctagcctggatgacagagcaagaccctgtcccaaaggaaaaaaaaaacaaaacaaaaaaaccccgcaatgatagtaagaggatttactatccttgccagatcaacaaagcaaaatataaacaagaatatagagatctgaataacagatttaataaggttgacagtctaggcaacatagtgagaccctgtctctgcaaaaaaatgtaaaaaaaaaaaaaaaaaaaaaaggatctgggtgtggtggtgtgcacttgtaatcccagctatttgagatgctgaggcaggaggattacttgagcctaggagttcaaggatgcagtgaactatgattattccactgtgctccagcctgggtgacagagtgagacaatggcccaaaaaacaaacaaaagaagctgatacaatagatacaggagcattgacaccttacaaggggataatatatcatatttgaaaaattacataaatggattataagaattgaccatttattactaccaggcctcaaataattttttttttgaaacaagatcttgttctgttgcccaggctggagtgcagtggtgcagtctcagctcactgcaacctctgcctcaccagttcaaacagttctcctgcctcagcctcctgagtagctggctaatttttatatttttagtacagacagggtttcaccatgttggccgggctggtcttgaactcctgacctcaagtgatttgcctgccttggcctcccaaagcgttgggattataggtgtgagccaccagccctggccccagagaatattttctgatcatagtacagaaaattcagaattttagaatttcaaaagacaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagggccgtatttccccaaaaaaaaaaaaaaaaaaggtctttagaagtttcaaagaagagaacttgctagatgccaggtgagcgacgaggttgggcagctaaagaaggaagaaggtgagcaaagttgctcagtataggactccatggaggttgtatgctgggagctcaagaggtgtcattcacatagtctccagggttaggcaggcacaactttatctggaggctctggcaaaggagtattggaaaaataaataattggaaagattgaaatgctggccagagaaacttggactttgtcctataagaagtgaggaactatagcagtttcttgagaaaaaaagataaatgatagtgatgtggctaaatataccagctttagagctacataaaaatttgtttgatttttggctacacttcttactagttaatatgatttggagaaagttacttaagtttattaagcctcagttttcttatttgcaaaatgaacataatattttccttatagaattatggtaaggattatttgagacaacacatgtagtgcttggcacaaagtaagtgctcaataaacggtgtttgatgacaataagtgtttccaaaatttcaaatggcagtggtatacaagatgaattgaggcaagagaatggtaactgattttgatttaagtggttgtttaccttagttgtgcaaccaattgacatgttggtatgaagtgacaaaggcgtaagctatggtttttggaataggaggcataagttggaacacaaacctgtattttatctcatctgtgacaccattgattataagatgtgctgttatttgtgtactatgaagaaagaaaaaacattgataaatgttgacacaatgctatcacttagaatttttattttctacttattgaaagagctctttcaaggcttagacatagcttttaatcatatatcatttttgtatacatatataaaaaggaaaatgtaagtgaaataaggtattcctaaaacttcttcacattcagagtccaacccttttgaattacttcttgtttcagtcatcattgtctgtgttttttcatgtaatattgtcctctgtgccatcatgaaaacaggcaatgctatatttctttaaaaagtgctctgttattgtctgaatttttgcccccaagcagcaacaggtttgatgcaagtccttttttttttttttttgaggcggagtctcaccctgttgcccaggctggagtacaatggtgcaaatctcagctcactgcaacctccacctcccgggttcaagcaattctcctacctcagcctcccaagtagctgggattacaggcgcccaccaccacgcccagctaatttttgtatttttagtatagacagggtttcaccatgttggtcaggctggtctcgaacttctgacctcaggtgatctgcccgcctcggcctcccaaagtgctgggattacaggcgtgagccaccgtgcctggcgatgcttcttgatcttaacagaaattgtcattgggaaggtagtagacaacagccaagactcacattctcttctgaaatggtgctaaatgatttgttgagtaaaaaggccagggatagcaaacatgttcacatggctgcaggcaatgacagctatgccctgttgttgccttgtccatagcaattttaagatgtatcccaatttcagaagactgataaatatgaaagaaaaatgcatctcagaattgatagatcagatagaattaaaacatgaggtcagtaattctgagaaggttacttaactttagtaagcaagcttagatagaaatgctttggtaatacctgaagttgttttgttgcaaattacttagggatgctctactagcactaaaaaacaaacaaacaaaagatgttttaaaagaattatatagcactgataagctgactcataaaaatggctgaaattgtttgaaactggctaataaagaagtagtaacctaatgattttccatttttgaatgccaggtgtttctaaaagccagatgaagtttgtttttattttaaaattatttatttttgagacaaggtctggctctgtcaccctggctggagtggcactatcttggctcactgcaacctccacctcctgggcttaagccatcctcctacctcagcctcccgagtagctgggaccacaggtgcgcactaccatgcctggctaatttttgtatttttagtagacacagggtctcaccatgttgcctaggctggtctcaaactcctgggctcaagggatctgcctgcctcaacttcccaatgtgctgggattacaggtgtgagccactgcacacagcctgtttttctaatatgatcattcttcctattggcttatacctaatagaaggatttaaccttataaaccttaaagttctaagaccagaagctaggtgtattagtccgttttcacactgctataaagaactaactgtgactgggtaatttataaataaaagaggtttaattgacttacagttccacatggctagggaggcttcaggaaacttaacaatcatggcagaaggggaagcaaggcacgtcttacatagtggcaggagagagacagagagagagacaaagagagacaggtgcggggagggaatgccggtggaactgccaaacacttttaaaccatcagctcttatgagaactcactatcacgagaacaacatgggagaaactgcccccatgatccagtcacctcccaccaggtccctccctcagaatgtaggaattacaatcaagatgaaatttgggtggggacatagaaccaaaccatatcactaggcttataagattcatttgtgtgtgtgtgtgtgagtaggcagcataaatactatctagactacaggaacatagcagaaaatacaatcctgtaaagttgctgtggcaacatcagctgcttatgttgcaataaatataatggcaataatttttgaaactttattttttattagagaccaggatacaactgaatctctggaaagataatgagtctaccagtttgtgctatttttctcttatccccttagttattgacctatttggaggattcttcaactgcagaagttgcaccatgtagccagtaataatatttatttttccagatgcttggggtagagtatgggaatttttcttttttaatccacataatgaggtatttataaggaagtgtatagagtccagcccactcagcagacaacccaggattcaaacattgctggaacttctagtcaaacctcattttctcttccatttgtttccctaaaatagtgccttgagcccagaaaacaagttaatttcctagcccacttgtcacatttccataattccatggcttctttgttattcccagaggtatcctcataccccttgtgtattctcctaagtgaatgaacccattttttcctctcccaagttccaggcattcagatgaacccattatattggtggttggaagacccagcgtctgtccaccctttctgttcatgatcgaatgtgtgcatgtccagtgtgttactgttaagttgagacatgtaactggcagtagtgggaatgcagacaacgaacaacaatatctggttccaacctgggctagagctaaaggcgtcatgggttggaggttcacttctgtcaccaagccctaccagaagcaagggagatttgacctatggggctccctttggcccgggccttaccagtagtggcactcagctacaacatacacctatcagttttttttctctgattcttttcagtccagtctcttgtatgcttgaatctcctgtctgtttggtagtctggctttgcaggaatgtagcagcagttttgaatgaattggttactttaagttttagaaatgtaagtccttgaagatcttgaaaatgattttggtgatgagctgccacagctggttgttcaagcaatggcctgggaaatgcagaaccatgaataccatgcctgttagacctggaacaggcaatggcaccctcattgagaaaatgtgattttgactaagaagcagtatttctggaaaattttttcactggctctcttctattgttgttacctgcaatttcatcatcttttcatttaattatgttcagtatgatgtctttgggaccagtgggtatttttatttgcttgtagaagtgtttgtttttaaggctatgcaatggctcaggaaggccagccccacccactctcttgttgcttggcaccaatcctccctggttgttgggcatcttgtttacttctgcccttaattccctgcaggtgcgtaagtacaagagcatgatcctggaagacctggagtctgctctggcagaacacgcccctgcgccacaggaggttaactcagaactgccgcctctcaccatcgacggaattccagtctctgtggacaaaatgacccaggtgaggggtgggaggtgaggaggagactcaaagacaagtggcacaggtgtgggcgggcctctgatcacttttctgcattttgtcctcagtgatctgaccagggagtgagatgctgactggagtcttgtagtgaaacagtagcagccttggaaaagacattatagtgccagaaaagtgctcccaaccaagggcatggctgtggtctcctctttcttctggcagtttttttttccctttcacttgggcctttgggttggatttaaaaaaaaacaaaaaaacttttagcttggggttggtctgaacaaaagaacattaggagtttaatgaatcacagtcaaggtagccaagtaaacttttagccctcgggctgctctgctcctctttcaatgtaaattctaaatacttccataattattactaagtacagcttccttccgcaagaatgtaaaagtcagagtgacagtcttctgagtcgttgatttcctcttcctttttaaaatttttatttaaattttatgatttctaaagatgagggtctcactgtgttgcccaggctgatctcaaactcctaggctcaagcgatcctcctgcctcagcctcccaaagtgctgggattacaggcatgagccactgtgccagcctgatttcctcttcctttaagaagggaagtcaaaaatgtacttagcatgataaatcagcataccttagtaatttttatgaaattatcccctttatatatttttagtttagcttcatcaaaatcaaacacctttttaacatattttcccaccctatttatttatttattattattattattttttttttttttttgagacagagtctcgagctgtggcccaggctggagggcagtggtgtgatcttggctcactgcaacctccgcctcctgggttcaagcgctactcgtgcctccgaatagctgtgattataggtgcgggctaccacacctggctaatttttgtttttttagtagagatggggttttgctgtgttagccaggatcgtctcaaactcctgacctcatgtgatccgcctgcctcggcctcccaaagtgctgggattacaggcgtgagccaccacacccagcccaccctatttctttattaatttacttctatcttgctaaatccacttgtcaggtttttttccttatcttattcagtcttcagcagcatttgacatagttgattactccttaaagcatcttctctctgtctcttgaccacaccctcttctgaagatcctcatccttcactaggtgctcccctcatcccttctggggcccctcttcctcttcttacctgatcatcgatatgctgttttcacccagtttaccctcactgttagatgtctggtcctcacacgccccaaacagaacctttggttgttcctactctccactccacatctgttcctctccaggcgttccccatatcagttaatcgaactactgtccatctggttgctcaagtcccagtatagaagtaatcctgatttccttgttttgccctctccctccacattcccctgccaccctcccggtggcaggtcatgtcagttcacctctgaaatgtaccctgactctggccattcttctcacttcccatcagcacccaagtccaagcctttagcatctctcatatagcctatccactgtggtctgctgcagtccattctccatgtagccatcatagtagttttttaaaaaacttaaatcatgccggacgttgtagctcatgcctgtaatcaagaggaggatcccttgagtccaggagttcgatatcagcctgggcagcaggctggtattttttttgtctctacaaaaaatacaaaaattagctggggccatggtggtgtatgcatgtagtctcaaatacttggaaggctgaggtgggaggatcgtttgagccccagaggttgaggctgcagtgagccgagattgtgccactgcactccagcctaggtgacagagcgagatcctgcctcaaataaatgagtgaataatgaatgaatgaatgaataaatttatttatttatttaattcaggccatatcacttccttgtttaagccctgtaatggttttccactattcctagaatcaaattcagactctgccatggctttgaaggccctatgtaatctgacctcttcctgcctcatcatcttcccctcagtcactgggctgcggccactgtagccctcttttcctcaaacaccctgcatccgttattttgcttttgctgttccctttgcctgagtattgttctcccagatgattgcatgatggactttatcttattcaaagtctagctcaaatatcacctctgagacaagcctttcttgattatcccacctaaatgaagctttcttctccctaccaagccactaatacatcctctgtgttcttgtctgtataacacttgttactacctggaattgtctcatttattaacttgtatacttatttgtggtctccccagctagaatttcaggaatttagtttctgtcctttacttctgttcagtatagctgctcagcctctgaaataacatgttatctaaataatagtatctgttcagtaaatgacttcagagttagagcaaaaatgagttaagcgcagtggtggggaacaggatcgcaagtcccctgggcagttgtttactcagtgtggacgctgacgctgctgctcaggggtggcacttttattttttattccatctgaaccagcaacttggtctgaagtaatactatattttataaatataaacctaaatagtgatcttttgattgttggattcatagccctttctgtggacactggaaggatctctaaatagtggttcagaaaggaaagcatatctaaaccaagcttgtccaacccacgtcccgcaagacgcatgtgacccagaatggctttgaatgtggcccaacacaaattcgtaaactttcttaaaacattatgagattttttggcgttttttttttcttcagctcattggctgttattaatgttagtgtattttatgtgtggcccaagataattcttcctctaatgtggcctagggaagccaaaagattggacaccccgatctaaacttttctttactgtctttttacagtttctattattctgtttctagaggcattctgactggttcaagtaaagaaaacataaagtgaattatttttatctagttgatgtgaagaatctactctgtctcagatgtaaagtacatctactgcctaagcctttggtttctaatactgtgttaggtaaactcctctcctgtgatgggtattttttgttctttgtcacatttggtgtgttagggtaaagcagtctgaggttttgattatattatatcatcgtggattggccacaaaagtcagcaaacagtttagttattatcattttggaggtaagacatttgaaagtgttgttttccatatttgtcaaaaccacactcagtagagcttggtgtgctggtgaatgaggagctggatctcagttgtcaaactcatagatactttgttggaggtgcacattttctctatcatatgctccctctttccccttcttaccaaagatgatgactaaaaagtcaaccataacaaataaaataaaacaaacaaatgaggaggaagagggagcaggatgatgaaaaacccagctcccaattgaatgggaatttccaagtatttggatcctggcattttcccccctcaacgttttattgttgtttgttttcattgaatacttttttcttaacttgagctaaatagctcctctttgtctctgtctctctttttttttggggatggagtctcactctgttgcccaggctggagtgcaatggcacgatctcggctcactgcaacctccgccttccagattgaggcaattctcccacctcagcctcctgagtagctgggactacaggcatgcgccaccatgcctggctaattttttttggatttttagtagagacagggtttcaccacgttgaccagactgctcttgaactcctgaccttgagtgattctcccatcttggcctcccaaagtgctgggattgcaggcacgagccactgcgcccagccaatagctctcttttataattgatcctaaagactttcaccattaatgggagtaaaaggagggttttatttccacccaaacctagatagacaagggtatgggactgcaagcagtttaatacactgttagtgagaatgcagattggtacactttctctagatggcaggttggcaatgcatatcaaagtctaaaaggtgtgtatcatgccctccagttaaacacagatgtacattgtttattacagcatgcttacaataggaaaattgggaacaatgtgattggttaaattatgatggtgtttagaatttatataggaagacgagcagcatagcccaaaagagatgattccgtgaactgttagacactaaaaatgatgatttgctctttattgcagtgaattatatttgtggtatgttaaattaaaaaactgattgtaaagtagcattttttatatactgtaatttgaggagtttagggctttatttttctgtttcttttgggagatttaaaaaaaattctgggaacacagaattgagctgatttatctcattttctataacattaacataaaacatgcccacctctgtgtgtatagaactttggagggatgcacattaaaatcttaacactgccgggcatggtggctcactcctgtaatcacagcactttgagaggctgaggtgggtggatcacctgaggtcaggagttcgagagcagcctggccaacatggcaaaaccctgtctctactaaaaatacaaaaatcagccaggtgtggtggcacgcccctgtaatccagctactcgggaggctgaggcagaagaatcgcttcaccctgggaggcggaggttacattgagccgagatcatgccactgcactccagcctggggtgacagagcaagactcgatctcaaaaaaaaaaaaacaaaaaaaactgattgtaaagtagcatttcttatatactgtagtttgaggggtttagggctttatttttctctttcttttgggagatttttttttttttaatctgggaacacagaattgatctgatttatctcattttctaaaacattaacataaaatatgcccacctctgtgtgtttagaacttggagggatgtacattaaaatattaacactaattatctacacatggtggcattataggtgattttcattttctttatctaaataagcatgaattgcttttataatagaaatacaaaaaactattttcctattttatattaaacttgaatattttaaagtgcaaagttaggccgggcgcagtggctcacacctgtaatcccagcactttgggaggccgaggcaggtggatcacctgaggtcaggagttcgagaccagcctgaccaacatggataaaccccgtctctcctaaaaaaaaaaaaaaaaaaaaaaaaaaaacaaccaaattagccgggcttagtggtacatgcctgtaatcccagctactcaggaggctgaggcaggagaatcgcttgaacccaggaggcggaggttgcagtgagccgagatcatgccatcgcactccagcctggggcaacaagagcgaaactccgtctcaaagaaaataaaaataaataaataaagtgcaaagtttgataatgtttctgctttgttttacgcaaagattactttatgttaacatgaagatgtcaacaactctctttttccccccttattttcctcttaaatagatactgtgtgttggaaggcacattactaagttctttacaggggcatctcatttaatccacctttctgtgtgtgtgtatgtgtgttgtaaaaaattcttattttatagtcaaggaagcagagctcagatatagcttatagccataaagaacaagtacattttactggacattaattctagatttcagaacatgtgggtaatttatggcttccttgaagtgataaaattctagaactatcaaattggactgtaatagagatagacttgggttaaccagacaactctattaatcatcttatctgcacttaatggtatagagataacttgatattgatgaccctaacttagaaatctatataggatcctaagatacattctgaatcatctaaagagagtaaattatattcaatattgttctaatattatgtgttgcactattttgtatctttataaatgagaaggttagcatgatttattggaaagaatactaactcagagtgagaagatctattctctagtctcaattctactacatataaccatggttctcactttcatcttctgatgaaatatatgccctcctaccttaaggagttagaggaagaaaaataaaatttggtgtaggaaaatgttttgaaaactaaagcatcacaccaaggtattattactaattattaatgttaattatatgtattgcctatattcatttttgaataacctgaacataccatctctcagccatgctttattagagaaagttcatgaaccaagaattttaatttttctcaacaattaagtgagacaacacaggtggctttttttttcttttccctggtgtctacgaaaacaaaatatttttcagattgaaaattgaggcataaatagccgggcgcggtggctcacgcatgtaatcccagcactttgggaggctgaggtgggcagatcatgaggtcaggagatcgagaccatcctggctaacatggtgaaaccccgtctccactaaaaatttaaaaaaaaaaatcagcccggtgtgctggcacatgcctgtagtcccagctacttgggagggcgagacaggagaatcgcttgaacccgggaggcggaggttgcagtgagccgagatcacaccactgcactccagcttgggcgacagagtgagacgcagtctcaaaaaaaaaaaaaattgaggcataaatagaaaatgaaatttatgaagcaagctagtgacagatagaacttagggctgcattcatattgccagtgctttttaaaaaatcttttttgtataaaactgtattgtgttcattattcagattgactctttcagctagtctgcactaaacatttactttttttgtttttgtttttgtttttgagacagagtctcactctgttgcccaggctggagtgaaatggtgcgatctcagctcactgcaacctccacctcctgggttcaagcgattctcctgcctcagcctccccagtagcttggattacaggcggacgccaccacgctaggttaattttttgtatttttagtagagaaggggtttcaccatgtcaggctggtctcgaactgctgagctcaggcaatctgccggtcttggccttccaaagttttaggattacaggtgtgagccactgcacccagccaacatttactttttaaaagaattttttacttgccccaaaactctcaaacttgtctcctacacatataaaaattgtacatagcaatgtctgcagttctgtgagaactaaatgctctgttcttttaggaagcagctctcttggtttttgtcttttgtcttttttgttttgttgaaagcatgattctttattagtaaataggatgttttacctggaaagtttctgtttttattattataactatattaaagtttttagtctcttcttttggtgccatgacttggattatagtcctcattttggcaggggggtggggggtgggtctgcacgttagaaaactacatagctctatgatatttttagttattaaaatgaaaatttggatttctaggcacctttaagaatagtggctggaacttattctatacttactccatatctattttagaattggaggaggttgagataaagcttagcaaaagggatccttagtttggggtaggttctgtaaccccagaattcatttacaatgaagtctcctttttcagattttgaaagtcaggttagtaaatttcttttaggatactacagaccagggcctagtggatgggctaagtcagttcctctcaaacttcagagtgtgcagcagtcacctgagaagtggtgttcaaatgcagattaggaatcagtaggtctggaatgggcctgaggttctgccttgctggtgagcccccaggtgatgccaatgctgctgtttctcagactatgctttgaattcaaggaattgcatagcttcttgcagagtctttaagcaataattatgattttgctagtggaaaatcagttctgctctttaccagacttgggtcctgtaggcatctcttgttcttgggaggtggtaaatctctttggaatctgtattagaagacatccaggcaaagatataattatagaagaatcatcactggaaagacctgggcggtattattgattaaaatccactcttctttcccttctcccttccctcaccttccttgaacttactgccctcctcttactgtcattggggcaatctttgttgctttaatattcccgtggcatgatgatgcaacaggatagtaatttacagcagtttcaggtaaaccttctgaaatgttcagcagagtggttgcttcattaggaaggagttattcacacggcttttgagatgttttacttacaaaacagtcagtcagttatctgcttaggttttttgagagttttgttctgttttgaaaaaacattggtctcacctcttctacccaaagagtagaaaacattatgctaagtgaaataagccagacacagaaggaaaatattgggtttctagagttggcaaaatgataaagatagaaaatagaagtggctgggcatgatggctcatgcctgtaataccaacactttagaaggccaaggcaagcggatcacttgaggtctggagtttgagaccagcctcatcaacatggtgaaaccccgtctctactaaaaatttttttgtattatttacaaaaaaattagccaggtatgatggcaggtgcctgcaatcctagctactggggacgctgaggcaggagaatagcttgaacccaggaggtaaaggttgtagtgagccgagatcgcgccactgcactccagcctgggtgacagagagagactccatctcaaaaaaaaagaaaaaaaaagaaagaaaatataagttaccagggaccatggggaggtagaagtcaggagttatcgttttaatgggcacagaatttgtttgagatgataattttaaagttctagaaataggccgggcgcagtggctcatgcctgtaatcccagcactttgggaggccaaggcgggcagatcacgaggtcaggagtttgagaccagcctgaccaacatagtgaaaccccgtctccactaaaaaaaaaaaaaaaatttagccgggcatggtggcaggtgtctgtaatcccagctactcgggaggctggggcaggagaatcgcttgaacctaggaggtggaggttgcagtgagctgagatggcaccattgcactccagcctgagagacagtgtgagactccatctcaaaaaaaaaaaagtcctagaaataattatgatggttatacaacattgtgaacatatttagtgccactaaatggtacatgttaaaatgataatgttatgttatgtgtattttgccattattttacaaaatttttttgaaaagggctggataaaaagtattttagtttggtggttctcaaaattggctgcatagtagagtcacctagggaacttaaaatcctagtgccccggccacactccagaccaattaagtcatagtcttcagggatggatctaggcatctgcaatgtttaaactctccaagtgattccagcatgcaggcaactttgagaaccactatgatggatcacaattccaaactgcttctccatactgtagtgtcagaatttactggcaaagcaggctcttcttactgtctgaaattatcaaaaaatgtttacatatatgatgtctttccatgtttagtaggcataatgaaattaagagaatatatatgggccagatgtggtggcccatgcctgtaatcccagcactttgggaggtcgaggtaggcggatggtttgaggccaggagttttgagacaacctgggcaacacagcaagacctcatctctactaaaaatttaaaaattagccaggcatggtggtgcatccatagtcccacctactcaggaggctgaggtggtaggatcacttgagcccaggagttcaaggctgcagtgagccatgatcatgccactgtacttcagcctgagcaaaagagcgagaccctgtctcaaaaaagaaaggaaaagaaagagagaatatatacgtaacaaataaaaacactggatgtgttcttaaatagaacatggcatattgtgagtaaagaataagggtatattcagaaatactaaagagaagaaaatagccatataaattacttacataggatacaacttgactaaggaaatatttacatttatatgacaattaatatccagagcagattaatattttcttcatattcataagaaaaagataattagaaaaataagcaaacattataagcagttcacagaaaggaaaaataaccagtaaatatataaaaagattgtcaactcactagtaatggaaattaaaataagaaaacatttcccccatatcagatgagccaaaataagaaaacttgataataaggctgggtgcagtggctcatgcctgtatcccagcactttgggaggctgaggtgggtggatcacttgaggtcaggagttcaagaccagcctggccaacatggtgaaaccccgtctctactaaaaatacaaaacaattagccggccatggtaacgcatgcctgtagtcccaactacaggttgaggcaggagaatcacttgaacccgggaggtggaggttgcagtgagccgagaccacaccactgcactccagcctgggtgatgagtgaggctgtctcaaaaaaaaaaaagaaaaagaaaaaaaaaagagagaaaacttggtaataaaatgtggaagaggatgaatgggtattgtctggtactcttagtgacagtgggattggcaaagtctttctggaggacaatttggcagtgtgttaaaatgttaaatccatataccctttaatcagcaattccacttttctgaatttctgctaaactgatttcataaactgtaagcaatctaaatgtttatcagtaggggaatggctaaataaaatggaaattctataccatggatactaggcaactgtttttaaaaattagattattctagttgcactaccatgagaagatctctatgacaaaatgttgagtggaaaaaacaagttataaaatagtgtacaatatggtaccatttgtgtttttctttaatcacataaaactgcctttctagcatgtatttatgtaaatgtatagaatttggcctagaaggaaggctgttcatcaagctcatgcctctggataggagactggattgagggaggatacatggcaaagaggactttgactttatctatattatttacatttttgtacagaagagtacaacaagcataaggtaacagaagctaaccaaactgtctccttcaaagagaaggtaggactttaagagcattttgattaaaaagagagagaaagtttgataggttgggggtgccgagatacagaagcagaagtcttgccttgagagaggagtctaaatgagtgtctccattgactggccttcaaattcactaattctgaagttacgttgatcttttctccaaacttgctcttgtggtttctatgggaatgtgtttttagggaaaatgagattaagagaagccagtgttttgcttggcactactagggagtggtgtttctgataataaccaccatagtcatctctctgaacagagatcagtactacaaataattcccaatatagggcaaatgaatcactttgctttagctctttaatgccctttaaatatccattcaaataaaattgggtctgtcagcctggacggtaataattttaagttaaagtaatgttgccacagtctgaaaaatctccatttttccttccctgctacattcctgttttctgtaggctatacaaacataacctttcaacatggtttgctttcaactgccttctctttaaatttattatgtattctctgacctcttcagtagaggtggagttggcagatatgttggtctgaaagaccttttcttggtaattgagcctaaatggacatcaggagcctcaaaatccctagactcagataaatgcagagcaaagatagagggaacaagaggagagggtatttggaggatgtgtaaggataatgcattgttggatagcaaagaactaactgaatttacaaaggaaatttctagcatagcaagaatttttttttaattggataagacgttttagagttttagagaaccttttattttaaacctatctgtggtttccacataatctttacttttcactgacacaggcatgaatttgatatccttatctttgctgattgtcccgggaagtggtagtattttctattctttgctgatttggtgtggctgtactgaccaagctagagtaccttaggcccacctagagccctaaatcagaatgagagtccaggaaagcttgttccagctcaattaaaggacggtctgagaggttaggctttagctttgctgatcctgttgattgtctccctgtgtattaaagacaaaccttccttaacaagcacttcaagaagctctggtttccagaactctccaggaccagtaattaattcaactggtaatgagagcacagttccgaattctggaaaggaatcatttgactcttcctgtactggactgctagtttccctttattaatagtctctttagccttagcactgtttatttgggacagtataaaaagaacctgtaggaagattgcctttttcaatgaagtcaaattatctcttaagcatttaaaagtaaaaaatacccttcattcccaaaatgtacacacctgaaaaacaaactcttatagtagaaaataccttttacttcttttggtataggggcaaattttatatgcttgataattagcatttttaaaagctatgatctgctcctgaattagaacttgtatgccagcagctgatttcagtctggttccattttttgacttgatgaggtttctgcctgtggaagtaaccttctttttgtactgtttctgtttctcctgcctcacatattagcctctaggatcatcttcctaggaatttgaaacatttctcatccagagatttctagcaaataaatcatctttgaaaagtttcccagttctgtctttcctctaattatggttacccttttttctgacaatttccattagtaatctgcttgtacatccccccaccccccgtttttttttaattgaagggagagaaacagtgcatgtgcgagagggagctgcttgtattaatacgtatttttaatgctcaaggaccgagcagaacaaggcacctaaactttctgtacattgtgggtgggttggtaatagcttgccattgatcattggtccaaatgatcaatttgttccttcttggttctagcaccctttatttctcatcctcaaccttgtttcagatacatataaactcattcttctgccgccttctgcttttttccactttacccatccttgaaaaactaatgatgaatgtcttaatgtacattacagtgtgttcagtattagtaaaccatttcagaaagctagctatttgtttgcattgggagaataaattccctattttccctgatttaaaagtaaaatctcatttacctttgaaatatttatttttggcaaatggtcacatttagactttgatagaaacttaatatagattgagtaccccctgcctgaaatgtttgggaccagaagtacgttggatttcatatatttttggatttttttaacatttgcatatacctagtgagatatcttggggataggaccacaatctaaacacagaatttatttgtgttttatatacaccttatgcactatagcctggtggtaatttcttagggtatttttaataattttgtgcatgaaataaagttttgacagcgacttgaggtcatgggtggaattttccacatgtgacacttgaaacattccagatttcagatcttcaaattagggatgctcaatctctccagattaaggattaaaactgtgctggattaaagccatgatgtttctgagtccttatttgttttacatttagagtagttttatttaatagatttgaagagtggatgcttaaagcatctacttttttaaaaaaaaagaaacagctttttcttattataaaatcagaattaccaatcagttgccaaagagctatggtgcacctaaattttataacaaattaagctctaaattttagaacaaaagttatgaatactggagaagttgctgaaaaaagatggcttgatgactgaggtaataataataaaacttctattaattaatatacctgctatctcagcctcttcattgaccttgtatatttgctattattactgttttgcagatgagaacattaatattcagagccaactctgagtcttgtgggttttttttgtttcttggtttgttttttgtttttgagatggagtcttgctctgttgcccaggctggagtgtagttgagcgatcgtagctcactgcaacctccgcctcccgggattaagcgattctcctgcctcagcctcctgagtagctggcattacaggtatgtgccaccatgcctggctaatttttgtatttttagtaaagacggtgtttcaccatgttggccaggtgggtctcaaattcctgacctcaggcagtctgctctccttgaccttccagagtgctgggattacaggcgtgagccaccaagcccggcccttgtgttctttttggtagaaagagctaacttaagagaagtgagtctgagtgcactgactcacacctgaaatcccagcactttgggtggttgaggcaggaggattgcttcagtccaggagttggagattggcctgggcaatgtagggagaccccttctctacaaaaagaaaaaaaagaaaagaaggaaaagtaaagaaaaaaaatagctgggcatggtggcatgcgcctttagtcccaactactgaaggctgaaacaggaggatcccttgagccctggaggttgaggctgcattgaactgtgatcatgccactgcactccagcctgggccacagagcaagatccgagagtgagagagagagagagagagaatgaatgaatagttagtatatgttccacaaagaatgtaggacttttctgggcactaaagaatgagtggcggcattagaatagtagcatggaaaatagtccagccaggggacagaacaaaggcaaagaagcgggaatgggcttagcagctcttaagacagtgcagagatttgtctgatggaggaccaaggctgagtggtgggaattaatgggaactgactgtagtgtgaggccagattgtggtgggtctgaaaagctgggcagaaggatctagtttagttgccatagttaaaagacatttggaggtgttttgagcattggagctatgtaggtaacatttaggaaaacctctcaggcaaggatatgtgggaagagggaatgaagggagaacttggagtttcccaagaaagccaactagaaggatacactagccttgggccaaaaaattagaataaaggtggggccggagaagaagggatagacaccagagacgtttcaaagaaaacaaaagaactggacttgcaatgtgtgactaggtaagtgttgaaggagaaaagtaaagataactttgacatttttagtttgagtggccggggaaagggtggttttctacttgctaagataaaaaagttgagaagacaagtagattggagagagggtagggtaggagtttaagtgaagaggctgatgctgagcccacctttcaagtaacattgagttattggaactcagttggaaggcctggtgggagagccgaaggaagacttgagggtgaaagatatccacgtccaggtgccaacgtgacccagaactgaggagcataaggaactattggtgcaaatagggtgaggcgtcagaagtgaagcgatcaccagaattagggaatatagagggttccaggtggatctgagcagactctgtcagtctagtattctccacagtgagtgctttctgatcactttaggatttctgttttgtttgtttggtttaagacagggtcttgctctgtcacccgctttaggatttttgttttgttttgttttgttttgttttgagacaaggtctcactctgtcacccaggctggagtgaagtggcaccatcatggctcactgcatccttgacctcctgagctcaagcgatcctcctgcctcagcctctctagtagctgggactacaggcacgtgccactgtaaccgactgagttttgtatttttggtagagacagagtcccactgtgttgcccaagctggtctcaaactcctggtctcaagcattctgcctgcctgagcctcccaaggtgcagggattataggcatgagccactgcacccaacccactttaggattttgttaatttagaattatttagccttctcatttcattttctccagactctcctaggtatgaatataaagaattctcctttttggaaactgttaatggtattcaaagaaaagggagtttatgaaagtctatatcaatttaatctatacctctgagaaagccattttttttaacatgaagaagtataaaatattgtgtgtgaagattaagccctttcttgctctatgtatttgagcctagaaaaagacacactcccaagaaattagaataaagggaaaaatgactttgagatgtactttcttaaaataactgaagtaatgaccgcatgagccagctgatgggtttttaaatggatacgtttctatcagcctgctgcttgatgccagagccaaatatatatggagtgtattatatcatatcctgtaggcaggagactgttggggcattgggggacttagagaggtgaagtggcaggcttggcacaggaattaacagcatggctaccgtcaaccagaactttattaggtcaacattactgattgggttcatggttccctattatgtaacaatttgtatcatcttctcgtaaaataatatctaatatttattataagaatgataagaatacctgatatttatagaaatctttaatattaaagtgttgctgtactcattctctcattaatacttaattattctcatttctgttttttcttgttttactttgtaactacaaatccacacccccgagtctgattcattgctaaaagtggcctctttttggttttcagctgcaggggcagtatgggtgcatccttagttgcaggatgctacttatatctggagtgctatagaccaccaggttaaaaggaagacagtaggtctgggaaggaggaatagatcataacttgataaactgcttttcttgccagaaatcattatcagcgattaagaatattcacaaagtagaccctcccccaacacacacagagtgtggttactatgccaggaaataagaatggcagttgtctttgtggtttaaaacctgtttggtctggatttgatttgtaaaataaatctgaatgaagtccataatgcatttaaattcacacatgctttactatgtctatatgtcagactcatggacagtggcctagcttactggaaaatttctagaagagttttagggttattttccctttttattaagttaaaggcctgtttgttttcctatattttataatcagccaccttattgaattctcattattgtttgtagtagtttttcatttgatctctttggaattctctagatataaggtgacttcatctataaataataatgattttatcagctcgcctcttatttctctcttatctaattgcatggattcctacttccagaacagtgttgaaaacaccccgagtttggcaccttacatgcatgaaaactgtagaagggaaataagctatagtaccagtaatatcttgggaagcagaaattaaacttaggggtagatattcttactcttagaggaacaagtctacaaaatgcagcctaaggtgcactttatcaacatatttataattctcaaccacccatggagatataggaacctatggaaaacagtgggttttcatcagtcacatcttagaattctctgggaccttcctggaaacctctctgttttataaggttagaatttaaggagtcataaacacaccccagatgtctttcatgagtattgatgaccacactgttctcttccaggcccagcttcgggcatttatcccagagatgctcaagtactctacaggtcggggaaaaccaggctgggggaaagaaagctgcaagcccatctggtggcctgaagatatcccctgggcaaatgtccggagtgatgtccgcacagaagagcaaaagcagagggtgagagttcctctgactgagttgcctggttgcttttccatcctaaattaaccacctcaatttttgtcatttctacatcttgtgctagaaagtctttgtgtaatagttaagcctgtccctccaaagactgatattctttgatttatagccttttccatttgtcgctccatcactatactataaagagaagactgggttgagttgatgaatttaaaatgtgtcttcggggttgccttttggagcagttttaattttatgaagtgcttgggaaagtcaaagaaacttgaagtaaaagtattaatcactttgaacacttagaaatgcttttatttctggttactaaaaatcattgttgaaaatgtaaatatggaattagagggatatgaagtctgccagctgagtctgctaataacaaaacttttacaagaaagactaaactacctaccattccttactttttttgcgtatttatttttctttttctttcttttctttcttttttttttttttttttgagacagagtctcactcttgttgcccaggctggagtgcaatgacgtgacctcggctcgccgcaacctctgcctcccgggttcaagcaattcttctgtctcagcctcccgagtagttgggattacaggcatgcaccaccatgcccagctaattttgtattttcagtagagatggggtttctccatgctggtcaggctggtctcgaactcccgacctcaggccatccgccctcctcagcctcccaaagtgctgggattacaggcgtgagccaccatgcctggccacgtatttatttttcatttagcttggaagtttactgagaatcttaatatgccattcttgatcagaataatctttctttgcaagaagtttaagagtttggcctcaggttggaatagggtgtaaactagactttgatcaagaagaaaccaatgagaagccctctttgatacttcgtacacagcttctttctaccagaaccagtctgtgggaggtaatcctaggagagtctaataagaggtttggtttggtttgatttgataaagaagtagctgcttattgcatattgggactaaataaccaaagttctttgtggcttaatgtgcttttccggtcatttggtgacaggtttcatggacccaggcactacggaccatagttaaaaactgttataaacagcatgggcgggaagaccttttgtatgcctttgaagatcagcaaacgcaaacacaggccacagccacacatagtatagctcatcttgtaccatcacagactgtagtccagacttttagtaaccctgatggcactgtctcacttatccaggtgagtaaacctgagggctaccagactgtggcttctgagatggatcagtgggcacctcacctcagactagggaaagtttcctttgtgcgaactcttgtatgaactttatatagctccccaagatcttcctacctgaaattgatttctgaagaatagtttaaattctttgcatttgctaaatacagagctatgagtagcttcctggacatttccaaaacaaagcacttttaaagggctctttttttttttgagacaagatctctctctgtcatcacagctcactgcagcctcaacctcccgggctcaagtgattctccctcctcagcctcccgagtagctgggactacaggtgtatgccaccaggcctggctgaattttttttttttttttaagtagagatgaggtcttgctatgttgcccaggctggtctcaaactcctgagctcaagtgatcctcctgcctcggcctcctaaaatgctgggattacagatgtgggccaccatgtctggccttaaaatgacttctgttttacagtttcactctcagtgatcagggaatattccttctgaatgacctcttctgaggtaaaacacaatttgttgattgggaacctctaaagttcagattgaggtgagaatagaaagttggttgaccaacactgggcatggatgtggcgatgtgatagcttttctcatatggacttatttggttgaagtaaaattctgaaactcgtgatagtctctgaactatgattttagtgagctatgattttagatttcacatcataaggcatattctttgttatctgtgctgaatttgggattaaatgagtctcagcttctgagtaaagaggtggaaggatccatccactgacacttaaccactttccatatttttctttaggttggtacgggggcaacagtagccacattggctgatgcttcagaattgccaaccacggtcaccgttgcccaagtgaattattctgccgtggctgatggagaggtaagaaagagattccatctgcatcttcttaaatacttgaatgtataatgagggaaaagcaagggtccagaagatggagtagcctgcatgtctgcggcactctttcatttaaaccttttaaagagcatgagaccatgaaagttttagaaagtgtcttatgctatgtgtattaattgtaacaattaagattcatggattagtatgtcaggaacttagaattttacatttgaatgtatagcatttggtattatacacaatacaaagggattatccctttaccatttttatgctgtgaatcccaaagaatttcatctttggtctttatgaaaaaaaaatggcacattaaaactggaactgactaagggaagccttctttgaaaggataaatatgtttgcaagtcagtaacatgatttattacatcttaaatatgcctttgaaaagatttcttaggagaattcttccttaccaaaattgggataattatgggacattaacctaaagacagccaacctttattgatcacttggtgggctaaacactcaaccctatgaagtataaagttctgttatcatcttcactttagagatgagaaaaccgagacataacagagcttagatgatttgcccaaagtcccatagcagtgttgaagctggataatgcattgagaaaaacattacctaggctctgagccattggtgaagatgcaacagtgaaggaaggggtttgttacgtcaccatgagtgtttcccttgaagatactgatgtggtgtgctgaagtttgaaaaatagccaacagatgtcaaagagcagtatcagaaataaagctaagagtattatctcacccttgttgagagccatggagcatttccccttagaacaccacaaagtcactttcatttgtgcccctcaggagagggggagagctggcaaaggccacatggctgggagatggagggagagtgcaccacaggctccttggccaccctgcatgtgccaaacccctgtgtagctgcagctgtgtggagttgattcgcacaggatccttgctgtcatgggactccagtctagtggggaagagagatgtctacgtgaatgaactctagccttcctgtaagggatgctgcaaagcgtatgtgcctcctttccacctaaggagcctgggaaagtttgggacactgaaaaacttggttattgggtgaggaaaggtgaaggttgacaggacacttactttctaagtatataaacatcattaaaggatatggattagcaaagcaaagaatttgtcagtcccagaacactagaacaagatgacactccttaaagtctgaaagaggtggaaaagacaacgaggggtacagttaggagatgtgttagtttttggcttagacaaagttatcaaccatatgtctctactgaatgtttcttggtactatttaaagaaagtaacttcgtttccttctgtataaaataatttgtttttgacacataatatttataacattaatggagttgcgtttccttttttttttttttttttcctgagacggaatctcactctgtggcccaggctggagtgtagtggcacgatctcagctcactgcaacctccgcctcccaggttcaagcgattcttctgcctcagcctcccgagtagcaccaggcacgcaccaccatgcccagctaatttttgtattttcagtagaaacggggttttaccatgttggccaggatggtctcgatctcttgacctcatgatccgcctgccttggcctcccaaagtgctaggatgatatatagtatatataattctgttagaagagaaagccaaagtgcaaaaacattagagacgtgaattttaaactgaaccatcaatatatgtaacagttttgaattgcataactcattttaggtgcatttttatgaatgtcagtttaccttaaatatgggcaggctgaataacaaataggaaaatatcaatagtatttttccatccatcccttcagtaaacactttttgagccctgtgccaggcactgtagagactatagataaaagataataaagactcccctttcccttaaggagcacataggtaggcggtagagaaaagcaaagaacaattgcagtgagataagggtctactggcagcaagcccagggtgctgtggaacagcagaggagaggctctcatctggacttcaggggagtggaattgtctcaggaaacacttcccagaggtgtagcccctgagcttagactagagtgggaactagccaaacaaaggagagggatgggagttctatcctgtcaaagagagcaacacattcagtgcattgacttgtgaaagcatggaacagccacagtttgaagggccttgtggtagtgggcctctctcagaaatgcatagtagctaatgagatatcttctgaatatcttcctctcctagggcttgtggccctttctttggggaagggagtgcaacaagagctcaagtaaacacagtttaagaaagcactgagactcaggaataggaaattccgaagagatgctggcacttgagctgatttcttgatcacctgccgtgtttctgattagaaatctcttctctgtttctcctcctattttctcttcaccgtttactgtcattccatgccatataatttaactttcttaaattatactgtatatggcagcattctaatgccattttcactacaaatatagttgtaactaaaagtatctatattgacttgctgcctttggagtttgaggacttgagagagcctcactgggccaaactcaagtgagagcagcagcatgggccagactgaaatagaggggcagatcagaaacaggaagaccattccctagcagtaggcaacagcactgcccggcttcagtggatgttttgagcggactcatcagccacctaagaattgatagtgcagcttgcctcttatggtggcagtgttggtagtgatgttcattggagcaatgagatcaaagcaaccaaccttggaaagcaagagctttggagttcctgaggggcaattttgcagctctaggatatctctgcctcaggagtgatgggccctgaaggcttgctggcacaatccactgcccatgagaactcagggcaaacacgaaggtaactcaaaggaatgtctctttctctgagaggcttttggcaaacattctgaaaagcattatcataatctaagtatggtaatataactaaagcaggaagcatttaaaatatctacctcctagagcttggagcactttctttgggacacagtaacaagcaggcacaaggtaactactcactaggccccagcaatgtgaagcaggaatagcaagagctgcagtaagcactgctaaggtcctgagacccaggagtccaaagacagatacacctgagctgatggatcacctgctgtacttccaaatagaaattgcttttactgcccctgctgcttttcagttttgagggtgggtagttaatcaaccagtatttattgagcaaaacggactgaagtaactagatacaggtattcagaactaagtctctaaacacagagaattgtactaaaatcagtagttctgtaccccagaccagaggggacatttggcaatacctggagacattttttaccgtcctgactggggagggtgctattggcatctagcgggtacaagccgggatgctgctaaccatcctgcaatgcacaggacagccccacaaccaaggatacctgggccaaaatgttagcatgccaagactgagagactgtaggcctagcaaacctggattctcatgtatcctgtcaccagagagtatgatttttatttttgggttttttgctgtgggcagtgggagagtcttcataacttctcccctactaaaaagaaagcagtttttgctacactttaaaaaattagtttctgagtttagcagtttctatcaaaaataaacatgccaaataactttgatctataattctacctctaggcatttaccctataaatagactcacatgtaatatacaaagtataatagtatataaggatattcatcacagcactgtttgttaatagcaaaagactgtaaaccacttaaatgtgcatgaaaagatgacttgttaaataaatcatgatgtttctatataatgcaatgcttcccagcactttgggaggcggaggcaggtggatcacctgaagtcgggagttcaagaccagcttaaccaacatggagaaaccccgtttctactaaaaatacaaaattagctgggtgtggtggtggggtgcctgtaatcccagctacttgggaggctgaggcaggagaatcgcttgaacctgggaggcggaggttgcggtgagccgagatcgcgccactgcactccagcctgggcaacaagagcaaaactccgtctccaacaacaaaaaaaaaaaagccattctatgcagccatttttaagaatcatgaatgagtaaagtagttttatatgttccaaaatggaatcatttcagagatgtactgtttgtgaaaaaagcaagatacaaaagatatgtagaatatgctgccatttttattttagaggagggagtagaaaggggaaatggggtgaatgtgtgtgtgtgtctgtgtaaatatacttccatatagcaggaatagctctacaaaggtacacgagaaaataggtacattacatggaaatattgtataatgataaaataataaaagagaaaataggcacagttgtagaccctttggacaaagggtctagagtactggtatcatattccctttgatacagtttgaaattttggtatagtttgaatttttttttcctctcatggcccatttctaacaacccagcctatatatttttaaactttattatgtatttatttaaattaacaaaaaattgtatatatttatctggcacaacatgttgttttgaagtatgtatatatcgggaagtaaattgagaaacgtatttaaaagtgtagagtgggccgggcgtggtgactcatgcctgtaatcccagcactttgggagactgaggcaggtggattacctaaggtcaggagtttgagaccagcctggccaacgtggtgaaaccccatctttaccaaaaatacaaaaattagccaggggtggtggtacacacctatagtcccaactacttgggagcctgaggcaggagaatcgctcaacctgggatgtggaggttgcagtgagccaagatcgtgccattgcactccggcttgggcgacagagggagactccctctcaaaaaaaaaaaaaggtacagtggaaggtcttgctttctgtctcccatccaacttgtttccaactcctctcaaccccacacatacaatccagagaatatattcagtggcttttgtgtgtccttccagaatttcttcatgcaaatgcaagcaaattcaggtatatattctaatacccccttttttatgcaaaaggtagcatgcttaaagctctgttctgtatattgcaggtcatgttaattttaaagagtatgtgtatttagccaaaaagtagcaattattagaaaaattacttgtaaaattgtacttttgtggctttgtttttttactatcttgtcctttctgcctcaggtggaacaaaattgggccacgttacagggaggtgagatgaccatccagacgacgcaagcatcagaggccacccaggcggtggcatcgttggcagaggccgcagtggcagcttctcaggagatgcagcagggagctacagtcactatggcgcttaacaggtggtggcaagagtgtgggaataagtgaggatcgcaaatctgtccctgcagatatgggtggaggccccttaaagagaaatgtgtctctgtttgccacagttggcagttggaacttaacactcttggcccatacgatattgtagtttggcctataataggtcagtccttaccaagaaaaattaaacttctttccttcaggtgtgcttaggaaaggtgatgtgaaatggaatcctccagtaaaaggtagtttccaaaactcaatgtattgtttcctgcttagttccttctactggctgttgatggaaagatcatctccgcatcattcttcactcctgccgccacccagccccaacaaccagtgtagcctttctgacttccagcccaagctggtcaagccttcccgtttatcctattctgtgtccagtaagcagaagcagtaaggcttgagtgcttcatgttttcaagggatacagaacaaattaagaggcttcggattattgtccttttgccctacaaaagaaactgcattttgttgggggtattaatccatgtttaagcagcaaatggctgattttacttgcttttgagaaaaatgtgttgcccttgcttatcagcgagctcaagataaataagttttggattattggggaaaataatgaacttttttcttcaggtatgttaggaagggtgctgccaaatgggatgctccaagaggtggtttctgaaactcgattgtattattccctgcctggttctttctactggttgttgacaggaaagatcagcttcatatcattctccctcttcttcattcctgatgcaattttatttttaatgggctcagggatttaaattaatggtcaagagtgtgagccttgacgccagactacttgggtttgaagcccagctctgtcacttacaagctgtttggcatcgagcagttgatttgaactctcagtagccaggctctcctattctgtaaaatgggagtgataacagtacattcttctaggagtgttatgagaactgaattactccatgtgaaatccttaggtcagtgtcttgtatacagtaagggctgaactcttgcggcatgccagctctactgggtaaggctgtaaatagagaatagagtgctctagcatatactctgccctcaaagaaatcatactcttattgcggagactgatttaagtaaaacacttagcaaacagtattacttagagtgtaactcactattgaattgtatggtaaagactatgaacgttgtagaaattcagaggagggtgatcacctcccctaaatataaaatcagtgaaagtttagattgattatgatagatactagagagctgtgatggatttgtatacagttcactgtatgaggctgtatagtatggtggctgagagcagggttccaacgtcacatagattcaggtttgaatcctggctccaccatttgatcctgagaaacataacctctgagccttgttttccccattgttataatgaggataagactcatcacacagaatcatgtatatgagataatatagataaaattctcatcgcggtgtccaacctatagttagcatttcaagaattatagttattatcatttaagttgtattttaagagttgtctattctgaattgattatagtgagaggagattagaagatcagttaggaagaggcactccaggagcgccttgttaaggtcttggaaactgaagtagtaagaatggaggtaaagtgattcttttttttttttttgaaacggattttcactcttgttgcctaggctgaagtacaatggcatgttctcggctcaccacaacctccgcctgccgggttcaagtgattctcctgcctcagcctcccaagtagccaggattacaggcatgctccaccacacacggctaagtttgtatttttagtacagacagggtttctccatgttggtcaggctggtctcaaactcctaacctcaggtgatccacccgcctcagcctcccaaagtgctgggattacaggcgtaagccaccacgcccagcctaagtgatttcattttaaaagaagtatggccagagattggtggttgattaggaataggaaactgaaacacacacacacacacacacacacacacaacacattcttgctcagagttacctagttagtccctagtgatcagaacatttttttcagcccattgagccatgttgctcttgttgctcttcatttctttttttcccccactcacgtatatactcatcatgttgcttttcagtaacatgaaagtcttacttggttccttacacttggctcaattctacccctctctttgagagaaacacccagataaacttcctgaaaggcatggccaagtgagaccctccgtccctttagtccagtaacaccccccattctccgcccgactgtagcttggggtctaacaggccctcattaaagaccagcaaaacttgatttcattgagacttgcagccaacaccttggatattccagtgaagtgtgtgtgtcctgggaactctgtacatagtggaaaatatgaggcacatttgggctctctttgttataaggaccagggcttgtttctaaaggcaagcgggtaatggtatcccctgagggcttgttaacaaacttagatgcagctgaggtggctcagtgtttactccaaaggaaggagaatgtgttcactgtggcatagaggaggaataaagagatgttgaaatctctttgcaatcaggtagttcgatgccccaatgagtgttaggggttggtggattgcagcttctgctggggatgaagaaaccaagcctggcagcagagactagactatagcagactattaggggaatatcagggctttctgaacccaacagaggtaacccatggtctaatgtcttagtcaggagggttggatgtaagaaacaagcccttaacattcgcttctttgtggacgagatgcagtagaatcatttagtccttgcactctgagcctctccacagaatttgctgttggaagtcatctcagtaagaaatacacagagaaatctggtctttgttcctatgatgacaaagcagtttcataatctgccctcttgcagcttgctctgttttgggtgcagataaaacaagcatggttctctaataaccacctgcacctctgctgcaatgtaaacagcagatgtgggcgcagggtgagaagggagaggaagctacgtgcaatggcaggttggggaataaggaggcagaggggctccttcatcttttacagggtaaaatgggatcaggacagttgcaggacagacttgtttctcaaccacgctgttaagagaatttcatactgcaagtcacaagggcccagggctccacggcctttagcccaccctggctttctaacaacccaaagtgggtatggagaaattgtcctttaaaaacctaaaaactatgttaattttcattttcaaaataaagaataaatcagcacttttggaaaggaggtgggaagggaatcaaagtgaacaaatgagcagaacatcacagctttaaaaaaatttgtgtgtgtatgtgtgtgtatatacatacatacatatatataataccatatatatgtatataaaaaatagcttatatataagctatttagcctgaacaaccagagaggaaaggaagtaatattatcatttacttgtgatacagtgattaatttgaactttcagttctttggttaagctgtcctggacttgtagttcctcttaaacatgtccttctacaaacccatttcctgaatatggccagtatagtccttgcatgtagagatcatgatttggctttgtagacttactctacgtttctaaagtagtggaaacttacttgatagtatattgttaacactgagacagtatttattgtgtgtctactgtgtgcagggctgtgactcagtgctatggggaaatacttagattaattcctcttctcaaggaattttagaatttgtctttttttttgttgtgaagattttgcttttaaaagtcatattttgaaagaaaaatttgctcttagtcttttttttttttttttattgagacagagtcttgctctgtcacccaggctggagtgcagtggcgcgatctcggctcactgcaagctccgcctcctgggttcacaccattctcctgcctcggtctcccaagtagctgggactacaggcgcccaccaccacgcccagctaattttttatatttttagtagagagggggtttcactgtgttagccaggatggtctcgatctcctgacctcgtgatccacccgcctcagcctcccaaagtgctgggattacaggcatgagccaccaggcctggctgctcttagtctttaagatgaaatattattgacttaaaattagacatattattaaaataaaatggggcttttatatacggagtgatatttgtccaataaaatgggatggaaaacttagatcagaaatcttctctggaagagaagtcagggatggtacaactgcttttctttcctacaggtaaagattagacgcttacagataaaaggttgatggaaacctcttatttatagctttggttttgaaatgacttttgtctaaaaattgtgaagtggtctagctcagggcctttttaatccctattcacctttttaagtgaacataatctttttctaggctgggcgtggtggctcacgcctgtaatcccagcactttgggaagccgaggtgggtgaatcacctgtggtcaggagtttgagaccagcctcaacatggagaaaccccgtctctactaaaaatacaaaagtagccgggcgtggtggtgcatgcctgtaatcccagctagtcgggaggctgaggcaggagaattgcttgaacctgggaggcggaggttgcagtgagccgagatcacaccagtgcactccagcctgggccacaagagcgaaactccgtctcagaaaaaaaaaaaaaaaatctttctagcagtttagtttggtcgtttcccataaagttgagtgtaaaaggttagaatcactctggaaatgatagccctgcttaccataggcatcatcgttgtcttcatgccccacgtaaagaccttaactggggactgaataattaatcgtactgacctgtcaacctgtcacccccattgcattggacccctcatccctggcattccagattgttttaggttgttgctggttttcagcttttcttctaccataccacattttagaaagaagttaaagaagataacttcaagtttttagggctttaagtggaaatgagtatgatcagttgcaggtacactttcctgtcaaggcttggggagctgccctctcccttcactgcccatgaaactcattctgccagagtgtgttcaggatgtacaggagtggcaggatgtcatctttgatggtcataaagatgagattattgtaaattgtaagaataattacaggaaataagcagtcactgaggtgacctataaacaaagatcctaattccatataaacaattctcatttacagttttcttcttcagactatcacacagctttttccaaagagtatacttttctgctttccataaagtctcaggtcacagcgtaaatatttgtatcattaatcattgacaggtggatgctgtaaaattggctggtcatatatttatgtatctttttctttttttttctccgacataggtaattaataaaatttccaggccgggtgcggtggctcatgcctgtaatcccagcactttgggaggccgaggcgggtggatcacctgaggttgggagttcgagaccagcctggccaacatggagaaaccccgtctctactaaaaatacaaaattagccgggcatggtggcgggtgcctgtaatcccagctactcgggaggctgaggcaggagaatcgcttgaacctgggaggcagaggttgcggtgagccaagatcatgccattgcactctagcctgggcaacaagagcgaaactctatctcaaaaaaaaaaaaaaaatttttttcccagtggttggtagtagtgtttattaacataactttcttagcaaaatattaaaaattaagggcctaggtactaaaaaatattcattaaagtctctctaataaatactttaaagcactttaaaattaaattctgtcatgaaaaatgtaaagaacagtcttagtagtaattccagatcaagggtctcctgttgaaaagacagtcctttccctattgaatggtgttggcacccttgtcaaaaaccatgtgaccatataggtgaaggtttatttctaagctctcaattttattccactggtctatatgtttgtctttatgccagtactatacactgttttgattactacagctttgtgttaagttttgaaatcagaagtgtgagtggtggtgctgggaaaactggatatctacatacaaaagaatgaagttggacctttacctaacacagtgtataaaaattaactcagagtggttccatgacctacaactataaaactctttgaagaaaacatggggcaaaacttcatgacattggatttgccagtaatttcttggatatggcaaaggaaaaatagacaaattggactttacgaaaattcttaaaatgtgtgcatcaaaagactatcagtagaggaaaaaggcaagccacagaatgggagaaaatatttgcaaattgtatctgataagggattgatatccagaatatatagggaatgtctaaaactcaacaacaacaaaaactctattcaaaaatgggcaaaggtcttgaatagacatttctccaaatttctccagagaagatatgcagatggccaataagcacaggaaaagatgtgcagcatcactaatccaaactacaatgagatatcacctcacacccattaagatggccacaatccaaaaaacagaaaataacaagtgttggtgaggatgtggagaaattggaacccttgtgcactgttggtgggaatgtaaaatgacatagccactgtggaaaacaatatgataattcatcaaaaagttaaaaatgggactaccgtatgttgcagcaaatccacttctgggtacatatcccaaagaattgaaagcaggatctcagagaaatatttgtatgcccatgttcacagcagcattattcacaatagctaaaacatgggagcaaccaagtgatcatcgacagatgaatggatacacaatggaatattattcggcctttaaaaggaaggaaattctgacaaatgctacgatgtggatgaatcttgagcacattctgccaagtgaaataagccagacacaaaaggacaaatactgtgtggttgtatttatgtgagatagagtagtcaaaatcacagagacaaaaaataactcaaaatggatctaagacctaaaactatcaaactcttagaagaaaacatgggggcaaaatgtaatgacattggatttgcctgtgatttcttagatatgacaacaaaggcacacacacctatagttccagctatttgcgtcaggaggctaaagcaggattgcttgagcccgggaattcaagaccagcctgggcagcatagcaagatcccatctctaaaaaaataaaaacaaaaatgaaaaaatcatcgaggcagaaagtagaatggtggttgccaggggctagggagatggtagaataggaagtttaatggtccagtttaaagttccagttttacaagatgaagagagttgtggagatgaatgatggtgatggctgcacagcattctgagtgtatttaactccctgaactgcacacttaagtgttaagaatgtaaattttatgtgcattttaccacaacaaaataatttttcaaactgtacagtacaatcctaattattatcttttttttttttttgagacagtttcactcttattgcccaggctggagtgcaatggcatgatatcggcccaccgcaatctccacctcccgggttcaagcaattctcctgcctcagcctcctgagtagctgggattacaggcatgcaccaccacacctggctaattttgtatttttagtaaagacggggtttctccatgttggtcaggctggtctcgaactcccgacctcaggtgatccgcccgccttggcctcccaaagagctaggattacaggcgtgagccaccatgcctggccttatcttatctttttgaagttgtatttaagattagaaggaaataattatgatatttaaaattttcttttatacttaatagagtttgctcaaactttctataaaagcaagtatactgcttttattatcagaaaaagataactgtttaaaacacaggcataaaaattaaaaagcaagacaaattagtaagaagaggaaattcttctatttaatgacacttttctgtccattcggtttcttttcctgcttcctaaaatccttacagtgaccaagaagtcttttgcaggggaattactatatctgttgttttacttgtgtgctgactgtcttaggtaaaggagactgtattgagtttggtacatgttgctttgcccacagtcctaacatgtttactccaattagtccctgtccccttacccacctccacttacggcttgtgcttacaagaccactgccatgttacagcaaatcctgcagcttcagagcaaagctgactcgactggcttatttgtccacttctgctaaactaaatggcaccaccatctctattctgtgcctactggaattcgatagtccctcagtaattgcaaattgacacctgatactttaccagaagggataatgaaattgcctgttttttcacatttttacatctctgaaatttggatggcaaattataatcttacaattgtcaggaatttttcttccttactggcccatgaaataatagtatgtcttacagtttgtagcatcatagaatcaagaaaaatgggtatttatgcacatagtaaaagcatatagcaaggaaaagaaagaaaaatgggacacactgctaaaatagtacttgctataaacaaatggttaatgtcttcctattctacagagcatttgtgctatgtagggaggtttattattttgttgtaattatagaggcaaactgtatttatacagtttggacttgcagtgataattttaaactttaagtctttgttttagccctgcctggatatacagtgagtcaaagggaagagctggacttttcaggatattaatcagccattactctgtatttgaaaagcataactataaatcaaattaatatttagtgttaattgaagagtgagtccaggttgctgctgactcctcatattatcattcatccttggctataaaaggacagtctcagatggtctgccttatgttactgtgaggagaaaagagaaaaggaaaaccttgtgattgacaaccaaaatggcttttgcattgtgaatatggatcagagctttcactatggcttgcaagcactcagctgatattgataaggaagaaactgataatgagtgccttctgtcctcaaacactcaattaccgaggttctgagaaactctcaccattagctttatagctatgtaagacttgagatttctctagccattaatattatttcaaaattactcttggctttatctattagcactgttatcacatatttgctggtaggatcacaaccatggagtcagtagaaagacccaaggaaggcattgaaaggatggtttgtcttggctgcagtgctgttcctctattcatcatcctctctcctgttcctgtgcccgcagcgaagctgccgcccatgctgtcgccaccctggctgaggccaccttacaaggtgggggacagatcgtcttgtctggggaaaccgcagcagccgtcggagcacttactggagtccaagatgctaatggtaagagagcataaatattttattaaatttcttccctgtttccacttaaaccttcctgacatgactggcaacaaagccttcagaaagagtttgagcttcgatttttttttcttcattggtagacatttcatgcctaggaatattctgggagcctgtgattcctttcactagtaggaaacatgggggttcctgaaggaaaatactgtgataatggctacctaattgaattgttacttaaaaagtgattatcgtcttgtgacaagacttgctgagaagcaccttaaaattcactgtgagccacattttgtcttttactgtctcatcggatagggtagatcaatgtcctttactgtagcagagactctctcatgggcaggaccatcatggaaagttctgactacatcaagaaaggcgccaatgtctcacctgtgcttggggtcaggcagcaggctgtgatgccggtgcctctctggttggtactgtggttctgcttcctgttatatgtagcctcacgaaggacctttggatttagccaattacatgcccctaccctgagcttcttccccagctctttgacttcctggacattggtgaatatcctgaataagcaaaagggataaaattcatagaaatatggtggcaaaaatatacaacttcagcccagttctttgggtccatgttggtaaggagtcagttggcaagacaagctgcccaaggaagtgcctcagaagtctgggtcaaagaggagggccagatctgttctgtgagaccctatgtgattgttatatttttaaataatatataattaagcaggacaaattaaatactccatggctttggggaaattgttgctttaaagtcctggaatggggctgggcacggtggctcatgcctattaatcccagcactttgggaagccaaagtgggtggatcacctgaggtcaggagttcaagaccagcctggccaacatggcaaaaccctgtccatggtggtgtgcgaggctgaggcaagaaaatcgcttgaacccgagaggcagaggttgcagtgacctgagattgcgccactgcactccaacctgggtgacagaatgagactccgtctcaaaaaaaaaaaaaaaaaaaaaaaaaaccaatcctggaatgaggatagataaataacatactttcatcatgtaggcagaaggttccttaatggcattagtggcagaaagaaaagtacctggcactttgtttatggtaggtgcctaagaaccgaatgctctgttagttggaaaagtctttgaagaaagacatagtgctgtgtcctcctttggaataggaggaaacaaagtacctctgtcccgccagagaagaataacataggaaatgcaaagagccatcgtggcttctgagaatcattttccaaagatgccaaacaaattcaattctaaaactatagcctactttttctgtagggaaagaggcttttgtgcttatctaaatctagacagagttgatctcaaccagaatgctgtaggacaaaggacatcttatagccacacatgttcaggatgaaatggaccatggttggaattaaggagaacctctctctctagctagactcctacttctatttttttacctttttctattcctcatcagagtcctaaggcaccctgagcaaagggtaggatatctggcttatgtggcattcatgtgaagtgtgattgctcttattcactatggaactgctaaaaataacttcccatgtgggttcagtaggaaactttattatccattctaatcgacttgacctgtctgggagagaacagactgctttataattctggctcctccccagcatcaccttttcagatggatgaatttataggtaagtccaaggaccctctggctctcggccaagtagaaccgttcagccatacaataaagttgaaccacacccgctactattgattactggaagctgcctcttttcagtagcattgggttgtgtgaatcatttggtgtgatttcatgttgttggctacatttgtgatctgggaaaattctggttcgcatcctaaaagccagtatttcccccaaagcaggccatcctcagtctgtgactgccagtacttgctgaactcaggccttgagagttggaagttatctctttctgaatgcagcatttctgtatcaaatcagacccttgagttgtgccgtatcccagcagttttaggcaaaggccaatcatttcatctgcccttgggaatccaaagaatgaatctcatatgggatatgatccaagtaactttgataatcctcttatcttctaacatttttgcccacagtgctatagtatttactttgggattggaaccagatttttccctcttaatcagcaattttgatatctggctagacttttagaggttctctttttcatcattctttcggattctgtcctgttgccagagtttgttgcttctttttgtttttgtttttgttttttgagacagagtcttgctctgtcacccaggctggagtgcagtggcacaatctcaactcattgcaacttctgcttcctggaagttccaatgattctcgtgcctcagcctcccgagtagctgggattatagacgtgccacaccacgcccagataatttttgtgtttttaatggagatgggccatgactggtcttgaactctggcctcaggtgatccacccacctcagcctcccaaagtactgggaatacaggcgtaagccactgtgccgggcctatgtttgtcacttctgggcagacaagcttatggtatctgccagtaggtcacatttttttttaatcttttttctttttttaatagaaatgaggcctctccatattgctctggctggtctcaaactctcgggctcgagcgatcctcccacttttgcctcccaaagtgctgggattataggcatgagccaccacaccctgtccaggccaagtttttttaatcagaaagagtttattatcaggaagaaccagatgatagcagaacaaggtgctgtttgttgacatagaactaacttggaaacagatactacttaggggaaaacatgtatcccatatttcagagtatggtttaaatcaaaattggaatagcagatgactcttctgagagcaatttggatatcattcagttctgaagtagaaagagtttgtgggatggaactagcagggatagaggaccactgcatgtggagcctgatgaagtccataaccattgggaagtggcgcgggcgggtgaggttatgaagcagtatcctaggggatggtgtttttcaagttagagataatgacccataggccaggcacagtagctcatgcctgtaatcccagcactttgggaggccgaggtaggaggattgcttgagtccaggagtccaagaccaacctgaacaacatagtaagaccccatctctacaaaaattttaaaaaattagccaggagtggtggtgcacacctgtagtcccagctacttgggggtctgaggtgagaggactgctagagcccaggaagtcaaagctgcagtgagccatgatcacaccactgcactccagtctgggtgagagatcaagaccctgtctcaaaaaaaaaaaaaagccaggctcagtggctcacacctgtaatcccactactttgggaggccaaggtgggtggatgacctgaggtcaggagtttgagaccagcctgaccaacatggtgaaaccctgtttctactaaaatacaaaaaattagacaggcatggtggcaacacctgtaatcccagcgaatcgggagttccaggcacgagaatcgcttgaacccaggagatggagattgcaatgagctgagatcatgccactgcactccggcctgggcgacagagcaagactccgtcttgaaaaaaaaaaaaaaaaaggtaatgacccatgcaagccagaagtttaaattttggatcaccaaagcagacctgatgaagacattgcacctagcacctgcgcaccctgaagacttctttctggacatgtaccccacactaccccgacactaaaggaactacccaagcactcacattactttatttctatgttctctgtctttttcaatagagtctttggtctcttaggatggagtttcatggttcggttcaatataaagattttcacagatgccttttcatttagatgtaggtagaattgcctaaggctggtgaaggctaccagattaattccttcctttacttgtttgtttgtttgtttgtttgtttgtttgttttgagacagggtctcactctgtcacctagactggttcactgcagccttgacctcaggctaaagctatcctcccacctcagcctactgagacgctgggaccacaggtgcgcactgccacaccgcgctaattttttaaattatattttttgtagagatgggatctccctttgttgcccaggctggtctcaaactcctgggctcaaaatgatcctcccgccttagtctcccaaagtgttaggattataggcatgagccactacacccggccctttacttcattttttgaacatagttatctcaatactcttttcatcttatacaccttaatgtaagaagtcatacagttcagcccatttgtttttcttcactctgccttcctctctgctggtccccagaaccccctgtgttccaggactcctgacctccaggactgacagatacaggcattcactcagacttgaggagctctttgctgagtgcctctcacctctcacccagaccttaacacccattgttggcaagcctcagaaaaccaggcctatagacctttctcttccttcctattgcagcaaacgtaatgaaagagaaggattatattggcacttggccacctcagaaacactcttctgtctgagatcttattgcagatttatacagctatctttcattcctgaaaagtagatgggggaaaacaaaatagattaacaagttcgtaagtattggttggtgcaaaagtaattgtgggtttttttgccattagaaggaatggcatatttgaagttggtgcaattactttcacaccaacctaataagcctcttagcagagctgctaagaaagcatcagcattttttaatatagctgacacttttcctaatgatgctacaagaaaaaagagaggatgtagcatttgctggtttggagtggggtttttttgggttttgtcctttggggtttttgtttgtttgtttgtttgtttttgagacggagtttcactcttgttgtccaggctggagtgcagtggctcaatctcagctcaccgcaacctctgcctcctaggttcaagtgattctcttgcctcagcctcccgagtagctgggattacaggcatgtaccaccacacccagctatttttgtattttcagtagagacagggtttctccatgttggtcaggctggtctcgaactcccgacctcaggtgatctgcccgcctcagcctcccaaagttccagaccagcctgggcaacatggtcaaaccccatctctactaaaaatacaaaaattagccgggcatggtggtgggcacctataatcccagctactcaggaggctgaggcaggagaattgcttgaacccaggaggcagaggttgcagtgagctgagattgcaccattgcactccagcctgggcaacaaagcgagactgtctcaaacaaacaaaaggttcatcttttaaatttgaaaaaacttttattcaaaattccaaagagtgttttgggaatatgaactttatactgattttaaagttcatttgaaagaataaaacctgccgtgtgcggtggctcacgcctgtaatcccagcactttgggaggccgaggcgggtggatcatgaggtcaggagattgagaccatcctggctaacacagtgaaaccccgtctctactaaaaacaccaaaaattagccaggcgcggtggcgggtgcctgtagtcccagctactcgggaggctgaggcaggagaacggcgtgaacctgggaggtggagtttgcagtgatccgagattgcgccactgcactccagcctgggtatagagcgagactccgtctcaaaaaaaaaaaaagaaaaggaaagaaaaccctatcttagccattttttatgctaacaagcctttaaacagaaccactaataaactgtaaaattgactcaagttttctcctctgcttctaccccagctttccccaggttcagggttatagggagttttcatcacagagatggaccaggtgagggaagcaagtgttcttgcactttgaaatttcactttctcctttatattcttttgatttttttcaatttcattttttgtaataaagatgttagtggaggcccgacaaagtagttcatgcctataatcctaacgctttgaaaggttgaggcaggtggattgcttgagctcaggagttcaagaccagcctgggcaacatggtgaaaccctgtttctacaaaaaatataaaaattagcccagcactgggctcatgcctatagtcacagctactcaggaggctaaggtgagaggattccttgagcccaggaggtcgaggctgcagtgagccaagatcatgccactgcactccagccaggatgacagagtgagactccatttcaaaaaagaaaaaaaaaagatgttagcaaggcataccccacttgtggagctctctgacctaggacatcaacatacttctcagctgttgaccttgcattctgtctctcaatcctgttgtatcattattttattcatttaacaaaatttacataatcttactatgtataagcattctaagtgttttacatgcattatatttaaaacgcatgataactttatgagtaaacactgttaaactgatttaacacatagggaagctgagacacagaaagtttcagtaacttaaccaagttcacatagagagtggcagacaattcaggcaatttgtttccaaaccactgtactacactgtctccctttgatgtgagctctgggttcctgcctagactccacaaatacagggtgataaccattgttgaacaaataaatttggaaatgtcaaacctttccccacccctgccagaggctgcttgccttagtctagtttagccacagcacccatctgcccagctgttccgagggctgtaggggtaccctggaggttcatgctgctgagtgccccgggctcagcagccctccctctgcacacacacaggcttgcctttgctggccagaggagccgacaggtctgtatgcttctccggttgcagaactcatcattggctggctgtcagccttaaacattttcagtgagcagagtactttgcaattagtgaatgtgtcttcttgactggagttgggtggtgggctacgggtgctatttagagccagggaaactaaggggaagtagatgatgttcagaaggaaggaaccccagcagacgagttgtttcatcagctcctagaagcctctgctcaagccttcctgctgcccttcagtttaggccaggactctttcagccttcccacctgtctctaacaaagttgagaccaaggtggtagggctgtggatcctggggaaagggtcaggggcgtgttcatttttgcctggagcgagtttattggcttatttgtttccccagctcctcaccgggtcttccacttggctctgcctacagcccttgcttggggtcccccagagattttgaagagcacatctgtctccgctggtcagcactgaagactcagaaaccacctatgctgccctggttaagactagggtctcaaccctccctcctcatgttctgaatgaagagaaatggactggagggctgtttaaaaattaaagctgctgggtgcggtggctcacgcctgtaatcccagcactttgggatgccgacgcgggcggatcacaaggtcaggagttcgagaccagcctggccaatatggtgaaaccctgtctctactaaaaatataaaatttagccgggcgtggtggcacacgcctgtagtcccagctacttgggaggctgaggcaggagaatcgcttgaacccgggaggcagaggttgcggtgagccaagattgtgccactgcactccagccaggctgacagagtgagacttcctagtaaataaaaaataaaaataaaatagaataaaaattaaagctgatgacaaggcattgtcattacacttagagaaggaacagcccttcgcaagtatcctcagggtagcgtgtcccacgttctgggctggtcctggcaacagtcttgctgctgaggttccaccttaagacttcaacgtcatattttctgaaactataagaccaccgggcgcggtggctgacgcctgtaatcccagcactttgggaggccgaggcagatggatcacgaggtcaggagatcgagaccatcctgactaacacggtgaaaccccgtctctactaaaaaatacaaatattagccatgcgtggtggcaggcacctgtagtcccagctacttgggaggctgaggcaggagaatggcgtgaacctgggaggtggagcttgcagtaagcctagaccactgcagtccagcctgggtgacagagcgagactccgtctcaaaaaaataaataaataaaatacaaaataaaaaaataaaattataagaccccaccctgccttactgtgctgtaaaacaaacgtacattttactatgcattccaactgccaaattaaattaatatagacatttctttagggaaaaacattctatctttttacactagacaatcttcaccttttcacatccctgttttctttgaccttattaaaaactttttaaaatatgtatgttttctcagcagaatttaatctcagcaatgctcaatagaatttttttttttttttttttttttgaggcagagtcttactctgtcttgcccaggctggagtgcagtggcacaatcttagctcactgcaacctccacctcctgggttcaagcgattctcctgcctcagcctcctgagagagcccagctaattttttaaatttttagtagagatggggtttcaccatgttggccaggctggtctcgaactcctgacctcaaatgatccggcctcccaaagtgctgggatttcaggcatgagccatcacgcccagcccaataggatattcttaacctggggtctatggaccctgagaaattctatacaaaggtatttgtatttttttttggtatctatagctttttttttttctttgcctccgctagcagcagggagggtattagctttgattgaatgtgtaactagaccagaggcattcccacccccacccccacccctgttcatctccagcccacaaaaaaaggttaagaacctctgctacagaaggtggtggtgaggatcatttaactttgtagatacctggtatagcactgagagtaaaaggaggagcaatggagaggggaggtcccgcagagctggagaccctaaaagctgaacctctaacaagctctgtaatcttaggcaagcaaattaacctctctaagccttaactgtaaaaattaggataatgatagttctgtactcagaaggaagttgtgagcattaaacaagatgattcctgtcaagttcttagcatagtgcctggcacagggatgcatcataaatataaaattctttagctgtcagcatcaatttcttctccatcattcctcacatatgttggagtgcacagtactatgtagacgctgctttcctgtctttaagacggatccgaatgcttgcctttcgcagatgaagatgtatgttgcagaggtggatgctgtaaaaatgggactagattagaagccctttctgtaaccttgactgaagaaaatacaaggtgacattgtttaaaggctctatcacttgcctttgtctagggctgctgttctcttctgcacatagtttgcggtcatgagtgtggcctttttactcctaaaatggcacaatgtgtcttcaaatctcaacagatgcattgtatttcaactctatcatgaaaggtagcttttgccattttttcctttttgtcaccaccatcatccatttttacttactgcatgtcccactgttccaactctttaaaaatgagagggatgatgccaatcctccacatgttagactgtaaaacacatctccttccacctttttctgtgttccttgttccctggacacatcagtatatgggcttgttctcacaagagtccactgagatgtaaatgttaatttaggaactgtattattgtttctccccaaaaaggttgctgatgtgctattccagtgtgtactaaatcactttttgcctcattattttaaagtttaaataaatgaatgtattaaatagtcttagtgtaagagtgcgttttcagtcaccataagcataatagccttaaaagtgctgttgtgttctatgacactgtgatactatttgtagcttttatccaaagatggtaagctcagtgcctcaggacttgaagcaggcagcccctaagcaactgttttttgtgtgagctgtgagtcccaggatacaagcctctcatcttcaaggtccccaaagagcagcacagctggtagctgtggatttttaggctgccctcctgtaaggtaaatggtcttttccacccactcccttgttgatagagtgccttgagagaaaatgaagacactagagtgctggtctcagactgcgctgaggcatcgcctgttctgtaagaaaaagcaaatgaagattcatgtgtattacaactgtttctcctttggaatcacaggccttttttaaatagagggggaggaggggatagtcctagacctgaaaagattccttcttgtaatataaggagagctgtgagctgtggatcaaaatgaagaggagtgaggggagtatgcagcgttgcctgtggctccagctgagctgggagctggcggcttttcctgggaactgtatgtggtgcagcaccttgggacagcagtgtctcttagtgtcttccacacgcccccctgggaaataggctttctttgcagacagggactttcccatttaagtcagctaacttttctctaagatgaatcgttttcattctgggaagcatgttggtagatgtcataccaggaaaataaccatttcagtcggctgtaattttgccttttggctatacacattgagcataattatttagggtcttcatctttttcctttcattgtccattctttcattttgtttttttactactgctacaaccaccaccactgccaccatcatcttcttgcaaatggctaagcagtgtctgcattattctaccttcacccagtaaactgagtagaatagatcttctgagccctgttcagaagcagctaaaaccgggacttgcccaggatctgtcagctcttaaatagtaagactggaaatcataccagatctccagtactctttctactgcccaatgaaactcccttcttccccttcactccctcttgccagcttagcctacctaggaagtaaagaaggcataatacaaatgaaaatcatggcctttattattcatctggttatgctagtacttggtgtggtgactcctttgcaggattattttaaagaatggtggcagctatgttttactcactttagaagtcaaagactcacggtaaatcttagcagaggcaaataaaaacatgataccaaaacctaacatctaaatctgtactgtccagtatgatagctgttagctacatgtggctatttgaatttaaatgcaagttgattaaaatgaaataaaatgtaaaaggtagttattagtcacaatcatatttcaagtgctgaatagccacatacgccctgagatactgaatttttaatttaattataatttattcacatttaaatgtaaacaggcacatgtacctagtagccactttaatggactgtgtagatacagaacatgtctatcactgaagacagttctattgggtggtgctgatctaagggctatatcaataacactgtggtctcctggcaagttgtaccctctctgtacaggggaggacaacacaaatacttcatgagctttgtcttccagtgaccttctcagctcataaacagcatggctttgcttttaaaaaaaaaaaaaaaatctacccatgtgactgcagtaatccgcagccagtaaacagcagggtgggagggttgcgaggagaactgatctatttttatgcactgcagagtccaagcaggaaaacctgagaccggagacagtggtgacatcaagactcacttcctagtgagtttattcatgactcaggccatgtgcatatttccacttggattcctcacaagtgcaagtttctcttctaggctacaggtatctgcagccaggtgctgtaatggatttatagtagcccgccaaaagatcaaatatctgaagcctgacgggtcacaaagctgacaggagccatgactattgcatgaattccagatttcacagtgaaacagagctgctgctgaaaaatgggagcacagagctgttcactggggctcttgattctagacactcaaagaggggtacagttctctgccccatgtgtgtttctcacccaaccttttcatggtgttgaggaggggaagggacagctcagtggtgattcttcacttctcaaacgtgtcctcctcctctgtcttcataatgacctcctgaagtccaaagtgccttccaaaatagctcttggaaagaggtggcagtttcctgactccccaatctcccccatcctgggagatgtgttgatggcactaatttgcggggtagcagagactatagtcctactctctttactggctggggcatcggaggcatgcagtaactgttgactaccactgctacaactgctgttatgattattaccattataatgattaatcactcacaccgaatgggaagggaagtaaccttcagaggttcactcttagtacttctggcacatatgcttagggccagggccagtgagtcttcattcgcagagaggtggtagtgaatctcccacaaggatccctacttcgggaagcctgtgttcctggtggaagtcccatcatatccctcaggcatactgagattctcttctctagaattaccaggccttttctgtcactcctcaggcataccccccgtagctggagggatttccagttgccagggttctttggtgcttttctttgcctcctgcagagatgctgagctgtggacaccttcagaaagaccagcactgcctcatgagagtatctcctgtccctctttgcgggtttaggttccttgtgtagtctgcacatccagaggggatgtgtcattctctctctaccattataacctggggtggcctcgggcattcatcgtttatatgccaggaattgctaacctaagctctgctatttgaaggcttaaagactgcagatcaaaagtagacacagagggcctttacaatgagatgataggccagtagctgtcattctttattcttagtgctcatctaagccatgaccatgtccttcagatgtagcttttagatacttttcatgtgaaagactggatacctctagtcgacatgtcagggccccaaaggaatcaagtccctttggcataccttcatgtcctcttttttttgtttttctgtacttcaatagatgcaaattcatttactctttggtctgcctgtgttgggtattctcagcttggggaaactcaatgagccagcacaccatcctatgaacagaacaccaatctgagccagggacattccgagcagacaactcaggtcagggcttccggacagattcccaaggtccctgccatctggcagatggacaccactgactgtggtctcctctccatccacggtgtcctcaaggccaagttacatgcttctttgtctcattctccttccctttaggtccgcagatctttcggagtctttgtatgtaaaggcagattttggtcttagattattccagctccttataaaccaagactgaatcttgtgcctgtcattgtgagcgctattctgtaaagggatttttttttctggcataccaaatccagagccataattggacaagtttaattggagtcatttctattcaatacatggatggcaaagtgggttttaattgagcatgtaaaaagggcattaatcactgttcacacaggaatcacaatattagaacaggaaaaattcttataaagtttttcaggttcttgggtaaaggggactttcctctttttatttatgcttccattaggattttgaaggaatgccagtgcactgttattaactctaatagcttgtccctcgcagccaggatggtttggggccctctggctctcaggttacctgtgtaaatacagggattcacttgccagcacccagctctgacatttgcttaataaagagcaaatgtgcagaacccaacagcagcagcagcctggcagaagcagtaatctgaacaggataaacatgcttcctctttgtgcgatgctctttctccatccttctgccaagagcaggatatcaaatgaaggggaggttgtggttggagtcagtgaagtgaatgtctaagtggcacctgcttcattcaacagatctgctttcctggggcctcccagtgcacatctgctcctgacaaagcctcttttctcctcctattggtcagactgagagcaaaggcctggcaaggagacatactggttttgctttgtcagcacaattgcctgtgacattataattacaccaaatcttcattattagaaaggccccaatttagagattttcagagcctaaatgggattttctaagtgaaattgattaaaaaaaaaaaaaaaaacaaaaaactttgccatcataaagcctagcaattgcatctgagaatcattgaaggggtctaaatatggaaaccgagacactgctgtgagtgagactacaaagaccatgctatcagattggctcgctagagaggcgtccagcagtcttccgactctgcccagcccatcctctccttattcccgtagcactgtaacatgcagatacctacactgcattgctctcacatgctgatagtttctcatgcagaggcctggtgggggaggggctggagggtgttaaaataagttgatgaggtatggcagtaaaggaaagaacctgtgacttaaataagggaaataccagaaatctatattttaggtgaatacaaagcatccaatttagattgagtttccatttaaacaaaggcaactcttaagagtgttgcacagtgtgagtgtatgtgtctgtctgtcggaggcacgtttatgatatggagttggcacactggaagctctggaaaggttttagagctgtgctctggctatttaaacttaattaaaacagaataaaatttaaaaatcagttcctcagtcacgctggccacatttcaagcactctgtagccactgtgtcggacagcactcaaacagaacgtgcccatcatcacaggaagctccagtggaccacactgtttgaggttggtctgaacctcttgaaatgcctcggctgcttaaggaagcctgggagtttctattgcaggcttgttggaaggaaaaaatgaaatttgcctcaatgtttctggaacaactccttccagccatgttacctagactgtgttctttttcacctttttgtatttttttctccaaggatttcatgtccttttcctactcctaccccttgtttaaaaaaaaaaaaaacctgaattataacaatgaaaaggaaatttaattttaggaatgtccactttcagctgaccttctccttggccttctcctaattaaactttcacagccctgctgttggaccagacagtccttttctcattaaatggagcaccttagtaaaacaagagggcatgtgaacactcgggccaagagtgtgtaaacaagttgtgcattgtgtggacaatgctgctgggtgtggaacgctgggctgccaacactttccattttcagcaactcttgggaccaaggacagggcctttaatcttgcttcttccatttgtctgtgtctagtagctactacacagttgctttgactcctggagaaagcccacgtaaaataacaatactacttcaaatttagacagtgtctttttttctcaagaacttaaatcatgtaagcatgatgttatttatcctcatagtggtcctaagatacagaagtggcctgttggttttacaaatgtgaatatagtcaactcttacttgttacctacagattatctgtcacgcagattactcgtgacacattttaaatccttgggcaatttctctgagcgagccagtgtaagcctggaccatctcctctgccccccgacccagctgctgggtacttagggaatacaaattagttttcatattagcttaaagaagacataattaggaaggtaagtctgctacaagaaaatcacatcacaaattccaacggcgagggggaaatatgagggaaatgacctcctctcccttcaactgaactaagatctggtggtctaagtgcacattagcacttggtgctggcatgcttgccgaaggctttcctcacgggtggaaggagcgaggctgtgcaccctgcaccagatgtgcatgggaggctgcaagcgccgcagcggggctggtggcccatcttgcccggtgcttttttttttttttttttttaacagttctgtgttattgtcaggcctctttatggcagatcgtgcaggtcgcaagtggatcctgactgacaaagccacaggtgggttcatctttggggaaagaaggaagcagctggaggatagagtcactgtgaggctgtcattccaggcgctgcttcctgcttggatggtgggattcctctactgtgcagtccccctcactcggtcacctgatagttttagtaaccattgattccattgattatctgatttttctagtgttaaatgtttccttttcatttattagctggaattcttttttaagagacagggtcttactacattacccaggctggagtgcagtggctattcccagactacaggttcgaactgctggcctcaagtgatcctcccacctctagttgggattcttttataaagaacttgtccccattaacaatttggctatgctaagtacagttcagataggaaaagcaggagaaaaacttgatgaagatgaactttattgggatagagttctttccatcttactctaaagccccattactgtctatttccacttactgatctgcttttttcaggtgtctcactgcctagagcaaatttaattctgccctttatgtgctcttaaaaagttttagtttttttgtggtttttttcctaaatggtgctctacagattatgctgagtgaggggatgaaaagtcacgagtacatctttggaagcttccttgcctcagcgtatccctgctcagatagaagaggcagggactggatgacaggcacatgggggttcattgtactcctccctctcctggtgcctatttgacattttccatcataaaaagtttgaagaaaaaaaaaagtttgaaagtaataataacagaaaaataaataaatctcccttcctaactctgagtaactcctgagtgggcctgctgttcatttctgcacctgactgttgcaggctcctggtgactttcttcttctgaggtttgtcatctgggctccactttccattttaaaatattggtgcactctgcatattgccatgatctatcctctgggacacagacttcaacctgagtgttgttcccacccttcttcctagtgatttcttctgggaatttactgggtaccccttgccctgctctgtacagtcagatcagatgtcctccagagcaggggtccccagtccctggcacggcaggaggtgggtggcaggtgagcaagcatcaccgcccgagctccacctactgtcagatcatcagcggcatcagattctcataggagcacgaacctattgtgaactgatgatctaaggtggaatagtttcatccccaaaccatccccctcaaccccccccccatccatggaaatactgtcttccatgaaactagtccctgctgccaaaaatgctcgggaccgctgctccagagcacgtgcatattccacaagcttcagcagaacgctttctctcctgccattttcagtttaaagccttcttggcagggtcaacaggccttgcagttagcttgttcatccccacgttgggagctcaattttcaggataataaaccatggtggttctgaatactgaaacacagagcgtttcataacgctcctgggcatcgccagtaatttcaagaggaaatcatgacattgtatctccaaaataggtcttgagatatatttactaataaagtaaaaatgaattcagttttaatatttggcttatgggatgaggggcatgaaaagcttcctggtggtctgcaaaagcaggcaaaagatagagtgagcctgtctcaaccagagtcactcctttgaatgttattccagaaagcagtttttcttagtcttgagatggtccagcaagagagaagaaaactctttgagtgctgaaaagcaccctgtgcaccaaggcacctgtgaggctgctcttggcttcatgagaatattcagtacttgccagatgtaagacatattttaatccataaatcccccaaatgtacccaaaagcttggacttaggaaacacggaaaagggagattaaatgtcccaaaagcagctaatagaacagaaacagaaccactgggaaagaaatgctttttctcttccccgtttgccctactatcatgaggttacttggacctcctttttgtttgatattgacattctcttcatgaccttcctcttcttgccctacatatgtcctctttccatctagtccttggtattctcagcctgtctaactgctgtctgcctgctagactagcttctttactgatttcctgttatcttcttccacttctatactggcacataccatgcctgtttttcttcatatagtggctttccttagacgtcagccactgatgtaaatatttttccaggcctgtaaatggaagatttttaaaggacttccttcctgcctgtcacccctagaaacacctatagataccgttgctggctccttaaaaactcaagcaatataatccggaatttaatttcttactcacgtattcctctcctttctaatcatggtcccggttcccatttgggccagtatttctttgatgtacatggttagcgttcatgttcataaactaaagaaggcattacgtaatgtaaatttccctttgggttttaagaattatttcttttccacctactgtcatgtttattatttgtttagctctctctttttctctcaacagccatcaatatttttctcccaactaaagatatttccatgaccaccttggaaggccttcaggctgaaagattcagttacagcaaacaacaattcccaaaggtttcccagactgtgagggcaaatgaaaggcccattcttcctcaggttgtctgtcctgctctatcttgtcgtggggtgaggggaggagggccagctatggtgctggataacttcaacagccctgcagccctgtgctctgcctggctcaagtctgttagtttctggaggacttcagaaatgtatcagggtgatgacatcacatcatactgccctgattgtatttttcacattcttaatattgaggagtggttctgcctggttgcttattgaccagtgcactcgattagcaaccacttcatctacgtcatgtgcagtgccagttctgaccatcactgtgtttcagaagggaagctgcctgccagtccatctgccctgatttcatggctgttatctttaatctttacatctttgaaggcctttggtgaatgatgtgcttcctggcaggagaaaatcactgctgaaaggagatctgtgttgtctctgcttttctttctgtttcccgagagctttagtctaacatctgtgaccccagccagactccatcaaacttcatactcaaagtcatctttgaaaagcagtggcatttattatatacctactatgtgccaagcactgtaatagattttaatgtgtcatcccatctatctagtttagcagccctgtgagatgagtgatcaccattttacatatgaggaaacaggctcacaagccattaaacagcagaaccaagattcacatgtaggtctttctgactgggaagcctttaatggaaataaacagcctactttttctcacataaaatgcacctgatctgcagcaccatgagaatggttgtggagaaaattcgacttcattctgaatcagagtaaaaggtgttaaggctgtttggtctgtggagggcaagactaaagggactaccatcaagtttctgaaattcatgaagagtatgatcaatgatacattttcatatcatattcaattattgagcacctactgtgttcaagttgctcaacattaaaagacagtcctcggccgggcgcggtggctcatgcctataatcccagcactttgggaggccgaggcaggtgaatcacgaggtcaggagttcaagaccagcctgactaacatggtgaaacccccacctctactaaaaatacaaaaattagccgggcgtggtggtgcgcgcctgtaatcccagctactcaggaggctgaggcaggagaatcacttgaacctgggaggcagaggctgcagtgagccgagatcaggccactgcactccagcctgagcaacaaagcaagactccgtctcaaaaaaaaaaaaaaaaaaaaaaaagacagtcttgccaacaatgcaagcatgcagatttatagacagaaaagcagcaactccttgggaacaggtcagcacatacctggggccaaatgaatggtggcggcaataaagtcacaggagggagaaaccaggtgggctgtcccctcagaggcaaccccatgaaccatgtggaaactgctagaagaactggcctgagactggcagggcctaattccagacagagagacctgcctgaggaagttcacatggcatccaagggacacatgtgattgtaatgaggggatagtgtagggtgttagcaggaaaggctacataaactccttcaactattagctatttagactttattttcctgataggagaaagcaaagtaatgtttttgatgggatgggatggcttttgccaaacaatattttaagatgttaaccatgataaacatacttattcatccaataatactgaatactgaaagaagttagccttgggaaaaataaagtccctcaaaataactaaataaattccatttccacggatacatgcacatatgtttatgtgtgtaaatttcattacacaataggcaagtgatgaaactcattgccccaggagagatctggaatagagtagattggctcatgaatgataaatccagagtgtgcaagactgtgaccctaacctttaaagcaaatctcactggtgcccgtggtctaccacagtgctcccctggtgccaccatcagagacagaccactgtaaaacctcatggccccttgttttgcagcgtgcaaggccaggcttatgaatagatatcatcatctgccacccatgtaatgtgatctgagaggcatcactttgtacggaagttttaaaagatccctctggcaggcgctaaagtagggttattacaaaggaaggcaagagatggtagtgtctgtccagggaggcagggggaaaagtgttgaatttgggttctgtatttgaagggagagaatcagctggtgcattggatgtgtgaagtaaaggatgacttcagagcttttggcctgagcaactagaagaatgttattgccatttatttgggaagagaggagacttgggaaaagcatgtttcaccattttggctcaagaatgatacacattaaaaaaaaaaaaaaatagagccatgtcaggcctcattgtccttgacagggaaacatggtcctgcagccagttcttccagagatttgggtccaactgctgcttgacgaggaaatctttatgttggcacctgaagtttctgagtcacctttgactttttttccattttgaccaattctataaaccttaccatgaagcttgagaagaaaagcagcagggggcccaaagaggacagtcctctcccttctggatccttcctggccctggtgttaagtgtttaaggacattctaatatatggaaaaagactcccaaatcaaaggcctgggtccctgactttaccatcaactcagtcatttggggaacaaaatcagtcctcctttgatctgtgttgaggtttttttttttaataaaatttttatgtttacttttgagttcaaataaaaagacgggttgtatttactaaactgagttaactccaaggttgtgtgtagctctgaaatactaaagtcttcaggacattagaagtatgtgcctttatgatgagcccgtggttctggctctgactcgtgaaagggaaggagccctgccctgtggacttctctagggtctcagcagaagtcaagtgacatgcagcgggggtgagagggctcagaaaggggctgtactgaggccaagggtctcattaccaggactctacaagggccctgtaagaaaaaggagcacttccaccccttaaagtagaacacgaagggcttcctgttgcttaatcaatcgaaatgacccagaatacaagcttggattaacatgcgcctctagattagggctaatcaggggcaggctgagcagatgcagggacagtcccagcctgattactgtacctcagcatttaatcatctctcttccaagggcagccgcccgacttagggcacgctgggtttccaggcctccagcccctccccctttcccttgccagggacatgaaggctgttaggtcagagacactgaggcgatttaatctaatcccatgtcaaaatggctgtgtgtgagagagacagaggtcttaaaatccctacagtgggatggtcatgcatttatttaaggtggcagtagacagaaactctatgtagaaaacagcggaattggggttccaaggcatgcgaggttatgaaatgactcccatcatggcctccctctcctgtgcttctaaggtgtgtggctgtcctcaccagttactcatccctgggagctttgggtggggaccatttcctcacccaggtgtggccaaatatgcttcttccctgtctggggtggagtacagaagatggaatctttcaaaaacagctttatttgggtgagtcttgaatatagtatttttgaagctgctttttttctgggctggaagctcttgttccagaacagcctcatcaccctaaggctcacccaccttaatcacgcagtccctagaagggacacaagttaaatcttagtaagcaggtttcattcatggtagtagaaaacattccagcacctgctgactgctggccactcaaagatggagacttaattcctcccttaaggaatctacggtctccttggggacaagacatacgagcagtgaggatgaatgaggccgctgtctccaaggagcctgtacagggagcagaggaggagcatcggagaagaggacccaagatggggaggagagaggctggggaggagccccctccaggcagaaggcatggaggtgtgtgcttggagaacctcagtcaagtagttcatctggctggcgtgtgaagtgagtggggattagtggatcaccaggcttaactgaacaacagtggccgacgtgaagagtttaaatacctgcaaaggggtttggactttatatcccgtgggccactagaaaccactgaagaactgtgaaggagaacagcaagatcaggtcagatgttcagaagatcattctgatgatggcagtatcagccaatagatagatttttgcattagaaccttgcttcatttattctggggaaaatcttccgtgatactatgaaaactattttaacaattgggcatgggcccacatcataggaaacccaaacacatcacagccagggtgaaagaaatttaactttgacaattcttttagtttctattcacaccagccctaacccagatggttgctcacagttagttagaaaagatctccctgcacactgtagtcactgtatttgtacagcaagggacttgttccccaagcctggagcttttggaactgaatggagcccagaggcaagagcagtgaaatgaggctgacctttgcttctggttttgcttgctacttgccagtatgtgggttccctggaggaacacacaggtgtcttggctttgccactgggcattttgggtgatttcgttaactttgcctgttttgaccagaagagagcctgatcgtgataggaggaggcgggggactgacggggttatacaatcttcacatatatatacactcagtcccatgccttgagtctagaggctggggagagggcccagctgcacgttggttgaggccagcagtacatggcccttgaggctatgctgatagcaacttgtggcacactttgtacttcatactgtgaggaacatgaaataagccagagccaggcctgatcttgaaagaaccctctgtcaagtgggaaggcctgttgcagacatgcatcaactggcccagctggcttatccatggctgtccctgggcctcctgtgaatccagaggaggctgctccagcattgataaggctgggatggggcaggttccacaaggagggaaagctcaccccagtgtaaaaggaaggagtgggggataagtctatctcatgaataacctgagcaaaggcccaaaagagtgtggctgatagattgggggaactgagagtagtctgggggtggggggcacctagaggacagggcacctgtgagagagtgagggagatgagactggaaagatggaccagggcaaaccacgaaaggccttgaagaccatgctaaatcatttgaactttgttacaagctttggaaaccttttaaaaaccatggaatttaaatgtttgagatgaggggagtaacattatggaaagatattttggctgggtgtggtagctcatgcctgtaatcctagcactttggaaagccgaggcaggaggatcacttgagctcaggagttcaagaccaacctgggcaacatagtgagacctcgtcactatttaaaaaaataaaaaataaataataataaagaaagataatttgagtgactgggaaggggtgaactgaaagagagattaattaaagacagttaagagcaatttgcaaaggtttagttgaaagaaattgaagcccacagttttgtaggccaaggcctggcccttctgcgtgcttcccccatgcccacgtgcacttggaggctggcctctctcctcctcctttcaggcctgcattgcaagtgtgggggcgactggccacgtcttccatttcggtgagggcacaccagaggagccagggtttctagtgatgcgtcaccataacagcaagtctcatttcatgaagtctcactgcatcatcaaatgcttaccccttatccctaaactggcaaaacttactcttagaaaaaagttacatacaatttaacattggaaaagaaaatcttatatttgattttttttgcattagaaaatattttgacaaccctttttaaaataatttttatcttcatcaaagtagcctatggtttaaatgtcaaaaagaactaaaaggggcctctctgggtcagtttctcaatacagtgggtgaacctcagaggcccagtcagcaaaggtctttgggtctggatgttggggttggtctaatcaattaaattcaaactttccactcattctcatttttagcctcatccctctttctgccgtagctaggcctctatgtgctgagccctgtgtgagcataggagttgccccttccacttctctgttcaatcagaaccatttcacatttgctttgcatcttcccaaaaaatgttgacatccctcggttatatccttttttcctcattcactgtaattctagtttcagaaggaagagagattgatgtatatgttagttactgccttactgggaatccttttttttaatgtattatcagctttccctttttaggcaggactacctttatggaggttatgtgcttcttcctttaagccatcctttctactctgaaataatagtgatattagggagtagctggggtcttttttttttaagttgaccccaaaatgtgtttttacattttactggtgtgtgaaatctagaaatcaggaaacaagtgacctaggctttaaaaataaataaataaataaaataagcttgactatgaaggaaggcacatagacggagcagtggccagaagacaggataggagagggacaagatttttcttttcaagctgagagagacttaagcataggcagaaagagggttgaagaaggcagtgtagccaaatatcaaagaaaaataatggtggcctgttctgagagggagaagacaggccggggacattcacacctgacgggcctgtgcttcctagatgcggaggcaggcagggccctctcacggcaagctgggaaggccctaccctaaggcatgtttccacaatttctctaaacttttcttttctgatagtctgttttaaaaaaatcaaaatggtcagggttggtggttcacgcctgtaatcccagctattcaggaggccaaggtgggaggatcacttgaggccacgagttcaagaccagcctgggcaacacagcaagactccatctcaaaaaaaaaaaaaattatattagccaggcatggtggcacacgcctgtggttccagctactcaggagaccgaggtgagaggatcacttgaatccaggagttcgaggttgcagtgagctgtggtcacgccactgcactccagcctaggctacagagccagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtagagagtagaataatagttaccagagtctggggaagggttggggaggggggcaggagaggttggccagcaggtgcaaaggaagaataagttctggtgttcagttacacagtagggtgactgtagcgaataacaatgtagtctgtgtttcaagatagctagattttgaatgttgtcaccacaatgaatgataaatctttaaagagattaatatggtaattttcttgatttgatcattctacagtgtatacatgcattgaaacatcacattgtaccccataaacatgaacagttactatatatcaattataaatcttaaaaattaatgaaaaaaattttaatggggtgggaaagagatgtctttgtgcctgggccatgggtatgtgatcacctgaggctggtgaccacgatacctcaaaggcaagacttgggtgcccccgtccagccagcatctgggaacttgagcctgagccccaccaacggtcttctctttgtctctccaggcctggtccagatccctgtgagcatgtaccagactgtggtgaccagcctcgcccagggcaacggaccagtgcaggtggccatggcccctgtgaccaccaggatatcagacagcgcagtcaccatggacggccaagctgtggaggtggtgacattggaacagtgacatacagccatattatggcatcgttttctagtctacttcaaaattttttacacgtttgcagaggtgcaatcaaatggaattaagtctctcgactttggaaggaaagttttgttaacctttttttttttaaaaggaagaaagcggattttggaattgcattttttaaagcaccactcttgattttctgggattggtgaagaaactgcattgtcaatttcactgtcccaaaaaagccaaattgtggcaggacttctttctgcggaaatgtgtgtgtatacttatgtgtgtgtatgtgtgagtgtgaatatatgtatatgtgtacatatggacatacacatttacatatatataaagtatatatatacatatatatatatatatgtatgaaacccgcatggaattatctgtatgaaatcaaggtgcgctgtggaaacaataattcacccagtttagtgggtggtagggtacgtggccagacacagtcacccagtttttgttcataccagggtcatgcgttgagctactgacaaactcaggcggaggtgaccatgcccttcaccaaagctgcctcccagtggccacacagaactctccctgctggactcacctgaggaaagaggctccagcatggggtgggtcagagatgtgcttgcaaggtccagggactgcgtggtctgccagctgagatgctcctcgggctggcccaggtgctgaccttgccacaggcagatgaatgtcttgaaagctcccgggcctcagcctcccatctcctctccttcccaggaatccttgatctcatgactattaaaatgttgctctggttttaaggtcagtcctgaattgctcgtatatatgaactgaaggtaaccgaagtattaggggtttgaggagtgcgtgcgtgtaagtgtgcttgtgtgtgtgcgtgcatggtgggggagaggatgggaagggggcgggggcagtggaagggaaaggaaggaaagaaaaatcgtcctagaccaggatacacccgtgggagcaattttctctactgtctgtagcttcacagaggaggcgctggaatgaacaagaagagacatctggtctgtggccacagcaccctgaacgcccctgatcttgtgtgatcttggaagctaagcttggttgggcccggtcagtacgcggaagggaagaagggacacctggccatagaaaacagctgagggtgtttgctgtgttcctggatcaggccctgcttcagaagggactcctggaggcccatgttccttgatgcaacctcgtggcccaggccgggagcagcttgcctcctcagaggtgttgactatctgggtgttcttggtaaccgttaactctgtctttctcagctgcaagccctgagtctccagtagctgaattcacctgacttttcaacaggccaaatctctgaaccttgagtacagggacagctcctcctccctcctcccagctctccccatgtgtgtgatggtgtatttaatgtgtttttttaatgcgacattaaaagattctccacgtcttgctcaacctttgagagaagtttcagattcttgtatttgcttgttttatataaaactatctaatgttctttatatgttcttttctgtacgtaatggggggaggggagggaaatttacatataaatagtcctagttctacaatttgttatttttttaattattattttttatcgtcattgtgaagttgtccagggactttaaagtccatgttcctttgtggtgaaataacctccaaatagtttgagaagttgccaagacgaagaaaaaagcaaaaccccagtagcagagcatggattctgtgttgtttcccattctgtctttgactgcctcattcaataaatagttaaaaatgtggcaacaggaagtggaattgttcatctctataggagctcttggcttcttaggcaaaaggaactctatcttggggcagctcgttctgcgtttaaaatgcagtcctactcgagatcagcggtctccgacctgtgccactccgacgctggggacctccgtaaagaagacactgaagattgcccagagccccctgcgagccccatcaccagacctgctccatttcatacatttcatatataacgtgttttcttatactgacgttctggggaaaaaatcgtatttaaaaaatcctaggccgggcacagtggctcccgcctgtaatcccagcactttgggaggccaaggtgagtggatcacttgaggtcaggagttccagaccagcctggccaacatggtgaaaccttgtctctactaaaaatagaaaaattagctgggcatggtggcgggcgcctgtaatcccagctattcaggaggctgaggcaggagaatcgcttgaacccaggaggcggaagttgcagtgagctgagatcacaccactgcactccaacctgggcaacagagcgagactccatctcaaaaaaaaataaaaataaaaaatgagggtgagtgatggtgcctctccatcttgggaattactattaaagtgaattgtctttctttctccaagcagaagcctcaagccatgacttgttcccctgcatcctcactccctggtttctcacacagcttactcccttaacatggcatatgccatcgctccagctgttcctcctgccccatccttaggcccttcatagaccccagtagcctgcacctccatgcttctgcatgccctggcctcagcctggaatgacctgctgtcacccccaccaccctttctttatattgttgggtgtcttggccactttcctggtgaccatgattagaatgcttggatgggaaggccaagaagccttttccttgatgcctgatggtggttcagtgaagccaagtgcctacctttcccccttcttgcacaaatggcataccctcgcctatttttcaccagagactggactagaaaaaggattgagtgcagccaaatcaaccacacatccgtgctattgactaccatgaaatagctgggttgtttagaatacctgctgaccaagggtctctccagaggcgtcttctagctgctgtttgcctggcaagcctcagatgctgcctttgccacaggcatgtattgacaactggttttggtggggccgatggagacctcttccattcctgcctaagtcaccaacaggagctgctaactccgctgtctatagagaccagggaggtcaaatcaatgaaggaagctgaggcaattcccatgtgagaggagggagtgatggggacaggcacagtggacagcatccatctaaacggggcagcctgtcctaggtgctgattgtcaccatgcaggaagatggaccctaatgccccaacttcaaaattgtccagagaatctggggaatccagatttttgtacgagatgtgatcgcaacaaataaaaaatttacatactctgcaagcaaaataaaacccatctgtagaccagacctgacctgacggtcagttgcacttaactacgtgaatgcttgtcatgtgccaggtgaatgaagcatggtagttgcctgtgagaaacaaggagtgaggaggagacctttacataaaccaaccgctgcagtccaaggtgatgaggcaccatctggacagagcactagtgcagaatgagctgtttaccgcatttgagccctcaaaggtcctctgttacgtagtttatcatctaggctccacacaaggatctggtgctcacagaaaccaggagactggtctaaaagttactggctttaagtcttgcatctgagaaggcccactggtgatacaggtgactactggcattctccaaacttgaacaaattagctgaggagaaccagaagggcagagcagaggaggggttccttgccctgggcctcactcacgcccaaggaacgctctctccccctctcagtaatgcctccgaagcttgagctctgggcatggcagagtcgtaccgggctcctggtgtttccttttggtgtcagcaccaaaactcatcagggaggaaactggagcttaattatttggagcagaagctacgtggggtgagggagtagagtccgtgttttccctctcactccacctcagcaggctggtggcaccttggtcatcacaactggggcttcagatgccccatccctgcactcccacccggcctctgctgtttactccaggaggcagctcttggaggtcacccaggatgctggcggcagcatggaggaaggggtacaatagagaggggaggcagggctccgggactgggctccgactgaaatcactgaagagcgtgggtttcctcttagtccccaagcccctctgaatatgagtttctccatcctgaaaaccactgggctgctaccaaacatttgttgagtattggaggcctggaatatatagtgaggaaaggaggaagaagggataacagtcatctgcagaggggaaccaaggtgccctgagaacctagagcctccttaggaggcaggaataggcctgggtcctgagccctctccagggctcaagctttgctagcttgcttacgagaactatggtttgtctacacagagtgtatggtagcaatgataacagtgaacacttagcccttacaatatgccttgtactgtattaaaagatttacctatatattaatttatttaacctttacaaaatactatcatccccgttttatagatgagcaaactgaaatacagagaggttaagttaaacaactgagccaagttcacactgctggtaagaggcagagctaaggtacaaacctgggcgggcaggctggctggtcccagaatctgtgcctagaaaaacatgacttgagcctcatcactctgtcacccaggctggagtgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaataagctttgggctgggcgtggtggctcacgcctgtaatcccagcactttgggaggccaaggcgggcggatcacgaggtcaggagatcgagaccatcccggctaacacggtgaaaccccatctctgctaaaaacacaaaaaattagccgggcgtggtggcgggagcctgtagtcccagctactcaggaggctgaggcaggagaatggcgtgaacctgggaggtggagcttgcagtgagctgagatcgtgccactgcactcctgcctgggtgacagagtgagactcccatctcaaaaaaaaaaaaaaaagcattcagttattttttaagtagcttaattaatttttgggaggttctccccaaattttatgtacttggcaaataaaatttttagtgaaatttaagtttactgggtctcaactgaaacttctgaatttatctaccctttaagaagcttaatacactttaggaggccaaggcaggtgtattgcttgaacccagaagtttgagatcagcctgggcaacatggtgaaaccccatctctacaaaaaatataaaaatcagcctggtgtggtggtccatgcctatagtcccagctactcaggaggctgaggtgggaggttcgctggggcccaagaggttgagactgccatgatcatgccactgcactccagcctgggtgacagggcaagactctatccaaaaaataataagttacagctatcaattactaaatggctactagcattttactgtgtaaaacaccttacacccttatttctaatcctcttcacaatccggtaagaagagactccattttatgggggtggaaactgagacttggcatcttccccaagaactaaaaactggagggctgaaataaggcctgatgtgtctgtctgttacagctctgctctctatgccaaccattcagaggacaaaactgcacatcaggattataaagtaacctccactgtgtcctgagcttgatagacctggaatagcctcccgtggctggacctttttaccgctccccaccccccccccacacacgcgtgcccttacatgcagcagggcctcaatacatctcataggatgagtgaacctagttttccagtggtagtttaatcagaaaattcagagaacccaaaacacctattcccacacattttcattactcaaaaaagtctggccagcatggtggctcacacctgttatcccacgactttgggagaccaggacaggaggatagctttagggccaggagttcgagaccagcctgggtgacagagcaacaccagtctctacaaaaaaaaaaaaaaatatatatatatatatatatatatatatatttctgcaaaaatccaatgttaaataattttatgtaaaaataacattgattgtattcttaagaaaaatctggctatgtgatatcctggcaggggtgacggatagtgaaatgttgatgctgaacacattcttggtcactaacagttgcactgtgttggtctttaaaaacctcagggcccaatgagactaggagaactcaaaaacccctgggtgatcaggaaacgaagccaaagcttggccctctcatagtggactttaatctgcgagggaagttagccaccactcctcatttgggctatgaaagttgaagccccgggtcacatggctggctcatcccccaaatcactctgctccctttcctactcagctcctcctgcccgggttaccatccagattctcaaaatctgaaatttttaatttagaagttaggtatttcctttaccagagctatttttatagaaagcaagagcaacgtttacaccaaataaattaatgtgtaattctggaatttaccaaaatggttgcagaaaacaaccatgaagatagaccttttttttttttttttttttttaaatacagtaatgttttttaagttagccgaagttcggggtaactcatcacataataggattctctaacctgggcctctgggtactcatctgtccaaaacagcggtcaaacgacaaggacgatgaagacttcgtgggccctgctgaggtccttgggagcagggcattcgcgcggggctgtggggcacggccgagctgagggtccctggcccaggggcctcccgtccatgccgacgcccactcctcccgtaggacccagccagtgcgggccctgtcttctagcccagcctgaacgccacgatgcagggaagcgcctgaggcctgccggggctcaacacctgcccgactgtgagcgcggaagcccgcagatggcctgggcgaaggcggcccgggtgcgggagacgcgacgcggggtcactcagagcccgagcgcatcccgaacccagagccgccgtcgggggcgcacccgattggccggctgagaccacgtgtccacctgcggcccaatcagcgatggcaggacatccggaaggcctggtccagaccgcagggtatgggccgctctcggggaagcgagctgggaaaagcaacccccgagtgccagtggccgcctttatgtgccagggtgctgcagccggggaatgatggcgcgggcatccccggcttccccacgggccatactgcctatctgggtctgtggaggcctgccttagtaaattaggggtcatttgggtagctgtgtgccgtctccgcctcccaccatccccagtagcctcaagaattttttcaaatcgttttattgagataatttatataccattaagttcatccgtttaaagcgtaccattgaacgatctttagtatatttacaaagttgggcaaccatcaccataatctaactttgaaatattttcatgatcccaaaaagcaggggttttttacacatttccctacaaaataacttgaagtaagttacataaaagatatatacaataaagttgaaaagcaaatagaaatgaggattcaaagaccaacggaagcaggtcacatttgtcagcctggggtcaacgtcggcggtgtgatgaaggtgcccttttagctctggtcttggctaagaggttggaattactagaaagggaacaagacacagttactcgaagaaacaaagcactaagtacttttttttttaagtttaagagaacgccaagttattttatattcagcatctttcacaacatttttatagccaaagaaatagctttatttccttagaccttaaaacctcaattttgaaagtttcctgggaggggccaaactaatgtggcatttcagtgtttatttacagagcattaaggaaaggatggaggggagacgggtatggtgaactggccatctgaaatggctgcttgagcaaggaatggcgtgtgactttttccatttcctgggatgggtgatcagagccacaactgtggacacagagttctccccatattggaaccccacattctcaagagaaccgccaaccacgggagcacaaggatacaacgggctcagctgcccctggccaccaccccagtggtcccgccatgggccatctaagatctgcaaagatgggtggagctattagagtcgcaggtctgggggaaagtgcttaaggatttctgccttccctttcccatcctccctccttgcccacccctctatcccccacccaaacccccaccccctgcttctggaggatctggaccatgagcagagaagggaagtgtctaccaggaagaccacgttcccaacaccgaggtcctgcctcccctcaggaaaagggcagcacatgtacttgaactcaagtttgagactgaagcttgaaagtgataggttgaatgatggtacatgcttacacagatacagaattcacccaaaatgtcattaaggagctagaatgggccgggcacagtggctcacgcctgtaatcccagcactttgggaggccaaggcaggtggatcactactcaggaggctgaggcaggagaatcatttgaacctgggaggcagaggttgcagtgagctgagatcccgccactgcactccagcctgagtgacagagcgagactccatctcaaaaaaaaaaaaaggagctagaagggaaagtcaacagaacaaggtcaaacaaggtcaaggcagtgaccatagaaaataaaaccatgttgtgtccagatccaccaaatcaagaagcctgatgcctttggttccatgaacagaagacacctcagacttgtgggttagtcagtggcaaggaaaggttccatttccacccaaccctaagagacacaaatccgttttcataaaagtgtgagccccaccctgccccaaggatatgggggatgggcacctctgcctgtggctcacctcccctgacaagctccagtgggtgctgtgcttcctcttcactgggaggcttgttcaggaaatccagttcactccattattgaaaacaactccatctccaggaaaagttgaaactggcagttttagcatctgatgatggagccttctctgccacttcaaggcctgctgcctccttttccagccggcctctcaccccaggaaacaccagcgaagccagtgcaaggagaggcctcaatccctggaagattgaggtcatgcctgggccaacacgtgtagcagagcttggagaaccctccctacaggacttgcccacctcccactacaggggctgactgttcagcttctgctctttgagaaaagacacatccactgtgaatgcaaaactcttcgtgttcagttttctcatcacagcatttatacttttttttttgaaatggagtctcgctttgtcacccaggctggagtgcagtggtgcgatcttggctcaccgcaacctccacctcctgggttcaagtgattctcctgcctcagcctccggagtagctggggtcacaggtgcccaccaccacgcctagctaatttttgtatttttagtagagacggggtttcaccatattggccaggctggtcttgaactcctgaccttgcgatctgcctgcctcagcctcccaattatatacatttttaaatgcctagattatggctggggaatttagggagttgtgagaggccccaacttgggtgaggaaccagcctcgacataaacttaggattgtcatgctgacagggcatctgatctggtccccacctgaggttggcatcccactccagcacctttgcttggccatctccagagatggagggtccagacccgaggccctcattggtgcagtcaggaagctctgtgtgatgtatagaacatgcctgtctggggtcggctactgcccctgcttctgctctcttaagtcatagagaactagaattctttcaactacttgaaaataacctcacattaccacccaaatctttcatagctaaaatctccagtttccatttttcctggagatgggtgagttgtttccagaaatggagtgaactggaatttcctgagtggcccccaacgaaaaccaaaaatcctggattttatgttttgaaacgtcttccaatgcacagcaatatagcgagtaagccacagaagggacctggatagccagaccatctctggtctggtccagcgcacaccacagcacgggtgccctccaaactgagcccagactgagggataacgtcaagggcttcacaaccttcatctcccatgattctcctccaggaatctgctgctgtaagttggctgcagcctgtccttccaagcaccacactttgcccctgtattcctccccctgggacctgctctttcccccttctctctctactcaggctcaatgtaggtggctccctccactcagagcccatgcaccaccccagccctggaggccatgcctttcttcagccccagcacctcttcctgtctgtactacatgcacctgccccatccacactgcccagtggggcttgtaaccgtgcccagcccagctcccgcgttgagctgtgtgtaccaggagggcagacccattggcattgggtgccatgcctcctgcagcaagcccagccctttgctgttagtgtttaacaagaatcttgatgggggccgagcgcggtggctcacacctgtaacgccagcactttgggaggccgaggtgggcagatcacttgaggccaggagttcgagaccagcctggccaacatggtgaaaccccatctctactaaaaatacaaaaattagccaggcttggtgacaggcacctgtaatcccagctacttgggaggctgaggcaggagaattgcttgaacccaggaggtagaggttgcagtgaaccaagatcgtgccagcacactccagcctgggaaacagagcaacactctgtctcaaaaagaaaaaaaaagaacagctgagttcatccctaacagcctcttcccctgcaggaatgttggatgcctcttaaaaaaaaaaaatgaatattggtggacttaatgcagccatcttctttctgctggaaagctggtctttgtggaaacctctcacatgtggttttgatggtactttgtgcacacttactctgtgctccaaaaggtgcccaggctccagctgcctgacctggaggagctgccttgtggagccatctgtacgccctaggccctgacaccagggcagcccctcccttttggaggtcagagccaggcaggccttcctatgacctcagggggcccatgggctacccatgcacgagggtcccttccactgcgggaactgagactcttgggggggtgacaagactttcggagatgcttgaggtcagaggttacgcagagtgtggaagtcagaatgcatcacccaggtctggaattccacagcctccctgccacatgccaggccccataccaggccaaggccagccctgggcatgaaagtgtgagtgagatacagcctggacccaaaaagcctccacagttgatgggtgaagctgacctactaacctcaaccctcacccctagccctgtggttttagcactggcaggctgggaaggtgtgtgcagggcatttgagacatgctgccttaccagcttcgaagggaggaagagctggcggggagggcaggccacatgaggaaggcgaaacaatttcttcctggcgagcaggaagacaggtggggggagcaggagggtagtttgcatggcaaggctgggtcataccaggccccataaaccaggtaaggcgcttgggcttatcccaagggagagggtggggatactgtggtcagattagctcagaggacggtcagtggagcagggcaggacagagatggggaggtggcagtggtgacggcagctgggacattccattccgtagggaccatcccactgatcagtcctgccttcccaccaccctggttctagctctgccacccccagcaaccatgtatcctagggaaaggcagaagtctctgcaggggctaaaggggcaccagggagaaggtcagggtccactggccacagtgcagccccctcccctggctgtgtggcacggggcctgcagcctctgggagcagttgccagggcccgggttccctgctccaccactcaccttggctataaacacttcattgtcctgatcctgtttgctcatctgtgcgctgcccgtggttgtgaggattcactgaaatcatgaaaatgtagcacagtctgtgctcaaagatcaatagctttactgtgactcaatctgcccaaagcccccaatttcttcttcagcgcccaccctgctgaggccccataataattctattcctgccagcatggagcaccagcagctgtaccagccaaatgaagctatgtgggtcgggggacaaagatgatgcaaggctcctccacgccagcttggactataaaacgcattctaatcactgaccttacctccatgcttagcacttagcagtacttgggcaccgcgattatgctgctgttgatcactacactaaaccgttcagcccacatctcctggttttgttatttacaagcttaagaacagagagcaggccgggcgcagtggctcatgcctgtaatcccagcactttgggagaccaaggcgggcagatcacgaggtcaggagatcgagaccatcctggctaacacggtgaaacccccgtctctactaaaaatacaaaaaattagccaggcgtggtggcaggcgcctgtagtcccagctactcaggaggctgaagcaggacaatggcgtgaacccgggaggcggggtttgcagtgagccgagatggcgccactgcactccagcctgggcgacagagcaagactcaagtctcaaaaaaaaaaaaaaaaaagaacagagagcagagccgtttcaggccctggtctctggcagacccctactcaccttcctgggcatgtatccaaggtccttctcccatggcacctgcttcctctgccatcgtggacttaatggccaagtccaactcctcctttcattctgcacacagccacaagagccatccaaccagaacacacatctgatcacaccccctctggctgcgtggctcccatggtccttaggttcgggaacaaatgcagccttaagatggccagccttccagcccggcatagaccccaggaaatctgtgtgctctccaacaggagtctcctcctctccctgagggtcactcatcttccaggactccccacccctccctgtgtcccagcaggtgccgtgtggccctagctcagagcagccttcttcatgccctgcagagccagcctgtttacgcagcgtctgcttgtgctcacggcatgtaacatgcatagtgcagcctgcgggagaacagttcccttctctttctgtctcaagagctgccggctcagaccttccctactcggcctgtgtctccccaaaagagcgcagtgagctgcacggagccggttgagcctggagccaccagatagatgtctgccccgccctgcccagccacaggggttggtgggtcatggaaccacacatgaccctccgagggcaggtgaggagaaaggagggctgatgggggctgatagaaggggtttgggggatggggagcaccagagaaggaaggctggcaggccgagggctggggagcaggggataggccttcacatttgcatttgcaccgttcactgcgggctaggccacactcacacacacacttacacctgcacccacaccctctcaaccacacgcgcagctcccactctggctcctgagccatctgcaggccaggagactccagggccgggcttccccagcaggtctgcccaccaagcccaactctctgggaagtgccactcactctgaccctgtggcccggctccggctcaggggagctcccactgcaaacacaagctctgggaaggtgagtggaggctttgtctcaggttctgaggcgtcaggaggaacaaatccatgaagtggaatgctggaggcatagaggtccagcccatgggccacctgcaccccagggggccagtcccgcatttacacaagtgacttgtacactctcctcctgcacatctctggaggcttatcccatctggccctccatggcctcagcaggatcactggatgtccgtgatgcacggcatgccctccctgccctcatcctcccagccagcagcccaggaaggaaccactcttagtgacctgtggaaggttaggagaccctccctcggggccctagagcccaccctgaacagggcctttcaggggagagggtgagaaggttcaccacccagaggagccaggccaaagccctgaaaccaaacatcccccagttccctcactcctcgattcagactccagggccacagcctggagcagagctggaccccagctcctcttggcagcacccctgagggccagagaacggcttcccagctgacttgaggacctgtgacctcagggggatgcagggaaacacagagtgtcacttccagctgcacctgccctctgccactacccagcagtccaggacctgagtcccctccttcctcgcggagaacagcaggtccagcatggccagcccttccctcgctggctgtgcacagggtgccggctgagtcctcgccccatagttggcaagtctagaaccaccggatcctgttacctcaccagtgtgagttctaccattgccaaaaacggggggaggcaagcagctccccccaggagctggggaggcctcggtctgtgctgaggaagagacagagacagttaggatggtccaggcagggccaggacagaggcgcccatccccgcaactgcgacaaggtccttcctgcagggtcgccctggtgtggaggcccaaccccacagtcccccttcctgctggtcccggtccctcctcagccccctcctctcctcccttcccctcatatctgtaacctgcagttcctgtgggcaggcatggagcagacaccatccctagggcagccaccaggatccaacccaggccctgagctgtggtcaccactcccaagggaacccgagggcacctccactcccagcacctgacagcagggactctgggaaccagcacaagccaggccagagagccctgcccctgggcgctggggaagagatggctaatgtgggctgggttttgctatttactaagcccacgtcactgctccatttaatccagagagatgctcccaagccattccctagagcctaaagctcacaggctgcccaccccaaagggagagagggaagttgctacacaaaacattcctcctccctatcaagtccaagggaggaagagcattccacttgccaaggcctcttccctaaaagcagtggacaaacaatggcgctgggaccttctacccaggaacgggaacaggcagcctctggggccatcagtcagtggcaggaatgggccaagctaaaaccaaccaaatatctcccatccagacggcactctcctgaccacagaacccactgcacacacccagcagccctgcacacacccagaccctttgagggctggctgcgatctgattctcggagtggcatttccccagaccgccagtcacttacccaagggcagcacacttccgtgttcccacttcccctgatgaggccaggtcctttcccaaggggtgttgaagtgtcctgaaggcatctcaagcctttagcaagggtgcaggctgcctgcccccaaccctgcatccccatgcctcccctgcagcctggaagggactctttgccctcaagcctcctgggcagtatgggcccaccatgagcaggctcattttccgaacatgccccggctgggggagcagctgacttggcagggcccccaaaatgacaccgctgccgccgccaccgccaccacccctcccatcctgcctgccctttagggtggagtgagatgggatgatggcttaagatgcaaacagatccaggccatccccagggccaagtccaggacctcggtggcacccagaccggaccggcagcctgggcttgggcgctggggaggacacctctgcccgaaaggagaggcttggtggggaaggtttggcctctgagcagaggcacgactctggaagcctctccgagggtgggcgggcctgctttgggacatcagcagcactgggctctcttggtcccatggagcccccaagcctgggacttgctgaggaggccactcccaccctcctccagtgtgtatgtggggggtcctgtcctcctccccacccagctgtggccgcaccagccgggctccatcggcagcctggggctgcaggcgatcaatggtgccggatcgcatttcgacccgcctgaggctgggcagagactgggataatggcctggaatgaataagcaaatggagtggtgggggaggcggggagtctggaaaacccactcatacagccctccagggagctgcccctcctgccgctccacgcacccagacaggccaagcaaggtgcccgacatgggggacgccctaaacccgggcatctgggagccgctgcttttgacaaacagaaaaacaaagcaaaaagtgcttctcagtgaccctcccgctccagcaagaaaggccttcgctgcagtgggacagcgttcctgcctgacactggacaccattggacagatcatgggcagaaccttttgcccatctcacagaccttctggaagccacacaagggaggatccaggacctgttctgcagggtggggaggtgaagaggggccctctcctatcctaagtgcccccagcctgggtggtaggaaattgtgtctttagggaggagggccagctgtggtggcccccactctctgggacagtcactgttgtgggtgaactcaccacccaggtctggcccggaactaggtaaattaggagatctagaaactagctttggcctgaggtcctcccctggagcgctggagcagggccccagagcagccgggcctgaagcctggtggaggcacgcccccacaccagtgcctgcactcggggctcagcaaaggcgcccacctgggcaggtgtgaggaggtggagcccagctgcagaccacccaggggctgagggcagcttctgtcatccagccttccccgctaggcaggaaggagcagaaccctggccagacactccagaggctccagggaaaagctctagaaccggtcactgccaggggccttccacccccccttgctgggtctctgtgcccaccccacctccagggctcattctcactcaggccgggaaatcccttctttcctatcccatgggacctgcagcaggacgccctaaggaagcacccggggcggaggactggagcacagagacagggtgcggcacaggccagccaggttccgaggggcagagggagagctggggccatcagaagagagacctagctacagggacacctcaccagggcagaagtccccttctatcctgaaataaacaagcccctccttttttctgcaggggcttggagagcttctgtagagaaacacgggcaccacaccccagagggaatttattgggggctcctcgcggtttggtgatagctaactgacaagaaaaaaaaggcccaacccacccaaggcagtccccagggcacccaggcaggcagcactggtcaccatgttcctgctgtgcagtcaactggacccgtcatcctccagctgccagcttcaaccacacacatcccccacccgggcactccctggctcagacacctaaaatgactcccactgatctgggctaagtccaccaacccttgcctgaggctccctggggagaagcagccccatcaggggctggcccagtgacctggggcatgatagctcccagctggtcccaagtcggccactggtctcctgcttgattgctgaccaccagatttcacatgggtccagcctggctggccaggctctccccagctttgacagactaggtccaggcctcccagcctcagtctctgccatctggggcatccttgggagcccaggcctgtagattcagagctgagacacctccaggccctgggtgcctccatggaaggtgtggctggtggcggaagagccacagtgacccagctctaccactcaccaacctcttcagccaagcctttcctctcaaagcctcaggttccccatctatgagataactattttaaaaaattacaagccccacagggctgaggtgggaactgttgggattatatatgtaatgtcacctgacacccagatggagagcataggccagttagtcatagcccagatccagggacccaggaagctacattaccagtgtgtggtgtgtgaaggggaacattggcctctgctccagaaccttctaggggcaggcctgaaaatgccctccaactccgagccccactaagtatcctcctcttggagctgttcggagatgacccactccacagcaggctacagctccagagacggtagcccccctggaaacacccaggctgacctcaagggcagcccacctgcctggagctgcccccttcacaacctgcagcagaaaagaccaggccctgtgctgccagccaaggtctcaccccaagcgtgtgctgggagcctggctgggcctttccaacccacggcaccattcaggatggccctacagatggtttcagactcccccacctctgccctgggcggccccatctgctggcccagctcagattgctgggctcccagctctaccgtggccccaggcagtgtaaggcgatctggctgcccaccagcgctgggccctcacacagcagctgagccagatgggctggggaggcggtgaggaggccttgaggaggagcaggctggggccctgacacaaggatgcaggggaggcggacgcagctgcgggtcctgcttttcccatattggcactgcacatgattgctcagagcggagagacacaagcaaaaatgtgctagtgccaaaatcggccaagcagatggcactggtgcgggctctctggggacacactggacgaggggccttgcatccctgcacccttggaagcagcctgtttccgacgtctaggagcactcaaggcagaagtgggtaaggtgctccggaggccctcgtggatctgtctctgctctgtttatggcccttcggtaattcactgactgagactgttcacagtgaattctaccagtgccatacacagaacaggagtcacactctgcggcctgccgaccctgcggagagaccagcggcccacgatgcccgttccctgctcctagcctgcccactcccttgggggccccccagcaggccctcagcagcggctgctacggtctctaccccccaccccatcccacctcttcacaagatccacatgccccatcagcccaagatgaccttcaaggagacagggacagtgcgggagaggggctgaccttctggccttgcagaggagaagaccacaccaaggtgtctcctatctccacctgaaggcccacatccctccacatcacccagactgcgcctccaggctggggagggagtgggtcaggaccatccatctccttgccagagtaactctggctcggagaggcaagcagctggccagagcctcctctctacccaacctgccacaggggcagtgaccagtgggacatccaagatgcctctcgtagcctctgagcccagacaccagcagcccaggctcctaggcactttggtctccattatcctccaccccccagcctgccctgtggcagaaacagagccccaggaacaaaccgaatctgctgctcacccccactcccatcccaaaccagaccagattgggccagactgtgaaccgcccaggctgggcatctctgctgccggcctaggatcaaggcaggaaaaggccaggaaaggagggcagaagagaagtcctgcagccacccaggtggcttggagggagccggaggcacggatgcactctagcaagggagtggctcctggctggctctggagtgactgcggaggaaagcggaggctcaggagcgagggaggggctgggaaggttgcatcagtggttgccagagcagctgcctagagagaagttgctgtggaggccctgcctctggtgtcacaggccctggggaaggacgggaagaagggagagggtgggagggagggtctctggggagctggcacccagggcaggcaagctggggcctccgcagagtggccactagagtctcagcctactccaggtcagcggtggcccagaaggcagggtggctagaaaatatcctggaagggtcagagcaggtgccctggcccagaaactatgcagacctcttggcgatgttacccccaggaactacctcccgtggacctcagagctccatctgggtaccttggccaaagccatccgctctcccctagacactgcttaatgctccacccttcctgctcccgaggactctttgtcctgctcccacacacccccactacagggctctgcccttctagctggtctatctccccagaggacaatccagcttgatgaggtggtgatctcaggaagtcactcctcagccttctgcctcagtttcccttactacaattttctgaactctactaaggaagagagaccagacttcccagccttgggtggggaggggaaggggtgatggcagggtgttagcaaagagtatggggtgggtagttatgaacattgcttaggatgtagccataagcatcacccaaggagcctgttgaaatgtagattcttgagcctgcctggaaatctgcattttaatagcaccctgacagctcagcatggggtgggggtgggggtgggaagatctattttgagaaatctttcccaagaagcctcaccctgggataattaaacagaatgcagaattcttctttcttctggctgggcgcagtggctcacacctgtaatcccagcgcactttgggagacgggaggatcgcctgaggttagaagctcgagaccagcctggttagcatggtgaaacccccgtctctactaaaaatacaaaaattagccaggcgtggtagcaggcgcccgaagctgaggcaggagaatcgcttgaacccgggaggtggaggttgcagtgagcagagatcgcaccactgcactccagcctgggcaacaacagagcgagattctgtctcaacaacaacaaaaaaaaaaaaaaaaaaaaaagaattcttcattcttcttttggggacagccaaggatggggagaggcaggtgttagggaaggggaacacgcagcaccttgcaaccaaggagccacagaggccttagagctggagaacagatggagccagggattctgctctccccagcccaggaaggaataaaagggaccccaggtagaggagagagccctgtaacaaagcagccaaacacgtacgctccttcaaattgtggcatctctgtcgagctccttggtctgttttcctcatctttgtaactgacataggatggaatacagggagcagctcgcaaagccaaatccctctccacttccagttctagtcggctgggccaggttcctcccctgcgcctgcctcacccctcctaacccaaatgcgacaggaagcccaagtgccgcagtgcctggggggtgccacgcccgctggggcctctccatcctggtggagggaggctggggcctgggccctagggaagcaaggtctcccagctctctcgaaaagcgggtaagaggagctctccgacatcagcagcagaatccccactcggaatctcaaaagggaaaacagaggcctatggcttggcgcaggtcaggatagcagcctcttctgccctccctgcaggacacagccctgaccttgagatcaaaggcacagaaatccgcttctggagtgggaagatgaagacaaggtctcccacacccgctgggcgtcagcgcctggcaatggaagaggaccaaaagagatgcaacttgcaggccaggctgggcagccagggactcacagggtgtgtgggggtcctacacatcctaggaggtctctacaaagcgccccctcccaccttcggtcgctctcagccccaccctcctgaattctacttgggccttcttaaaactcgagtcccctttcccctaggggtgtcccttcctgggcactggtgcccaatgcaaagggcaggcccccaaccccttccagtgttagaggtgagtgttgcaggactctgggctatgggtactccggggtccttagacagcacatagcctaccgctcgactcccggctctcctctccacctctacacaacgaatctggagtccagggtcccagccgcgccacccacaaccggtctggtcctgatctctccagtctctatcaaatgcccctgaggtcccaggggctagaggctgctggggcccttgaacgggcatgccctggacgctgcgcctgtcatcctgtgtccccatgaggtgctgggagaggggcccagagctcctttccccgaagcccaggccgccaccgacccattaaataaatactcaggtgtctggggtgcggagctcactccaagagccactgggccccggtaggagaaaaagaataaacgaaatcctcacaagtgaggccggcatcctagaattttctcttctttgcgtaaggccgactccagaggtcccgctaactcccccgcaggagcatgaaggggcggccttgagcggtaaagaaacgagcagtggtggaggctgccgctccgagcccaggtccgaaccgagagccgcgcggggaatgtgggggtcgaggctgagagctgggcttggggcaggttcctttgcgttcgctcaggccacgatgaggccactaggacagatttctccgaaggctcggcctcggatcagagatccgccgactcggtgcccatcggtcgggctcactgggtgacaggtagagggtgatgcgcacccgtagagctgagtgacccggcccgagaatccgccacctggctcgcaggattttcgccctcaggagctttgcgaagacgggcgcaaacctgggaggcgccgccgcaccttgcctgtgggggtggggaggtcgattacggcaccgcccgccctcggccctaatcgctcagagccggcctcagtgcccctgcccccggcgggtattactgtacacggtgtccgggagcccgggttggaagagcaaacgaatggctcagcctggaggacaccgtggaatcgggcgacccctgaccccgggtgacaccctcactgcccatagtcctgggatgcgctgaccggtgaggcgccagaggcaagccgtccagccgccgatcttggggaagggctgggaacctgggtgccactagcgctattaacaggaatggggcagttgagggcggggaacggtgtctcattcgcgtgcgccggggttcccgggatgagtggccgcgaagtggaggcacacgggaggtctgagagccgctttcccccagagactgggcggggcggctccgggccacggaagcagcctcgaaccagccgcgcagccctgacaagacgctggaggggccagctccggggccccggcgctctccgcagccccctcccagcctggcgcttccgcctgagcccaccagggcggcgaaacgcagcccgaccccagccaaactcctcgcgggtaggcacctcgcaagcaccggccgcactcggaccgcagccgctcccgcccccgcccccgcccgggaacagcgctgggcgctgggcagacgccactggcggacccgggacccaggcgccccgtgggcgcctccgcctgaaggcgcggaagagcgagtaggcactgccgcgtcatccccgaaagccagctgcgccgggacttctgccctgcacccgggttctagtgcggccggtcccgggcgcccgcctccgcctcctctactgagccccgctctggctccgcccggcccgcccccccgctcccggccccagacactcacctgcgccggctccaggctgggcgcacagccgcctctcagctccgcgcggagtccacaccagagaagccaggcaaaaacggccccggtttggaaagagccgcatggacggagcttgaagcgcgcccggcccgggcccaaacctccgctgccccgcgagagggggcggcgccggagcgccgagcccagcgggggaacaaaggggagccgggacccggccgcgcgcttcctgggtgtcgggtgacaggtctgccggggaaggccccggcccggccacctgaagaggagccgcctccgcgctgcaggcgggggaggtccagaggggtacctgggcccgaggaccggaagaacagggggcgcgggctgcccggaccgcgcggctggacggaggccctgcggctccggcacggctgcgcgggggctcgacggagtgcacagagaatgactccaggagggttttaccgccccccgccccgggccccgcccgcccctcgcgcagcgccattggctcaggtgccgcgaggcggggaggggcagggggcgggccggggatgattcaccttgaatgtggctccggttggtgcgcggcgcagggcacgcccgtccgggactgcggagacgccgggagccccgcctgcttgcccaacccggccgggtctggccccaaggggtcccgtcgcccgccttctatccccgcctcctgccctcgggctagggtgccgctagccgaggtgcgcccggacgccctgccaccccagcgccctctgagcccggagctagccgaggtgtgtgtggcgtggcgtgcttggaaatccgaccctgggaggggggaggggaagtgcgttgggagctggggcgcaccgtagggccactggacgatctctgcagtctccccgcagaaaggtgctcaaggctgacctgtctcagggggcgcacccggacccaggggcgcagggctggaatggggacaaggggcctccatgtcctcacacgcccaccctcggccagttctgcggcctcacaggtgtctggccaccgctgccgccgccgccgggaacaaaggctgtctgtcccaagagagggagggggaggggagccgcccccagacccgttcccatctccccctccccccactgcgacagtggctccctcgggagggggcggggccagccggggctggggcgcggacgcggattagatccttctcaaccgtcctttggtctgacaccacccggagcattcagaagggaccggggggcaggggctaggtcctccaagctgtcagcgttggggtggcctcttccttcttccccagcatcctgagcaccggagcgccccctccctccctgctgctttggctgcccttggcagtcccagctccgccccgcccggccgccccagacggcaacggcagctcaaaaccagattaaaataaaacgttaatccgcccttctcctttttagcttctagttcttcccaatcgacccccgcagatctggcaccctagaagcccctgtaaaatgagggtggtgcttagcctatgctcccaccaaacctaacccttgcacttgaagaccgttaacaccttgtcttgggctcgagcaaaagaagggggtgaggcagtggaagcggggcccgggaaatctatagtttccccacccccagctcctgccgagccgggaggggccaagggtgacggcaaggatacgaacccttcaatatgcccgactcccgggcagggcctgctgaagccgtagatgtcgcagccagatggatcgggaagcaagattcccaccccaggtggataactggacgagtctcagggcctcggggcccctctccccatgcagccagggatgggcacggtgagcgagaacccggacagcggagataatgagcacgtcacagagcccaacgggccaaaagggggtgatagctccacattaacccctccccgtcctactagcattcccccgcccatctaggtcgcctcgagcctccctggctgtctctgcacccgcgccctacctggtcctcagacccatgggatgctgggcaacccgggccgggtgtgcccaggaccgcaaagcgggaagcgcaggccttgcggactgcgagtggcccccgcggcctgctgctcccctttataacgcgcgccccgccccccgcgctccgggcgccccgccctggcccattcacctgctgtcgagaaccagacaccgcgcagcagaaagctagccgctgggccgcgaggtccggccgtcggagcgggcggggctggggcgccgccgagacagatccgatttccaccttttcttaaatgcgctgctgaaagtcgagaaggccccggccggggagctcgcgtcgcttcctcccccctcagctcccctcgcaccctgagtcccccagccccactccgggaggggccgcgaaactgcacccgcaagggcctcatacatattttaaggagcaggccaggcaggtaaccggagctggactcggacggtgagggggcggcccccggggacctgataccctggatcccttacggctcagggctcaggcgggggaagaggtggctcaggacgacctggggtcctcactttgctggcctgtccagcgcatcctaagcccgcgtgtatcctaccccctccttctgcagatccaatgtccgtctggcaattgccgcattccctctcgctggagagatcccttccgcctcgccacaggcgtcccacgctgcccggagtcgtgcgccccgggacgggtagttttgggttcctcgacgcttggccaggtttaggaaagacccgctgtcttccttgctgcccccacctaggagactcggcgccttgcgctccgtcctttttaatggtgtcgcggcttgtccctctggcttgctccctcctagtccctaccccacacggctcccttcgccagctccatgacaatcccactcgtgctgaagaccttgggcaaagaagtaaccatcggtcttcccctcccttcccattcctccggcggcaggactagggggaaaggtgcccgggatacaagcccctcacgcagacccactgatgcggccgtggttctgccattggcccctctccgaatggtgaggttctcctgctaaccctggccccatggcataactagtataaccccagtgagaggaacccagagttccagtcctcccctgctccagtccctctatgtgtgatctcgatctcgagggattcacttcacctctctaagcctcagtttcccatttgcaaaatgggcagaatgactcgcacctctggggatgaagaaaatgcacatgtgagcacgtgggtacttggcgacccggagatctctgcaaactgcaggcccagcgagatggcctcagcacgccctgcaccctcgtccgcgcgactgccgccgggtgcccgccccagccgctgtgtccctggtgcttcctccgccagggccacgtgccggggaagccaaagcgggagtctttcgatcttggcccagcccttagccctcggtcctttgctctagcatctagattctcgtgggtcaacaaagtcactggaaacccaacgaacttcccgacatttttcgaaaaccgtatgcgtgtgcttctgtgcgtttttcctctgatcgaggtagggccctgtagggttctgtttggacgggaggctggagtggttccttcccggctgcggggtcggaggatgcagagattcgaaagaaggagaaacacagagactgtcaaatgaaaggagattctgtcttcggaatcgacccagctctttaaaagaatgaggaaaacatggggtctttatatatcctggaaagtcgcctaggcgttcagtgaaaaacgcaaaaggcacgtggattcctatttgtgtaaaaatataaatggggcagggggttaaacatcaggtttttttctgcacgaaaggtctcagcgcagagggttggagatttttcttttcattgtatgtctttcgggactgttcgaagccaatgtgtgttgcttaccatattcttgcattgaattttcaattaaaaaaagaaactgcaggaattgttttttgtttgtttgtttgttttgagacggagtctcgctctgtagcccagactggagtgcagtggcgctatttaggctcactgcaacctccgcctcctgggctcaagcgattctcctgcctcagtctcccgagtagctgggattacaggcgcgtgccaccacgcccggctaattttttttccttttttctttttttttttttttttagtagaggcggggtttcaccgtgttagtcaggatggtctcgatctcctgacctcgtgatccgcccacctcggtctcccaaagtgttgggatcacaggcgtgagccaccgcgcccggccggggannnnnnnnnnnnnnnnnnnncacgcctgtaatcccagctctttgggaggccgaggcgggtggatcacctgagatcagaagttcgagaccaaccagcgtgactaacatggagaaagcccatctctactaaaaatacaaaattagccgggtgtggcggcactcgcctgtaatgccagctactccggaggctgaggcaggagaatcgcttgaacccggaaagaggaggttgcggtgagccgagatcgcgccattgcactccagcctgggcaacaagaacgaaactccgtctcaataaataaaatgaaataaaataaaataaaataagcattcgggatgctgaagcctgcaggagttgaatcagagggcgagctgcagagcggaggcactggggcggcgggccttgcccgggctcttggctcccatgaatcctcgatgagtagagaatcgtcgctcggagcaaaggcgagaggagagagaagcgtgcgggtgcggcccttgctgctttttatcaggcgacaccccggtcgactttgacccccgagcaggtgaaacataagcgtccaccccagaggggtcccctacccaagtcagaggagaaggtggcctgccaggttaaaggatcgagtccagcctcggtttcctcatctgtaaaataagccgagaacatccgcgcctctttctggagaaggctgggaggatgccagagagaaactgcgcgcaggccctggcgaggagcccctccggcccatgcggaactctgcacaggctgggtccctccagggttagaaacccagcttccccacccctacccagcagggacccgcgctgcatcccctaacgccccccaaccctctgcacccagacccaagagccggccttcgacgcaccacatgcgtggagcccgggtcccagccctgaggaccaggtttcagggctcagaagactccagcgaggttccctcgcagattgtgtctgcggtcgttgggggaggggccccgcagccttcagcagattatccaaaggtcagtgacccagatatggttttggccacgggccatgtttcacttcctgtgccccaagcagaatttagctgaataattcggaccccaaaccaaacaaaacgctcttatttccgtttggggattcttcggagttgggatttttctgtctcaaattagaataatctgcattattaaccacttaacatttatttgttggttggctgcctgacctttctgagcctcagtttcttcgtctgtaaattgggagcttacccaggtcggaggactgttggaattggaaatattcgaataaggaagtgtttttgcaagtgctttgtaagcagcaaagcgcttcttcaggggtcaatttttttttagctctgcagtcaccacccaaattcggaagatcgttgtgcctttcttggatgagaatgcccggctccagcccggggatgggacggtcttttccttgctaggagtccgctgtggagggggcgatgcgctctgtccaggacctaggagtccctttctccctccaccctcggctcacagcgggcagctcccccgacgcgtaccgcctctttgcccccagcctgaggtgcgctcttccccaggacgcctcctctgtcctctgcacgccgccggccctgctggggttgctttctgccgcggcgtcttcgcgaatatcccctcttgctgtctgcctgggcgtccctccgggttaccgcacaccgcctccgaccctcccagggcgcgggaggaggggcagggcatccgcgttcgtgtctgggccctggcggggagtcgcgtggtccaacccctcgtttttaagaggagggatctgaagcccagctaggcttctaattccagacagagccctacggagcccagttctctggaggctttcctggggcttttttcactaggccaggttgggtgggtctggagagaactcccgcaaccggaaattaaagaaatgcagagagaaacctggggagtggggccaccctggtcccctgggcaggctccggtctctggaccagtggggcagcagaggcctcgggagctgcagagattttcctgggcacactcctgaggggtaggtgcgaagctcctgctgggatgcctagaaagagggttatcatggggtccctggctgccggctcacagccgctcctgcttggagaaaaggcagggcagagggtaggggatgcacgggtgtggaaggaggggatggaggagaaagaccacaggcggtttgggttgttgggaggggagggggtgtgtgggttgcgggggtgggggggaggtgatcaagaatgatcaagaatccccgaagctctttgttcgttctttgatctgctcttttttttttttttttttttctttgctgtttgtttgttttttgagacggagtttccctctcgttgcgcagggtggagggcagtggcacaatctcggctcaccacaacctccgcctcccgggttcaagagattctcctgcctcagcctcctcagtagctgggattacaggcgtgcgccaccatgcccagttaattttgtatttttagtagagaccggatttctcaatgttgatcaggctggtctcgaacttcccttccgacctgaagtggtccgcccgcctcggcctctcaaagtgctgggattacaggcatgagccacggtgcccagccctttgatctgctctttaggaacctccaccaataaccagaatcctttgatctgctctttaggaacctccaccaataaccagaatcctttgatctgctctttaggaacctcccccaataaccagaatccagcagtctctccgcagtacctgctgtgggaacctgctgggcccccggtagaagggagggtctggccaaggcagtggggatggagttcccacagcaacagcaggccctgccctaagggaagcagcctgtggcctgtgtcaaggacttggagctgctgtgagctccctgcagatgctgggttggaacctggcctcagcctccagatgggctagcttgggggaattcctgcccagcatttagcataagtccctcctaatggaaaatgcaagccccactagggcaagggccacatctgccttgtagactgcggtatctcctgcctgactttctcggaaggtgctccatgaatatgtgtttgaattaatgagcaagggctgtgcagggtgcagtcacaaccaggggccagcgggattctcccgcaggacagtgagcggagaaactaaggctcaggcaggctaggcagcacatgctggcctggacttctttctgtccatcacagctgcctgctctgtgctaccccttttagctagcaatggccatgcctgggcttcctcttgggaggtcatttcaagggaggcagaaactcctcagtatggctttaggggtattctcctcttccctttttcctgtctcatggatatggtctttgagtgagccaattccacctctaggcttcagtttcctcatttgtaaagtgagggctggaaggaaaagcctttcctgtcttccttcatccctttatttttcttttccaagacacgttgaggcagaaacagaggcagacaagctgggctgcacttggaccaacggagcccactatgctagatatgcatgggacaacagacgtcccacgccgcttctggatgtcacatgctcttctaactggttaaactagcacatgcggtggggcttggtggctcatgcctgtaatcccagcactttggaaggccgaggcgggcggatcacgaggtcaggagatcgagaccatcctggctaacacggtgaaacccccgtctctactaaaaatacaaaaaattagcctggcgtggtggcgggtgcctgtagtcccagctactccggaggctgaggcaggagaatggtgtgaacctggtaggcggagcttgcagtgagccgagatggcgccactgcactccagcctgggcgacagagcgagactccgtctcaaaacaaaacaaaacaaaacaaaactagcacatgctaccccaagaacttaatcatcaagtcccacaggtctgggtttttgtttttgtttggttttttttttagacagagtcttctctgtgtcacccaagctggagtacagtggcacaatctcggctcactacaacctccattcaagtgattcttgtgcctcagcctccaaagtagccgggattacaggcacatgccaccccaccccagctagtttttatatttttagtaaagacagggttttgccatgttggccaggctagccttgaactcctggcctcaagtgagctgcccacctcagcctcccaaagtgctgggattacaggcctgagccactgcgcctggtctggatcttaaagcagagaccatgtgggccttcgaggagctcacattctccttgagatgaaaaggaagcatgctggataatgctcccagcctctgctgcagagaaaccaaagctggcctgctcccctgccagcagagactaagtggggtggtctgagattgaggagccaacagactcagcaaacacatgctgacaatcctcctcatttggtcttattcaccagcagagcccccatgggtataagtccagccatcaggtgacaggaggagcggctgagccagggctggattcggggaacgctcctcttcctcttcctcccacctccccaagctagggtgtcaggaatgtatcctaaccttgggcctagccttgggctcccttccatccttggttttggagttagggagctgctcccctccaaccctacttcaatgggtccccaacacaaacccaggcctcagccctaggccacctgccagctgatggggtctctttaaggaattgatttccacaagtccctgaagtgtttcttcggcagtaaatctcctgccacccaggctttctggcccatgaatgatttagcgccttggaggggttggaaccgtcttcctgtgcagtggaggcctgcagtggtgacatcacagctgcaatggtgatggatggactcttctaccctaatggggaggagaatgcacaggccgctgggaggggtcaggccatgaaagtaagtacccatctggctccgcagatttctggtttggggttcttactgatggaccagctagctaattgccctcggaggtacctagagaaagggcccgagtccatctctctgtccccagcccagagggacacaggctcatgtcactttgaggtttgcctttccaattcctaaagtgctctgaattataccgagcgccgtcttcccttgctccagtgacagcacgcatacaccccaacacacacatgcacctgcatgggtgtgcacacacacatccactgttctcaacaactctctcaggaagttcatcattatgtcccacctaaacgtttcttgctactggggaagcccatttttctctgattccatctggaattgacagagaacagctggtcattattagccatatgctccccctccaagcacacatggtgaatagcagcatgttcttggtcccttctccactcagagccccctcccccatcatctctcctctaagcatcaatgaccctagttatctctgttccaccagcctttgggggaaatgacaaggctttagtcagtcagcatccacagggtgccaacttcttcaagggagggtaggaagtggagggggtggtctctgaggcagggagtagcctctgcccactcttgccatccctgacaccagctggccctggcctatcttggagtaagtataacttggaggaggaggtaaatttcctgcttcaaaatagcttccccccattgcctatcctatagagacagccattggcttgatttttctctaagattgaaactggggtatgcaccatgcaaattcactgctatggtgcacatcccggattggtactggggtgtgcaacatgtgaattcactggtatcacatacatgttagcatgtcttagtttgggcattccagtgcgtgtgtaataatatctcatcatggttttaatttacatttccttgatgacaaatgatgtgagcatcttttcatgggcttacgtgcctgtgtgactgagtgtgagggagacagaagaaaggcctggctctggagcgttaggggaatgttgcagagtgagacgccacaatgaagggctccaggcacttcggagctcactgtggaaactgggcacaggtgagccaagagagagccaaggaagcaagcagcttcaactgaggccagatggatcatggtgcacaaaattcttccctgaacccttttttttttttttttttgagacatttgttgcccaggctgaagtgcaggggtgtgatctcagctcactgcaacctccgcctcctgagttcaagcgattctcctacctgagcctcccgagtagctgggattacaggagcccgccaccacctgggctaatttttgtattttggtagagacagagttttaccatgttggccaggctgggcttgagctcctgagctcaagtgatctgcacacctcagcctcccaaagtgctaggattgcaggtgtgagctactgtgccaggacccaaacactttttcattttcccctcagatctctgaagggtgggaagatctgaggcttcctgtgagtgtgcattttccaagttcactcagagggcacttggcagatgaaggctcagacccaagcgttctcgctcccggcctccatagtaccactttgctgtttacaaagtgctttcatggacatcatctcatctgattctcaggataaccccattttacgagtgagaaaactgagacttggagagattgagtggcttgctcaagccatccagctagtgagctgcagagcagaggagactcctcgggctcctccatttgtccctagagaggctcatctgacctccacctctcttgttgggattgatggagtctgctctgccctgcttaactctgctgggggcaactgcaggaacttactcagaccacctgtcctaggtgctgagccagtcccgacttagtttcagctgagccacatttagagaactgttaacatggtggtgttgaccttacctgtaagacccctggccacctcactcaggttgctctcagtcatgagattagaaaaccaagatattcctcccaaagactcttctcacatttgttgtatcttctgttttaatcatgaaaatccagatatggccgggtgtggtggctcacgcctgtaatcccagcactttgggaggccgaggcgggcgaatcacgaggtcaagagatcgagacgatcctggccaacgtggtgaaatgtcatctttaataaaaacacaaaaattagctgggcgcggtggtgcatgcctgtagtcccagctatccaggaggctgaggcaggagaatggcttgaacctgggagatggaggttgcagtgagccgagatcacgccactgtactacagcctggcaacagagcgagactctgtctaaaaaaaaaaaaaaaaatccaggtacaaaatgccttattaccacacagggtgagatctcgccctgactttattcactacctgcaagctcagacccccatctccgatggtcccaaagcccataagttgacagtacctgtctgacacatagtaggcattcattaaatgttcgttgaatgaatttgaatggggttcgttgaatgggatttgttaatgaacatggcttccttttcctgaactgtgattaattttaaaacccaagaggagggaagtgacatttattgggtaggtctttccattcctcacctctgccgtgtgaggttagcattattatgccattttatggatgagaaaatggaagctaaggctgggtgcggtggctcacacctgtaatcccagcattttgggaggccgaggcaggcaaattacctgagctcaggagttcaagaccagcctgaccaacatagcaaaaccctgtctctactaaaatacaaaaaaattacccagatgtggtggcacacgcctgtagtcccagctacttgggaggctgaggcaggagaatcgcttgaatccaggaggtggaggttgcagtgagccgagatcacatcactgcactccagcctgggtgacagagcgagactccatctcaaaaaataaaaaaaagaaagaaaatggaagcttgaggggttcaataatttggttactcagctaggatggggtagagccagcatttgaactgggtctgagtgccacactgaccctctgtccattgtacatgaggagagaaatcctgggtgtccctggataagcccagaggcttccagtgggcagggagccagcctgagatcctgggctctagagatgccttggcctcattgggctgactgtgtcagtcacagatcctggtcaaaagctatgaatttcaaactttactctagagctgtattccaatacagcatcagctgaacaacagagaaagctgctctgctccaaagtagcagtctctagtccaggggactttccaaccattttgaaatcagcagtccagcccctgccatcccagcctgtgcctgtctcaggccacacacagcagccatttgcagcttgtggttgctactggccaagttcaccagaggcccggataccagcatgatggttcccagccccccgccggggaggaggagagggggtcattgtggagatgataatgctgctccatgaatgtccaacttcctgaaaaccaccgggacacatttcgtttatgtgcttgtttatctcaggcctgcttccagaagggctccgaggagcagacaatgaaagaccaccgacagaattgctgttcacgggccaggcgcagtggctcatgcctgtaatcccagcactttgggaggccgggcgggtagatcacctgaggtcagaagtttgagaccagcctggccaacatggtgaaaccctgtctctactaaaaatacaaaaaaaagaatcacttgaacccggaaggtggaggttgcagcgagtcgacatcgcaccactgcattccagcctgggtgacagagtgagactctgtctcaaaaacaaacaaacaaacaaacaacaaatacaaaaaacattagccaggcgtggcggcaggcgcctgtaatcccagctacttgggaggctgaggcaggagaatcgcttgaacctgggaggcgaaggttgcagtgggccaagattgtgctgttgcacactccaggctgggtgacagagcgagactccatctcaaaaaaaaaataatgaagaaactgtgtcaaaaaaaaaaaaaagagctgttcatggaaaaagaataacaaaagccccacagaaggaggggacagagttacacggaacctccagccagtggtgatgattaaatgctcacctacatacatgctgacctcagcagtcccagcagccccctgcaatacacgtggcaagggacagtcttcaggtggcctttgtagcagcgtggctgcttcccctgggttgactcacttttcctccacctgatagtccaggggacatgaggggaccaggtcttggccagatgccagatctgagcatttttcactcaggattctctcgcattgagagacacaggctctggcaacggtgcccagtgtgagtggaatttgggaacactgtggccaggtggttggcacccaagcgtttccctgtgtcctgcaggcaccctgccctctggcctgcagcccttttgccagggccaccatggcccttcccacagagaccagcacccaaagtgggcaggagcagggcaagatcagggcccagcctggaagcccttgcccaactgggaaccctcagtaggaacacatagctgcagcaatacgtctggggctccaggaggagcttatcgcctttctgtctctctccctcacagcccattcagcaggggcttgagcaggggacagggaggctggtgaaaggccacccgaggctgcttttcaatgaaactatctgtgtgcaggatagaattacttgtatcaagtacaccaagacttttaatccattttgtaatcaaacagggcatctctctgggcccctatgagcctgagatgacagcgtagttccacccacttcacaggtggggaaactgaggtgatggagagggtcagaagtaatccctttcagcccagcaggcactggggaattctgagctctgggctcccaggccaccccagactggctgaagaatgagcaacacgttgccctgggttcctccttctgtccccagccaagatgggttctgcttctggttggagctcttccaccatctctctgtacaactttgggctagacgtgtgtgccttggtttccagctgtgcagcagggcagtgctggccggtccgtctgttgtctggagtggctatgcacctcaaatgggacagaggaggggagagaactttgctaagtagaaaatgctagacccggccagtcacggtggctcatgccctgcaatcccagcactttgggaagccgaggtgggcgaatcacgaggtcaggagttcaagaccagcctggccaagatggtgaaaccccgtctgtactaaaaatacaaaaattagccaggtgtggtggcaggtgcctgtaatcccagctactctactcaggaggctgaggcagagaattgcttgaacccgggaggcagaggttgcagtgagccaagatcatgccactgcactccagcctgggtgacagagcaagactccgtctcaaaaaaagaaagaaaatgctagacctccatgaggggcagtcacatgtcatggccagaggccaccgaggtaagggagcactccacaccacagcagacagcactgccctgagggccccagggcttgggctctagaccctgagcggcctctggaggccttcggatgctcatctattaaagcaaagggctggagctcccttccagccgggcactctgtgctgttccaagctgcctatgggtggtggggtggtggtatttccctggtcactccccaccaggcctgggcccctggacacccttagcagaggctgtgtctcctctgggcacttgtcccaccccttgaggaactcacaggcttagtccctcagcccacccgagctccttgacacgtttccaggaccataggacagtgcggcgcaggtcgtgcagagtggcttctaggtctgagccggcactcgagggcggggtcctggtcggggggatgggggctcagcatttccccacactggggcaaggcctggcctccactgtgcgtgcacaggactgaaggccccttcccagctgcatggagatggacgtccctggcccaaaggagcaatgagacgccctccaagtgccctctgcagctgaagaaaaaggccctgggtcttgggtgcccagttgaatacaggacaccattcagattggaacttcagataaacaatgagtacatttttagtataagtatgtcccaaatattgcacagaatatacttatactggaagtatttgttatttgtctgaagttcaagtttgactgggaatcttgtacttttctttttcttggtttgtttttgagacggagtctcactctgttgcccacgctgggagtgcagtggtgcaatcttggctcactgcaacctccgcctcccgggttcaagcgattctcctgcctcagcctctcaagtatctaggattacaggtgtgcaccaccatgcctggctaatttttgtatttttagtagagatggggtttcgccatgatggccaggtcggccttgaactcctgacctcaagtgatccgcccacctcagcctcccaaagtgctgggattacaggcatgagccattgcgtctggccttgtatttttatttctaagtctggtgactctaccttggtcctatcccctggcccacccctcagtccctgctgctaaaatgtcccacagaggctgccggtgcccagtgggcgccctcccaagctttgagtgtctctgtgaatctgtgtgctcctgatcttgcaggctctgtttctctcacttctgtctgcttgagtctcgccctcctgtcccctgctgtctacctcagacagtccctcctcagcctccctctgcgttccctgctgtcctgcaaggtgacgctgagcaacatgactagtacacctggtgctgaggactcaggctccccaaagggccagcctgcacagccaaagggggtcccctgagggtgagaggagcgtaggggactggtccctgctcccctggatatggggaaaacccaggactccaaactccagcccctcccactccagccacctgggagagcccgcttcacctgggaacaggttctaccatccagaaggcaatcaggcacgtgccctaaaggggtaagccctgtcccttctgtcctgggagaggggcaggcagcaggaacagccggtccatggctgggctcccaggtcccacctgcctgtggcagagctgacgagggctgggaacagagggcttcaccagacctgtcccacccacggccctcagctaagcaacagaagtgagctccctcttccctgatgacccaggaaaggggctaggacctggcaccactgggacaagcctgggagaccagcactgtgctggcttcctggctcatgtgactttatttttattttattttattattatttttcttgggacggagtctcgctctgtcgcccaggctagagtgcagtggtgtgatctcgattcactgcaacctttgcctcccaggttcaagtgattctcctgcctcagcctccagagtagctgggattacaggcacctgccaccacacccagccagttttttgtatttttagtagagacggggtttcaccatgttggccaggctggtcttgaactcctgacttcaggcgatctgcccgcctcagcctcccaaagtgctgggattacaggcatgagccaccatgcccagacttgtgtgactttaaacaagttacctaagctctgtgagcctcagtttcctcacctgcaatatggggctagaaacatacctacctcatgagcatgatgggcttcaattcaatcatctaggtcaagctcttagcacagtgcacagaaatgggacacccttgaggcatatttcttctctttgtctctgccggccaggagccaattccgtatcttattacacaataattaaccaatggggaggcagggagcgccccctctacctcccaatctcagagggtcctgcagacccactgcaactccagaagtaccatgtatgggaagcagagataattttgctctcagacgaggcctgaggaggcctttcccttctgggcctgggcccaggaaacacggctggccttatggagaggagtctggggaaggagaccctcccctggggggatcacattacctgagtgagagaagctggggaaaaagctgggggcgggggtgggagggtgttgggggtggtgccaggcccgcatgcctgtgtgccttgggtgtgtggcccagcagaatttgttggatgctttgggattttatttttcttttttctctaatttcctttgaaaacatatgtttggcctccattacagaagtcctgcctatcgcagggaagcccacggcagacaacgcaaaccccagaaaagcgctggctgccgtcggctgcaggttcctgcatcttttttccaatgtgcacttcgttttaataaaaaatgggaccattttgtatacactgtttttgtatcttccttttctcactgcgtaaccttttcccatttgggaaaattctattctgttgacaatgaccagctgcatagtgtttcatcttctggctttgactgattgattcaaagcccatcctaaggacagctgagcagtttccaatttctggctgttgcgaaagagcgaatttctttaggatacattctgatgagtggtgtcttcgggtcaaaggtgtgcaaatcgaaaacatttattggttcatattacagaagctgcgcacgcgcgcgcgcgcacacacacacacacacacacacacacacacacacaaaacacactgtcataattccagcaggcgctgggccctggctgcaggcagaggcttgaggagggctgacttgggctgagctgatgtgggttggctgcctagggagcctagaaagttcttcatggagaggagagatgggatctgccctgcttgtctgtcctcgggttcgaggttggccatccccccacctcaggctgcaggggtcccgcacccgcagaaacatggacgattcaatattgatacctggggacctggggccagctgggctgggtggcagaagagagccagccttcctacctcagctttgcccccacccacctgacccacccccagcccaccttcaggcccacctgaaaagctgcttcttactgaaagcttctctgatcctcagccagaagtgcttcttccctcctgcagtacctgggacagaccccccagtgaggatgggggagacccctccctcctgggggatgggcccggggcttgaggtgggagaggagcggcctgggttggcgagacccttccttctctgggcaggaggcccagaaagtcatgttatggtgggtcttggagggtaggagctttccatgtgatcccataggcagtggggggacggcagtgacaggcggtgaggatggacagaagccgagggcaggaggagaggagacagctggaaatcccagagacgatgcggggtgtgagcatgggagagagaatgtggggcttcatagaggcggcttctagaattgacttttttgctgactgtggggtcagggctgagagaagcgtcaaaggcccaatgtccaggtgtccctagccggagaggtggggttcaaatcagcctccttcgggtccatgcagcgtggcaccatggtggctgccatgccctggctggctgacctcatgcaaggcaccgcatttcctgacctatgcacagggcataacaagcgtgcccaccttaaggggcttcgtggggtcaaacaaagcaatgggtggaaagttcagggaacccctcagtgccctgggctcacaccaccagtctctgagtctatttccttacctggagtagatgaggttaacgtgcctgccttgcaggcccaggtatggaaagcattcagcacatttggggtaagagttcgaaagcctagtaactagggggcttaccccttaagcccatgggaactgctgtgggatccccgtggtcagcctggggttgacatctggggtgttgcaggggcgccccctgaggggctgtgcactgtcagccagggagggcctgccaagttatgatgtcctgccctcagagacatgggtagggaggaggctaggaggggagggaccccgcccctagcagcctccggagactgaacacaggcccaggtgcccacccagcagagagctgcccccagcttccagccctgggtccagcaggatgcagaagcagcccctgcccactggatggggggcaggtggtaggggtgcccaggtgcccctgtgcccttctgccagccaggcctggaggccccaggagtaacgagataatcacagcaattgcagcgagataggactgtctgcttgtggagcactgagatgctggagcaggcggggggccgggagagtggcaggaagcttcctcaggcagagtcgctcgtcccaccagccggggtgccaggactctcatcctggaaccctgcactcccacccagccctagtcttggtgtccaggaagggctctgaggccttttgctcaaatgagcccatcatctaatgagggagaggagtgtgggtggggagctctgcgggctgcctggaactgactgtttagagttcaggttatctttgtttaccactgagaaaacataaagctgaacacaggtattaactgtgcccacctgctcctgccattgattcgctcatccagagttgcagcccatggcaccagcaataaaggaaattgcttttgaagttgacagaggctgggaatgaagctccaagaccgactggcccgtctcttccaggtggcagctgggtccctccccacccacctgtcccccaaagccaaagacacgtagttgtcaccagggagctgggaagcagcctccaatcctgacgtgtgtttttttccaagagaccctctgctgcccaggattataggctcacacctataatcccagtactttgggagatcgaggcaggaggatcattcgagcccaggaattcaaggccagcctgggcaacacagggaggcccccatctctacaaaaaaataaaaaattagccgggcatggtgacatgcatctgtggtcccagctactcgggagactgaggtggggggatcgcttgagcccaggtccaggctgcagtgagctgagattgcaccactgaactacagcctggatgacagagcaagaccctgtccccaaaataaaaataaaacaaaagaccttgtgcctatgtctcccagcccaacacggggccatctgccagggctgcagcatgagggcatgaggagagatgctaagcaggacttcctgaggaccagcatctgcagcatgaggcagggtgtacactctcttcccgacagttctctgggaaagcagtgtcaggcctggggaatcagaactggacaagaggccttcctgccccaggcacgtgctcatctgcaagccttccaatgacctaagtaggggaacctgctaagatgttcctccaccaaggggcttctctgctttcagcacccagactcccacttccccaggtcgaaggacctcagagaggcagatcattaccccaatgcctcccagctccgtctcccacacccttgccctcgtcacaccgggccacagcgtccctgtgcctgcagactctttccctactgggaagccagggtcctcgcctgggttctccttcttcaaggttggtgtagtggagtgaatggtgtcctccaaaagatacatacacatctggatccccagaacctgtgaatgggaccttatttggaaaaagggccttttgcagatgtaattaaattaaggattttgagatgaggaggtcatcctggattatcaggtggttcctaagtgcgatgacaagtgtccttataagagacacacggggagatggacacagcagagcaggagacaaggtgatggtgcagacagagcctggagtgacgcgtctaccaggagcgccagggactgccatagctcccaccagccaggagagacccctggaacagacacactcagcaggtggggaaggccctgcccctgcctcgattttgaacttctggcttccagaactgtgagaaccaatttctgttgtttgaagcccctcattgtggtcacgtgtcatagcagcttcaggaaacaaatgtagctggtgttctgggatgtcacccacacccccaacgtccacgacagccataaactgttgatggcaagtctgtccctccaggatggtgtccatccaaatttcagatctctattcccagtggcgccgtgggcagtgtggtataatatgaaaaatatctggtctttgttcctgggtcctggcacagagttcccaaacccttggaattttctgagtgatggaagcctcttttgttattgataagaagccctttccataccacttgagtttctgctaatgaggtgacttatggtcaaaggcagttctgcactcctaccgatgctccctttaagtacatgcaaattaaggggcagattatgcagacatttctagaaaaggggtggtaacttccaggtcatcaggtcattgccatgggaaggggtggtaacttggggatcttgccatgaaaggggtggtaacttccggttgttgcatggcaacagtaaactgcaatagcatctgtgggtgtgtcatatgggcaggtgctttcgccccatttctattgtagctagagtcgtcaaatcaattcggtgtggtgtcccagcccagcctctggagtcaagtttcacctcctgagtggagtcctgcctcctacctcaggaagattgagcccaggtgttcaagaccagcctggacaaaacagccagacctcatcatgaattagagtaggctccgccatctaggtttgtgtaaggacaccctgtgatgctcacacaatgacaaaatcacctaagcatgcacttctcagggagtatccctatgactactcccttttgtggacattcgggttgtcaggtctatttctgaagcacccggaaacagtcagttctggcattttagagaggttctgtatctgcagccttgttctgtgcaagcctactgggtgtctctttcagaacatatcccgatttcggagaaatcccccaccatcctgtccatgatcgagggcaccaagaactgatgcttgagccagacactcaaccacaaactgcacttcagggaggcccacagcctttgaggaggtttggagtccgctgcctaattagggctcttcatcttggtaggtaacacaggagggagtggagcctggggtttaggaagtgtggcaccgttagcatacacagaggaagctcataagtgctctgcaggagcccaaatggtgctgaggtctgtttcatacgaagagtctcggaggccaggattcagctgaggagacagattcctgtcctcgggtctccctgccataactctggaagacaaccttgaaccagtggatatgattcttgtaggatattaaatatgtctcttttcacagtcatgctatttatttactcaacactttttattttttttgagacagagtattgttctgtggcccaggctggagggcagtggcacaatcttggctcactgcaacctccgcctcccggttcaagcaattaccatgcctcagccttccgagtatctggggttacaggcctccgccaccttgcccgggtaattttttgtatttttagtagagatggggtttcaccatgttggccaggctggtctcaaactcctgacctcaggtgaggatctgcttgcctcaggctcccaaagtgctgggattacaggtgtgagccacctcacccagccttttttttttcttcatatagggtgcaaaggtacattctctcccgctcttattatcacaaatgtcaaattatgaattaaagatgttttattgtagctgctcttgcaatgtgaatgtgtgtgtgtgtgtgtgtgtgtgtgtgtgtgtgtgtgtgtgtgaatgtgtcatatttgcatttgggccggacctgaatgaatgactttagaatgagactctaatgaggatgacacaggcggctttcgagggatgagacctccccggagaaggacagagacattatttggctgtcttctttccggagggtaaggatttggctaagaattttaaacactcacgtcctccagctcacaggagtgggtcaagagcagctagagggagtgcagagaggccggtgtcgatgttccagaaaagtgagacgagggatgtggtcgatgactgccctgccagccgggtgcaaataatgcatgggaaggtatacaagtccggtggaaagaaccctgggctggcgataaggagattggcctgtgaccttgggtgagttctgtttggctttgagcaagtcgcttaagctctctgtgctgaagcatgtgaccgcgcatggaaaacaggccagagatcggcctccgtacctcaggagactgagtgggttgttaggtacaaaatgcctgaagtcctttccacagcaaggcagggcatacacagacctatcaataaaactgaaggcatcaggaatcctggtggggaaactgaggcccagcccaggaaagccctgtgcccaaggatccggggattgtctccatcctgcctttagggaaaagcaagctacccatctagggtctgggtagagcaccccgggaagagcaaggagacatcccagatggaggccctgccaggaacacaggccatttcccttgcaaagatgaaattcaaatctgaggtggcatcagtgccaggggaggcagctgggcacagatgtgtcttgggaggatctgggggcagcggatcatgtcacatgagagcaccggaccaggattcggcctgacccctccctcctgtgactctgagccctcaggctgtgggggctgactgtcccaccgcccaggtcattctcggcactgccccagagccatagcggaggcagggctggcataaagggggccctgggacgaccccaggccctaaggcctccaggcctgtccgggccgcccagctagggaggctgagatggccgctcggccccagccagcatatgcattagtaatggccactgatcctgctggccccgcgccctgtttccagagtggggcagtaatctgagcccggctgcccactgcctccaggctccaccctacgttgctggggccattgaatgcctctacttttccttgttctcagctctgcatcgaaatgaagagaaacacaaaccagcgatgtctcctcaacgtcctgggcgttagctgttcccaccatcacttcatagagaggtttctggatgggaagcgttaggaaagacccagggaggcctctgaggacaccttgcgcagatgtgaggccttcctgggctgggcctcagtttccttactgggggtggacaggtctgttctgaggctgtcactggcactgatgttctggggtcctggggcccattgcttgccctaatgtggggggtcactctggtggaggggacccggtcagaccatagcaggctagaccgtgtgtggtgacagcaacacggcccagtggcagaggctcctgggggtgggggcattaggggatgaagcaggcctggaggatgggtggatccagagagcactggtgagtggggggggtgcctcagctcagggggcaggcctgcgggatggggggacccctgggacatttatccagcctgagactggaggcagctcttcttaccttcctgggaagggccttcagccctgcctctccccctgcacccacctggcaaacctttcactcccagcagctctgggatgtctctcgagggacccaggctccgtcctgagcctgtggcctgtctccggcagccgcccttgggtgggaaggtcctggctggccccagaggtttttcctaagagcctgtaattctccccggagagataaggcatggttacatggactcatatcacactggcagagaaagcgcctccaggaattaggccaccagccaggggatgggcaggcctgtgtaggaagggcagcctctcagttggaggaagtgggggtgtgggacagccgagggcactgagaaagtggggaagaccacatcttcatgggagggtgggaccagcccaggctgtgggagtggcctgctgtgtgacctcagagaggccacgatccctactagctgcctctaggaaaggaatctgagcatgaaggagtagtggggacagggagatttgcttttcactatataattttttgcaactttttgaaaaaagtacatttttttttgagagtcttgctctgtcgcccaggctggggtgcagtggcatgatctcagctcactgcaacctccacctcccgggttcaggcaattctcctgcctcagcctcccaagtagctgggattacaggcatgcaccaccacgcccggctaatttttttttttttttttttgagacagagtcttgctctgtcacccaggctggagtgcagtggcaccatctcggctcactgcaagctccacctccctggctcaagtgattcacctgcc

SEQ ID NO: 12450 - DNA, 13090 bp, Human
  misc_feature (1)...(13090): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggccctgagctggggagacccccacggggtagggcgtgggggccacgggcccacctcctccccatctcctctgtctccctgtctctgtctctctctccctcccccaccctctccccagtcctaccccctcctcacccctcctcccccagcactgcctctgtcactctcgcccacgtggatgtggaggaagagggggcgggagcaaggggcgggcacccttcccttcaacctgacctgggacagtttcccttccgctcacctccgcctgagcagtggagaaggcggcactctggtggggctgctccaggcatgcagatcccacaggcgccctggccagtcgtctgggcggtgctacaactgggctggcggccaggatggttcttaggtaggtggggtcggcggtcaggtgtcccagagccaggggtctggagggaccttccaccctcagtccctggcaggtcggggggtgctgaggcgggcctggccctggcagcccaggggtcccggagcgaggggtctggagggacctttcactctcagtccctggcaggtcggggggtgctgtggcaggcccagccttggcccccagctctgccccttaccctgagctgtgtggctttgggcagctcgaactcctgggttcctctctgggccccaactcctcccctggcccaagtcccctctttgctcctgggcaggcaggacctctgtcccctctcagccggtccttggggctgcgtgtttctgtagaatgacgggtcaggctggccagaaccccaaaccttggccgtggggagtctgcgtggcggctctgccttgcccaggcatccttggtcctcactcgagttttcctaaggatgggatgagccccatgtgggactaaccttggctttacgacgtcaaagtttagatgagctggtgatatttttctcattatatccaaagtgtacctgttcgagtgaggacagttcttctgtctccaggatccctcctgggtggggattgtgcccgcctgggtctctgcccagattccagggctctccccgagccctgttcagaccatccgtgggggaggccttggcctcactctcccggatcgaggagagagggagcctcttcctgggctgcccgtgaccctgggccctctgtgtacactgtgaccacagcccgctcctggaccctctgtgcccggctggccctctgtgcccagccagcctgcacctggggatgccaaggcctggggagggtggtttcacccaggccaagcctaagacagtccctctgggccctgctgggtaccggggtgtgacaccactgggaggacaagatgaggggcacccctggggccgccctgacaccccctcgaggctcctgccccgggggtcctggtgccccttcactgtggcaggcgactgggggttccccacctcggcccctctcccggggcctgctccccggcacctgaggcagcatccttgtcagggccgtgccttcctgcctcagcgccacctcttaaggttggcccgtgggtcactcaggactcagaactggagattctgggcaaaaggcaaagagcaaagggccaaaaggcatcccagggagacgactgcgggggaaccagagggcagaggggcgctcgtcacaggggagggggagctgagggaggcaggaggggagccgagcctctccccccgtgtcccggctcttcaggcacgccctcgggacgccaccctccccgacccaggcgggaaagataagagcaaggtgtccgcagcctgacactcgtgcctcaggtgcccgcgcttgtgccggacaagactctcacaggtggcatgcctcggtttccccactggtaacagcacagggcactcagcaaggcgcagtgggcatgactggggtcctgtgggtcctgacccagatgtggccaccccggccgcagtggtcttcattccaggatgcctcttttccctcctgatctattcactgcgttcgccattcggtcattcccggggccaccactcccacctcaggtgtgtgcttcccttgtgttttatgagatatccccaacccggctgcttattggccccgtccgagggcaggagcataaataagagcctctgctttggcgtgggaccactgtgagctccagtcagcgctgccactgctgagctctgggccttcgacaggacttggccccttactgacttctccgtgtgctttgggtcatgggtgaggacgcctcctggcaaggctgcgtcctgaggattaaatcgggtcatctgtgaaaactacccagcccagcccctgacacttttttgtttgtttcttttagtgacagggtcttgctctgtcacccaggctggagtgcagtggtgtgatctcggctcactcgacctccggggctcaagcaattctcccacctctgcctccagagtagctgggactataggcacgtgccaccctgccaggctaatttcttccattttttttagagacagggtctcgctatgttccccaggctgggctcaaatggtcctcccacctcagcctccccaagtactgggattacaggcataagccactgcatctggcctccatgacacatatttttaaagtctgatttttaaagtcaaacttttgaagtcagattttaaacggactattttgaaaaatatacaaaaacgtttaaaaacaatgaatatccctcacctagaatcaataactaagaatattgacacatttgctttggggactgggcggctggagctgccatgacaaagctccgccgaccgagtggcttttaaacagagcctgccctctcgccgactgagggctggacgtgcaggatggagctccgcagggtcggctcccctgtgctctgaggggctctgctcagcctctcccggctgtggcttaaaaacagagcctgtcctcccgccgtggggggctggacatgcaggaccgaggggccacagggtcggctccctgtgctccgagagggctctgctcagcttctcctggctggggggttttgtggccaccctctgtgttcctgggttcagaagcatcccccaggctctgccttcatctctgcacgggtgactctgtacaggaagccaggcctgctggtcaatggccacccagccctgtgccctcatcttacctagtcccagctgccgtcaccctattcctaataaggccgccttctgaggtcatggggttaggacttccacataggaatctgtggggacacggttcggcccacagcccttcccacctccgcacacacacacgactgtgaggagttggaagacctcactcctcacccctgccaggtcctctagggacaagctcgctgtcctcatcccagcacagcccgtgggacggtttccttgtccctaatgggaccacggtcagagatgccgggtctggtctgggccagcaggttcctccgcccggggcaggcagccttcttctgtgcgcttctggaaagcaatgtcctgtaatgcggtctctctgcgggagcacccccaccgccacctcacaggcctgttccacagccccgggatgggctctgtctccctcctgaccctgcatagggcacagccctctctcatcaacccacgatcctacgtggatccgagagggagcacctggggaaacaatggaatcccatagaaacaccccaaatctaacttgatccaggaccagccagtggtcacttctgaatattcaccttcctagtagacactaccagccaagggaggccaggaagccttcctggaggaggtggcctgaggactggggtgaggcaggccctgcgtgggggtcgccacccagcacccccacactgggtgggagccagtctctgagactggctgggggaggtgggagagggggctgcttgaactgcagacaccgaggtctagcccccaccccacccagccagttggtggaggcaggggaggccgaggggcccagctggacctgctccccggggtggattccaaaataggggggttggggggggcggaacaggagcccagggtcctggcttgaggcccagtggctgagggctggtgcaagccagacaggaaaagggttgagcctgtcagcgccagcacagatcaagtcaggagcaggtccctccaccaatgtgtgcaaataaatagcagctaagtttccagttacaagaacaatgcacagatggtcccagggacattgcggtgtggacacgcagcggccattgtcctgtcgccagcacctcgccctacagctggggggtcccttagcacttcctagccatgcagggtccctgctcacagtacccgtgatgacttctgttcctcacctgcctgtctgtcccgacagctgcatggcagccctggcctgggagatggagaccccgaggggctgcctgcggtggtggggcccctgggtccccactgcattcccagaaacccagagggcagggcatttcccctgctctgtgccgagtccacccagccccagcctaggcccagtaagggctgcagcccaccctgtcccaggctgcctcccaggagccctcttggccctgatgccagaagcccatcttcctccattcaggcaggtctctgagtgccctggcctggctgcctgctggccctgagagtcacactaccccacagccctccttggtcaaaatccactctggagtggctggaagattccccgggcccacgccgcacacgcctatgcagggagcttcccctggccggccggcagacaagggcggtctcagagagggggctcacctcagcagccccttgtgtagctggccctcgcccctgccacctctgggaacaccaccaggaagctgggggacaggcacgcaggtgaaggaggcgagcgcttgtcagccgggaggccatgggcacagagggaacagggacaccctgggtggcctcaaggtcacttcaaacccctcactcgtcccctgggagggtgcccagtgaggttggcactaggagttggtcctggtcacatgacagacccacccacctctggtgtccagccagcacgccgtgggccagcctggctgcagggacacgagggcagcagccccctcctcctctgagctggttgctccttgagtcatcaccaccgcctgccacggaggccgcctgtcccaggaagcagagggaccgcagctgtggcaaccagggcctggtctctgtgtcacctcgctggggggccgtgcccaggcctgagacggaactgagtgacagtgcactgggtctgacagtgtggggctggcgccatgtttggggaaccctgtggcatgggacctgtgggtgagccgggaaaatcaccccgttgcatggcatctcgggcctggatcttaagcgcctgtgttggtgcctccgcctggcggaagagccgcgacccccacgttgccatgcgggtatcccaagccctgaccctggcaggcatatgtttcaggaggtccttgtcttgggagcccagggtcgggggccccgtgtctgtccacatccgagtcaatggcccatctcgtctctgaagcatctttgctgtgagctctagtccccactgtcttgctggaaaatgtggaggccccactgcccactgcccagggcagcaatgcccataccacgtggtcccagctccgagcttgtcctgaaaagggggcaaagactggaccctgagcctgccaaggggccacactcctcccagggctggggtctccatgggcagccccccacccacccagaccagttacactcccctgtgccagagcagtgcagacaggaccaggccaggatgcccaagggtcaggggctggggatgggtagcccccaaacagccctttctgggggaactggcctcaacggggaagggggtgaaggctcttagtaggaaatcagggagacccaagtcagagccaggtgctgtgcagaagctgcagcctcacgtagaaggaagaggctctgcagtggaggccagtgcccatccccgggtggcagaggccccagcagagacttctcaatgacattccagctggggtggcccttccagagcccttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccggggaggctttgtggggccacccagccccttcctcacctctctccatctctcagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacaggtgcggcctcggaggccccggggcaggggtgagctgagccggtcctggggtgggtgtcccctcctgcacaggatcaggagctccagggtcgtagggcagggaccccccagctccagtccagggctctgtcctgcacctggggaatggtgaccggcatctctgtcctctagctctggaagcaccccagcccctctagtctgccctcacccctgaccctgaccctccaccctgaccccgtcctaacccctgacctttgtgcccttccagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgaggtaacgtcatcccagcccctcggcctgccctgccctaaccctgctggcggccctcactcccgcctccccttcctccacccttccctcaccccacccaacctcccccatctccccgccaggctaagtccctgatgaaggcccctggactaagaccccccacctaggagcacggctcagggtcggcctggtgaccccaagtgtgtttctctgcagggacaataggagccaggcgcaccggccagcccctggtgagtctcactcttttcctgcatgatccactgtgccttccttcctgggtgggcagaggtggaaggacaggctgggaccacacggcctgcaggactcacattctattatagccaggaccccacctccccagcccccaggcagcaacctcaatccctaaagccatgatctggggccccagcccacctgcggtctccgggggtgcccggcccatgtgtgtgcctgcctgcggtctccaggggtgcctggcccacgcgtgtgcccgcctgcggtctctgggggtgcccggcccacatatgtgcctgcctgcggtctccaggtgtgcccggcccatgcgtgtgcccacctgcgagggcgtggggtgggcttggtcatttcttatcttacattggagacaggagagcttgaaaagtcacattttggaatcctaaatctgcaagaatgccagggacatttcagagggggacattgagccagagaggaggggtggtgtccccagatcacacagagggcagtggtgggacagctcagggtaagcagctcgtagtggggggcccaggttcggtgccggtactgcagccaggctgtggagccgcgggcctccttcctgcggtgggccgtggggctgactccctctccctttctcctcaaagaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagccgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaaggagttctgtcctgtctggtggctgtgggggcagtgggcaggagggagggaggcctccagggagggacaaggcggcagccaggctgaggctgtgtgtggagggtgctggtggctcccctggatcctggcctgagtcaggccttcccctcgctgtcccagaaacacacaggccctcctcgccctgtttgccccactcacatgtagagccctccggtgaaaaattcctccaacatcacggggctggggacaccatcttccccaagcccaggccttttaggggggtcccacggccccctggccccaggcttcctggccaggcatgggtgtccctgagtgactgtgcctgctccatagcccccgtgtccccatgcctaccagtccctccgggcaggggtggtacctggtgccagggcgtccacagcggggtgggagggctgccctgggctatgagggacacagcatctgcgggtccctccccaagtacacagggtgggggcagcgggggaggcggggtcacgtctgctggagccctatcaccctgctgcggtccttggcagctagcagcagggacggtgcagggaaaggagccctgccaggccctcgggcaccgcagccaaacacccactgacaccccggggctcattctctgcttgccatcctggagcccagtcctggaccccatgcctgtgtcagggacaggcacagagacctcgcagctctgggaactcccggtgagatccggcagatcaggcctggcagggaacgctgcccgggggctctgcacatgatgtgggtttccatccgcaaaacccgataggtcccatggaaaatgaccacaggcaatgagaaagccatagagtgctgcctgtgagatcagcgtccagaactcacagctctcaaacacccactcacagcgcagcgcgccagcgtccagaattcacggctctcattcatccattgacagcgcagcgcgccagcatccagaactcaaggctctcaaacacccattcacagcgcagcgcgccagcatccagaactcacgtctctcattcatccactgacagcgcagcgcgccagcatccagaactcaaggctctcaaacacccattcacagcgcagcgcgccagcatccagaactcaaggctctcattcatccattgacagcgcagcgcgccagcgtccagaactcacgtctctcattcatccactgacagcgcggcgcgccagcatccagaactcaaggctctcaaacacccattcacagcgcagcgcgccagcatccagaactcaaggctttcattcatccattgacagcgcagcgcgccagcatccagaactcaaggctctcaaacacccattcacagcgcagcgcgccagcatccagaactcaaggctctcaaacacccattcacagcgcagcgcgccagcatccagaactcaaggctctcattcatccattgacagcgcagcgcgccagcatccagaactcaaggctctcaaacacccattcacagcgcagcgcgccagcatccagaactcaaggctctcatacacccattcacagcgcagcgcgccagcatccagaactcacggctctcattcatccactgacagcgcagcgcgccagcatccagaactcaaggctctcattcatccattgacagcgcagcgcgccagcatccagaactcaaggctctcaaacacccattcacagcgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 12451 - DNA, 30402 bp, Human
  misc_feature (1)...(30402): n = A,T,C or G
caaaaaaaaaaaaaaaaaaaaaaaaaaagtacctggtgcatagtaagcactcaaattatttctattcttcctaactttattctgctgaaaaaaaattcacttaataccatgaaatgagagacggaataaattttatatattatacttacatgcatggtttaaaacagaaaatgtgccagacctccttacttaaatatatttaggtgacaattatgaatatttggattcagagttgccaaacacccccatatgctcatcattggactgtggcagcataatgtctagttttctactttggtttatttaccacatgataattttcttcttatttattgttttttttctaagacaaagtctagctttgtcacctaggctggagagtagtggcacactcttggctcactgcagcctcctgggttcaagcaattctcctgcctcagcctcccaagtagctgggagtataggcacctcgcaccacgcctggctaattttttatttttagtagagcgggggtttcatcatgttgatcaggctggtcttagacccctgacctcaagtgatctggataattttcaattataaaccagtggccgggcgcggtggctcatgcctgcaatcagcactttgggaggccgaggtgggcggatcacgaggtcaggagatcgagaccatcctggctaacacggtgaaaccccgtttctactaaaaatacaaaaaaattagccgggcatggtggcaggtgcctgtagtcccagctactcgggaggctgaggcgggagaatggtgtgaacccaggaggcggagcttgcagtgagccgagatggcgccactgcactccagcctgggtgacagagtgagactctgtctaaaaaaaaaaaaaagaaaaccagtaacctaaatctcatggttgttatcaggctagtgaaaagactcatcagtttaagaaaatgctccctgaaaagctgtttcacaaaagctttttgaaacacaaaagacccttccaatttatgaagacgctgcttcatttagtgggattttatcaccagtcaactaaatgttcttccctcaacatcttccatgacagccatccatacctcacctcttcttcatttagataaaccagaaaaatatccgcagctgacagtaaagagagacctagccttctggtgggtttcccagtaattctgtctctcaatttctccacacaatattgtgatatagaaaatctattgagattctaagttagatgtggctatctttagttctgattttctacttcatgtttgtcaaaagctattgtattacctatatttttccttcagttctttttgagacaggttctcactctgtcatccaggctggaatgcagcggcgtgatcttggctcactgcaacgtccacctcctgggctcaagcgatcctcctccctcagccccccaagtagttgggactacaggcgtgcaccgccatgcccggctagtttttgttttttttgtagagacagggttttctccatgttggtcaggctggtctcgaactcctgacctcaggtgatctgcccacctcggcctcccaaagtggtaagattataggcatgagcccccatgccctggcctttgtcttcaattcgtaagtaaacatctcatttcatgtaaaactcactccatgtactcctatagaagccctttttggatgattctcagagtatgctggagaaatacttccttcaaatcagtggttctttttttaaaacagggtctcactctattgcccagggtggagtgcaatggtgccatcacggctcactgcagcctcaacctcccgggctcaggtgatcctcccgctcagcctcccaagtaactggaactacaggtccatgccaccatccccagttaatttttcaattttttgtagagatggggtatcgctgtgttgcccaggctggtctcaaactcctgggctcaagtgatcttcccacctcggcctcctaaagtgctggaattacaggtataagccaccacatctggccaccagtggttcttaaaatgcacatatacacaacatgttgaatagacgtttaggagttgatgtccaccccctgccccacccccgaagcccatccagtatgaaaactagccagcaaggcagcaaagttcacttcagaaatgcagattctctgtcacagtttataattatgaacacaacacacacaagtatttccagttgtaaaggtccctcccaccttcaccaaagccagccggatgcaagaacgcctggtctccttaccacagagccggtggagggacttctctgagtaggtgtctcggtcgcagcctttccctatgtggctggtttctagctccactgtggcctgtactgaggcgactggctcgtcacatgtctccaggtggatatttggaaagacggccaacgcgccggtgcccggctcatactcaatcctgttgttccatcctgtgttggtccacaagtcagcaggggaagagagaaggaaaacacacactctaggttgctgccgcatacatcagttttaagagcagatgtgagcgcaggggagagaatgaagctcaccttgccacccaggggtgcaggtgggcttaatgctgatcttcaccaaaacatcttctgtggctcttttcttcccacagtcataggcagtgacggtcagcttatattgatgttctttcccgtagtttaatttctctgtgttttttatataaccttacagagggcaaaaacaacagtgagagccaaaacccatgctggttttacttttgttgtcctaggcggaaagacaaaatgcataggctttaagccctgtaaatactcagccagaaataaacatatgcttgggatgcttaaccctcaacctgtcctccctgagccctaacacgcactaaatccatcctgaagagtttcaacagaagagacggagctacacagctcagtctccacttactctcacagtgttacattgggctttacattaagatttaactgtttacatacattcagaggattaaaaaataataataattcaagtacctcaaatattaaatataagatcgctgatcaaacatttactatattaaaagaaagagagatttcctacccccacctgcttagaacagaagcctgctttttgaacgtggtgagtatagatctctggaaagtgtttgcaatgtccataattccatcaaagattctagaccgtgcattgattaacaatggaaacactgtattatctttttttttctttttggaacagggtctcgttctcttgcccaggctggagtgcagtggcctgatctcggctcactgcaacctctgcctcctgggttcaagcgattctcccacttcagcctcccaaatagctgggactacaggtgtgtgcctgcagtcccagctactagcgaggctgtggcgggaggatcccgtgagcccaggagttcgaggttacagtgagcagtgactgcaccactacattccagcctgggcgacagagcaagaccttccctcaaacaaaaaaaaaaaaaaaaaagatgtcacaggagattctaacttaatggagaacatggccaggcgcggtggctcacacatgtaatcccagcactttgggaggccaaggtgggcggatcacctgaggtcaggagttcaagaccagtctggccaacatggtgaaaccctatctctactaaaaatacaaacaacaacaacaaaaaattagctgggcgtggtggtgggcacctgtaatcccagctactcgagaggctaaggtaggagaatcacttgaacccgggaggcagaggttgcagtgagctgagatcgcaccactgtactccagcctggggaacagagtgagaaactgtctcaaaaaaaaaccacaaaaacaaaaacaaaaaacttaatggagaacagaaaatgagacaaactaaatgtaaaggtcagtctcattcagatgcatgtggactgaaagttaagaagattaaaaaaacaaagccatgtcaggtaggaggatttttatttgattttggtgggaaagcaaaaaagaggtgagccccacaagagaacacaggacttacaggttccagagaagaagttgtcagggaacaaagtagaaacttaaatgtttttacaattaaaagcaaacacacaccaggttaggtctccaacttgtgagttccatgaagttctgacgaagcacagaagctggggtgtaaagtcagtggggttagcagggactgtctacctagctgaaaagccggctcctcgattcttaccatctttgtcaacagtaaagggcacgtctggagtgatgatttcgtagctgcaaatctggctgaactgaggggagcagtcggcatccacggcctccaccctcaaaatgctgtcgtactgcttcccctcgatgaccgtggctttgtaggacttctccttgaacacgggcgcgtactcattcacgtcgttcacctgaatatgaacagttgctctggacaaagggagggagaaaaatatttttctgcttgttttcagtgtgagagagagacagagagtgtgtatgtgtgtttacccaattctgccctactttaaaatttcctgtttctgataccttgtttcatgaaattcatatgatgaagtcaaaaattaaacaagctattcactgcttttcattcaagtgtggagataacagaaagttaaaagagggatttgggtcgattcttccatatcctaagaataaagcaaaaaaccaatcatctaaaataaaagagacttgggtgtttttttttgacaatatgggacaagacaggcagaagggagataaacaataccagacgtctgtttgctctccaattataaagttgaaacatattttgtagcaaaatccagaaaaaaaatagagccaagggaagaaggggtatgaaacagagaaagcatgaaatggtttgattctgagagttcaaacgaattctgtcctacttctagggaataggctggagtccatggcatcacctggtcctgattcaacaaatggaagagttcaggagaggcaggccgttgccacctgccaataccccagctcagttatcaagaaaattagggtgtcatcagacctggctacaaataaaaaaaactgtaggtttcaagggctaatggtcagggcatgcttctgaatcagtcaaggactttggtcaaaatctgaccttttcaagggaaacaataacattacactgtggaaaaagagaagagactcactggggcactgcaccttctgctcaccatgagcctcctcatcccagtgccatcggtctgaccctcacaatgggttatgtgacaccatctcgcccacatacccttctttagtagatgtgctaagtagaaactgagactcagggccgggtgtggtggctcacacctatcccagcactttgggaggctgaggcaggagggtcaccagaggtcagagttaaagaccatcctggccaacatggtgaaactccgtctctaccaaaaatacaaaaattagccaggtgtggtggagcgtgcctgtaatcccagctgcttgggaggctgaggcacgagaatcgcttgaaccctggaggtggaggttgcagtgagccgagattgtgccaccgcactccagcctgggtgacagagcgagactctgcctcaaaaaataagtaaataaataaataaataaaacaaaagaaaaagaaacagactcaacaaaattaaatttgcacaatgccaaagggctagcaagtggtggagaaaagactagagctctagaaaagactagagcttacaatctaattgtagaagacactggacttgagaacaccagcagtccccagcctttttggcaccaaggactgatttcatggaaggcaatttctccacagatgggggtgggaggatggttttgggatgaaaatgccccacctcagatcatcaggcagtcgattctcataaggagcgcacaacctagatccctggcatgctcagttcacaacagggttcgcgctcctgtgagaatctgataccgctgctgatgtgacaggaggtggagctcgggcagaaatgctcactcgctcacatgctgttgacctcctgctgtgtggcctggttcctaacaggccacggaccagtactggcccacgtcctgaggtatggcgacccctgttctatgttgtcttgtccaaagccctctctgctacaactgcagttcctaactggcaggaggtgcagcaacacactcaggattgtggcagcgagccagcctacttccaccagcagtgactaatttttttttttttttgagacggagtttcattctttttgcccaggctggagtgcaatgatgtgatcttggctcagtgcaacctccacctcccaggttcaagtgattctcctgcctcagcctcccgagaagcagggactacaggcgcgtgccaccatgcctggttaattttgtatttttagtagagacagggtttctccatgttggccaggctggtcatgaactcctgacctcaggtgaaaatcacctcaggtgatctgcctgcctcggcctcccaaagtgctgggattacaggcgtgagccaccgtgcctggccaatttttgttgttattgttttttagggacagggtctcattctgacactcagactggagtacagtggcacaatcatggctcactgcagcctcaacctctcgggctcaagcaatcctcccgccttagcctcccaagtagctgagaccacaggcatgtgccaccatacctggctgtttatgttttgtagagatggcatctcctacattgtctaggctgctctcaaactcctaggctcaagcaatcttcccacctcagcctcccaaagtgctgggattataggtgtgagccactgcacctggccaacaatgattaagtttatgcccttaggaattacagcaaaagataaatatgacaacaaaataaccttcctaagggagaagcagactttttcaatttttaatgtagggcctttacttctttaatagagtatttggtgtgataaaattattcactcattcatttattaaaaacctaggccgggtgtggtggctcacgcctgtaatcctagcactttgggaggccgaggcaggtgaatgatggggtcaggagtttgataccagcctggccaacatggtgaaacccgtctctactaaaaatacaaaaattagccaggcgtggtggcaggcacctgtaatcccagctactcgggaggctgaggcagaaaaatcacttgaaaccggaaggcggaggttccaatgagccaagatcgtgccactacactccagcttgggtgaaacagcgaaactccatctcaaaaacaaaacacaaaaaggccaggtacggctcacgcctataatcccagcactttaggaggcccaggcaggcggatcacctgaggtcgggagtttgagaccagcctgaccaacatggagaatccccatctctactaaaaatacaaaattagctgagcgtggtggcgcatgcctgtaatcccagctatgtgggaggttgaggcaggagaatcgcttgaacccaggaggcggaggttgcggcgagccaagatcatgccattgcactccagcctgggcaacaagagcaaaactccatctcaaaaaacaaacaaaaacaaccccaaaaaacctaatatgcctaatgtgagcaaggctcttgctagaaactgtatacaagggtagagagacatgattcctgccctccaagtgtttacaatctaattgtagacacttgagaactatcttctgcctatttcaaaaacagtcttggggagcaggcaatagtcactactattttcgttctgcgcacacacgtttactcggtgggttatgttcactctttgtccagcttacttacttatgagactttttcacgttggtgccatcaggtcccttcccacaatcataggcctggatggtgaatgaatagtctttctgcagctcacagtccagtttctctttggagcgaatgactccctcaccagtggatttatccactaccactgcatcaaaggggacattctgcccgtgaattttaaatccacaaatctcacctagggagtcaaagcagaacaggtaagaattcctaccacatagatcttctgcaccttgccctcctccccccatctccacccccaaagaaaataaatgacaacaatttggcagccaggggtttggagggtccgtggacaaagcaggggcactgtgttttaaacatggggaagttctcgggctttagtaagatgaagcagattctggctttccaagcaacttgtttactttgcatccattcatgcaggaatacaaaagagagagagaagaaaatatagacaggcattccacaggagcacttagatagctcgagggtaaaaggagtctcattagcacacagccaggcctgagaacaccagcgctgccccagctcctgggagggctggcagccagtttgatttggaccagagagaagctaaaacgcagttatgtgttgagagaggaggaagcgtgagatataggatcagcaccgtaattacagaaattctgtcaaaaaaaaaaaatcaaaggaaacaagtcttcctgtgcaatgagcctggctaaaattagggaatcaaaacaaactactcaatgagaaaggtagaaataccgactcgtcaggcatccatttcaacagctattttatcatctacgattcagacacagtttctattatgggagggactggctagacttgcctttgtttcggactttatcctatcaaacctgaaaaagacaccagcctgggaacttctctacatctaaattggctcacaacttaattaggagttaaaaatctatgtttccattcttgtccatgggagaacagtataaatgttttgatgtcgatgtgaaactccacaaaatgtatttcacatgaaaataagactgcactccttccacaattccaactaatagaaaattgttacaaagcaaatctctgaagttctattaaacaaaaatgtacagtgttatccatacagttcaaatggatgtctgatttccagatatttctaaccaagggtctggttacatacaatttccatcaatatactttaaaatagaaacaaagtaggagaataaataaggataaaagagcatgacagtttctcctgtttaagggctgattcccaattttataaacaaagttagtgggttaatattcataagaggggaagaaagaaccctttatcaccttctttggtgactgtcacctcaaaactctctaaagggagaaaagataagcccatgtcagtaatacaggaaagaatgaagacggaatacactaaggaaaaaagtcaaaggtgcacatattacacatttccacaccaagctcagcgaccggcttctacgattgctacagcaaaacctaatcttcaggaacaaaatgtcactttgaatccaacttaccatgaactactgcataattctgaagttattaatttagggatgaaatactcctacatgaagtgtcctaacaccctcaggggtcattaggatttttcttttttttgagacagagtctcgctctgtcacccaggctggaatgcagtggtgctatctcggctcactgcaagctccgcctcctgggttcaccattctcctgcctcagcctcccgagtagctgggactacaggcgcccgccaccacgcccggataattttttgtatttttagtagagacagggtatcaccatgttagccaggatggtctcgatctcctgacctcgtgatccgcccacctcggcctcccaaagtgctgggattacaggagtgagcccccgtgcccggcaggatttttcttttaatgaacactctagtgacaaaccatgaataagtacatctatttgttattttgcagttttcagatgttcatttccaacctaaattctctcagctagattctggtaacattcaactcatcagtagatttaatgaaacaaaaatttggagcaaaaggtttttttttttttttgagatggagtcttgctcagtcgcccagactggagtgcagtggcgtgatctcggctcactgcaagctccgcctccctggttcacgccattctcctacctcagcctcccgagtagctgggactacaggcgcccgccaccacgcccagttaattttttgtatttttagtagagacagggtttcaccatgttagccaggatggtctcgatctcctgacctcatgatccacccgcctcggcctcccaaagtgctgggattacaggcgtgagccaccgcacccagccgaacaaaaggttttaaccctttgttcttgaactgaaaaaaatgacaatatttttctaatccaaagtacccaaccaaggcaacaaatataaacccctctgctaatggaacatctgcttaaatgtgaatagaaaccagattcaaaactaactgtagggatgctacaacagtcactgttctcattacatgaaagctctgttctaccaagtcaatatatatcctgcttataaaccctttactatggaggagtggaaatgtgaagagatcaggaatttcgctgcccctcaacacactgggccctcactggtggcaccttctctcccccaaaggtaacacgacctgaattcccttgctttgctaatagtgctaccatttattctccctgaacagtgttgtttcattttgcttggttttaaggttttaaaaatggtatcacatggcatgcagttttttgtttgtttgttttgggggggggtgggaacggagtttcactcttgttgcccaggatggagtaacaagatctcggctcactgcaacctctgcctcccgggttcaagcgattctcctgcctcagcttcctcagtagctgggattacaggcatgcaccaccatgcctggctaattttgtatttttagtagagatggggtttctctgtgttggtcaggctggtctcgaactcctggcatcaggtgatccgcccgcctcggcctcccaaagtgctgggattacaggcgtgagccactgcgcccagcccacgtgcagtttttatgacttgcttctttttctttttttgagacagagtctcactctgttgcccaggctggagtacagtggtagcatctcagctcactgcaacctccactttctgggttcaagcgattctcatgcctcagcctcccaagcagctgggattacaggcgcctgccaccaagcctcgctaatttttgtatttttagtagaaatgggatttcaccatattggccaggctggtcttgaactcctgatctcaagtgatccgcccgcctccgcctcccaaagtactgggattacaggcgtgagtcaccgcacctggccatgacttgctttttcatgcaactttgtgtatctaagatttattcatccttgctggtataggtagctatagtttattcattttcactactacctaacagtgagaatccacgggtcaaaacatgtaaagtgcttaaaacattgcctggcggaaagagagcacttaacaaatgtttgctattattacaatcattttccactgtgtgaaaatgccatcagttgttcctgctgtttaaaaacaatggtgtcatgattatttcggtccctgcttgctgctgcacgtctacaagagcctctgtacgcctgtgctgcctaacatggcagccactagccatgtggggctgttcaaatgcaaatgaaaattcaagctaaaaatcaaacaatgtgaaaaatccagttcctcagttacactggccagttctcaagggcccagcagccacatgtggctggtggctgctgcaagaagacaatggacgcagagtgctccccttggcacagcaagtcccactggacagagttgctttgaattaggggtctgcaaactgccgtttccagaaagtccaacctgttcctgattttgaagagcccacacactaaaaacaatttttaatagtacttcataacatgagaaaattacatgaatttcaaatacaaatacagtttctttttgtttgtttgttttgagatggagtccttgctctgttgcccaggctggagtgcagtggcacgatcttggctcactgcaagctccacctcccgggttcacgccattctcccacctcagcctcccgagtagctgggattacaggtgcctgccaccacacctggctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttattcccctaggagatcatctaaaatggtcaaaaggaactttacttaagaaatttgaggagcaggcctggtaggtcacacctgtaatcccagcactttgggaggctgaggtgggtggatcacctgaggtcaggagttcgagaccagcctggccaacacggtgaaatcctgtctctaccaaaaatacaaaaattagctgggagtggtggcgtgtgcctgaggtcccggctacttgggagcctaaggtgggagaatcacctgagcctcggatgttaagcctgtagtgagccattatcatgccactgcactccagcctctgtactctgggcgacggagtgagaccatgtctaaaaatttttttaaaaatttttttaaggaatttttaaagcaaaacataaaaatatgaaaaatggatgaacccaacaaagtatggatttgacttctggatatccaaagtcacgtgcagggttctcagctgacagcactttgccctcactttcctcatctgtgcctttgacaaaccccagctttaggctggccctgctgttctttcgaagtcttcttcctaatctgaggatggcccctcctacacacgtctcccagctctcaggggaccctgcccttatattgcaaatgtttcctttgctccttacgtataacagctaaggttctctgattgtaagcaacagaaatcctttctaggtaacttagcaaaaggaaactgattggaaaactatcaggaactcatggaactgactgtaggccagagaaagggacttggaaacaggtggaagccaaggcggctggagaccaggaaacaggaaccgcaacagtcccactgcagaacagcctggacagacagacccgaaccgcaactattcttagcatcgctgtcgctccactcaccattcaaacttcagggaggggcacctgttcacttggctaggggaagctgggtaacaggttgtagatccactgatctgtgcccaatgggaaacggatcacggggctgtaaagaagagaaaatgggccgggtgtggtggcccacacctgtaatcccagcattttgggaggccaaggtgggtggatcacctgaggtcaggagttcgagaccagcctggtcaacatggtgaaacccgtctctactaaaaatacaaaaattagccggacatggtggcaggcacctgtaattccagctactcaggaggctgaggcatgagaatcgcttgaacccgggaggcagaagttgcagtgagccgagatcacgccactgcactccagcctaggcgacagagcgagactctgtctcaaaaaaaaaaaaaaagagaaaatggacacttgccaagcagcgactatccacttctccccgctgcactcggccttggtgcccacactcaacggctccgctccactcggccttggtgcccgcactcaacggctctgctccactcggccttggtgcccgcactcaacggctgggtgtccgggctgtccctgacgttgggtgacctctggctttcttgccaagcagcgactatccacttctccccgctgcactcggccttggtgcccgcactcaacggctgggtgtccgggctgtccctgacgttgggtgacctctggctttcttgccaagcagcgactatccacttctctctgctccactcggccttggtgcccgcactcaacggctgggtgtccgggctgtccctgacgttgggtgacctctggctttcttgcttactggtccaggctagtttctggaatgagctcatacgtgtctctaatcagcagttttttcggggtacctttttttttcttttttttggagacagagtctcgctctgtcacccaggctggagtgcagtggcacaacctcagctcacagcatcctccacctcctgcgttcaagtgattcctgtgcctcagcctcccgagtagctgggactacaggtgcacaccaccacgcctggctaatttttgtatttttagtagagacagggtttcaccatgttggccaggctggtctcaaactcctgacctcaagtgatctccttgcctcggcctcccaaagtgctgggattacaggtgtgaaccactgcacccggcctaggataccttaaatatatgtaacaataaccacagactccaagagttacgctctcgcaagttcctcactgactacagcagtggctctcaaattctagtgtgccaaaaatggtctgtgacgcttgttaaaaatgtggtttccaagctccatccccagaaattctgacttggtggttctaggggcagagcccagtgatctgcattttgagcaagcactgccagatgactccaacacagacagtctgcagacctgggaaggtggcccattgggggtttgcaaacctagctggctggtatggatttctcaggtgccactcctggaggtacagactaggcagctgagcatggagctcaggaacctgcactctacaccagggccccaggtgatccagacatagcattggaaaaccccatgcatccattcagcctagcaatggaaaccatgtggactcaagttgacttcaatcctgtgctcctctataccccacgccacacaagctgacctggtcacctaccctgggaggcccttccagttcccacctctgctcccacctctcccctctcttcactgcctatgcaaactccacccaccctttacaggactcaagccctgtaaaccactgtagaaccacttctgggctatctcagcccattcagtgttgctacaaaggaagacctgaggctgtgtaagttataaagaaaaaaggtttctttggttcacacttctgatggctggaaagttcaaggttgggcatctgcatctgatgagggcctcaggctacttccactcactgcggaaggccaaggggaatcgtgtgtagaaatcacatggtgagggagaaagaaagagagagagagagagagagagagggagagagagaggtgggtgggggaggaggaggagcaaccacaggctctttttagcaatgagctcttgtgggaactaaaagagtgagaattcacccactaccccccaccccaccacctcacccccatagccagggacaacattaatctattcatgaaggattcaccccctgtgacccaaacacctcccattaggccccacctccaacaatgggatcaagtttcagttaggggcaccatggctcatgcctgtaatcccaacactttgggaggccaaggcaggtggatcacttgaggtctggggttcaaggccagcctgggtaacatggtgaaaccctgtctctactaaaaatacaaaaattagccaggtatgatggcacaggcctgtaatcccagctactcggaaggctgaggtgggagaatcgcttgaatatctgaggcagaggttgcagtgagctgagatcccgctgctgcattccagcctgggtgatgaagtgaggctccatctttaaaaaaaaaaaaaaaaaaaaaaaaaagtttccacatgaggtttggaggggacaaacatccaaactgcagcacttgcctccttagcccacaccatcgttgcctctgtcacttggggctgaactacaagtttcctagtatcctttgccaatcttggtttggccctcttacccacattatcagtggctttgaaaacaggaaccaacttttacacttttttttatcatctctggaaaacctagcatagctacctagtatttaatcattactgatcccaaactcttcctgggtggtgtctacatccaaaatgggtccattcaagtcaatcacggttaataagaagcacctgtcctaacattcagctacttacttaaaattgttactcaatgcattattgccttcgattaagctgaagcatgtgaaatgtcatttttttttcaaataccttaatatttcaacatttaaaaaaattgggccaggcgcagtggctcaggcctgtaatcccagcactttgggaggcaggcagatcaactgaggtcaggagttcaagaccagcctgaccaacatggagaaaccccatctctactaaaaatacaaaattagccgggcgtggtggcgggcgcctgcaatcccagctactcgggagactgatacaggagaatcgcttgaacccaggaggcggaggttgcggtgagctgagatcgcgtcattgcactatagcctgggcgacaagagcgagactccatctcagaaaaaagaaaaaattggcctggtgcggtggctcaatcctgtaatcctagcactttaggaggctgaggcagggggatcttgaggtcaagagtttgagaccagcctggccaatatggtgaaaccctgtctctactaaaaatacaaaaattagccgaaatcacttgaacccgggaaacggagactccatctcaaaaaaagaaaaaaaaaaatggaggccaggcgccgttgctccacctgtaatcccagcactctgggagactgaggcaggtggatcacctgaggtcagcagtttgcggccagcctggccaacaaagcggaaccctccctctactaaaaatacaaaaattagccgggcgtggtggcggcgggcgcctgtaatcccagctactcaggaggctgaggcaggagaatcgcttgaacccgggaggttgcagtgagccaagatcgcgccactgcactccagcctgggcgacacagcgagactctgtctcaaaaaaaaaaggcaatttcatgcaggtcaaccaattcactgctgcaagcacaaggtcagctcagttacatgtgctaaaaaagcaaaactgggcagtgaaatgcagcagttaaccccactggccaccctcagggcatgtgaatcacattcataacaaagaatacagacaagagtatcacagggctcctcggtgggctctaactgactatcaatgaaaactaagttcccattcttgccctgaaacttcttttggattctatttgtatcattatggttcaaccaatcttgtaaaacatccatacttaatctggaaaagcaggaaagagattgctagaacaccaccacctcctagaaggaggagctctgaagaggaaacaagaagaggaggcacggcttctgacaagaacagaatgcatcatcttcaaggccccaaccctgtggcccacacatgaggctcaagctggtaactctccacgaaatatataaaatgtaaacaaaataggccgggcgcggtggctcacgcctgtaatcccagcactttaggaggccaaggcggaggatcacttgaggccaggagttcgagaccagcctggccaacatggtgaaaccccgtctctattataaatacaaaacattagctggctcgtggtggtgcacgcctgtgatcccagctactcgagaggctgaggcatgagaattgcttgaacccggaaggcagaggttgcagtgagccgagatcgcgccactgcactccagcctgggtgacagagcgagaccctgtctcaaaaataaatagataaataataaaatacaaaaattgttttctgacccatgactactcaggctttcagcagattaaagagaaggcgcagaacaagaaactgaatcatttaaatttcctaaaacacttgacaaataccaagactctgtatcagaatttcaccccaaggaaacaatccgggcgagactggatcttcattgtgaatgtctgattagtgatgacttacaaggagcttcaatgactaagctcccagcattgcatgtgcattcatttcagagctctaacaagtgaactcctgtggctacccacacacacatgccttgtagtgggatcacactatgaactggaatgttcacacagtgagctgggcccagaggcggctctgtcacttatgagctgtgtgatcctgggtaaactcatctcctccctctacaaatatctatggagtgactgtgttccaggcactgacggaggttttggggataaaatggaaaacaaagtagcttctcctgctgtcacgcagctggcagacacgctgagcctggttcctcacctggagaacagggacagtgggcatgtctactgcgtaagattggagaagagaggctgggcgcagtggctcacgcctgtaatcccagcattttgggaggccgaggcgggcagactgcctgagctcaggagttcgtaaccagcctggggaacacggtaaaaccccgtctctaataaaaattacaaaaaattagccaggcatggtggcatgcacttgtagtcccagctactcgggaggctgaggcaggagaattgcttgaacccaggaggcggaggttgcagtgagccgagatagcaccactgcactccagcctgggcaacagagcaagactccatctcaaaaaaaaaaaaaaaacctgctgaaaagaatcggagaaagtaacccacaccgggccctcagagcaacctctgccacactgcaggcactcaataaacgttagatgccaccaccatcaccaccctcctcctcaacatggtgcgaaattaaactcaatgtcatcacccaaatcaatctaagatgaaaataaggctccaggtctagcctctgtcttatccaaaaaatacttaagaaagtctgtaagaaaatgcaacactataacgacttttgtagaaagatgaaaaaatatttctcacaaaatgttaagtgaaaaaatatttttaaaagattctattagtagtaataacagcagcggcaaatactgtaggtggtaattactgtaccacccactgtttaaagctcttcacacgtatgaataaagaagctaacattcccccaaaccaatgaggtctgtgacattaatgaggtctgtgacatcttatccttttacaaatgatgaaatggaggcacagaaagggtaagtaatttgcctaaggccacacagccaataagtagcagagctacgattcactcactggtccctcggctctagggtctctgttcctgacctcccttgctcagtctcatagggtcctgttctgtgctgggtggcaccatgggggcggggttgtcctggacggcaccatgggggcggggttctgtgttcggtagcaccatagggatggggttctatgttgggcaagatcatgggggcggggttctgtgctgggcggcaccatgggggcggagttctatgttgggcggcaccatgggggcgggattctgtgttgggcggcaccatgggggcgggattctgtgttgggcggcaccggggggcggggttctgtgctgggcggcaccaggggggcggggttctgtgttgagcggcacaatgggggtggggttctgtgctgggtggcaccatggggttggcgatctgtgttgggtggcaccatgggggcggggttctgtgctgggtggcaccatgggggcggggttctgtgctgggtggcaccatgggggcggggttctgtgttgggtgacaccatgggggcagggttctgtgttgggtggtatcatgggggcggggttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaactctgcagaatttcagaaaaacccaccacttgactgaaaacaagtagtgtttaagaataatccatccgggcgtggtggctcacgcctataatcccagcactttgggaggctgacgagggcggatcacctgaggtcaggagtttgtgaccagcctggccaatatgttgaaaccctgtctttactaaaaatacaaaaatgagccaggtgtggtggcacacacctgtaatcccagctactcgggaggctgaggcagaagaatcgcctgaacctgggaggtggaggttgcagtgagccaagatcacgccaccgcactccagactgggcgacagagtgagactccgcctcaaaaaaaaaaaaataatccacttttgagttaggcttggggtccaattccagcctccctctattatgagctgtgtgaccttaattaagtacattaacttactgccggaaaagggtcccaatccagcccccgagacagtgttactgaacttcatgcagtaagaattcggggcaagtccacagagtcaagtgaaagcaactttattaagaaagtgaaggaagaaagaatggctactccacaggcagagcagccctgagggctgctggtcggctatttttatggttatttcttgattacacgctaaacgaagggtggattattcatgagttttcccggaaagatatgggaaattcccggaaactgaggactcctccccattttagagcacatacagtaacttcctcacgttgccatggcatttgtaaactgtcatggtgctggtgggtctcttagcatgctaatgtattttaattagtgtataatgagcagtgaggacgaccagaagtcacttttgtccccatcttggttttggtgggtttcggcgggcttctttatggcaacctgttttataagcaaggtctttgtgacctgtgtcttgtactgacctcctacctcatcctgtgacttagaatgccttaacctcctaggaatgcagcccaatagatctcaaccttatttcacccagaccctattcaagatggagtcgctctggttcaaatgcctctgacaaactgatctcaagttcctcgttcgtaaaccagggacacccccaccctcctctcggtgatggcccggatcactggagaagtgctatcttgtcccttcttgattgggactctaccagaactgctacttttgcttttctggccgctgctgacctcacttccctgagaagatgatcatttagcccctgtctgctttgctttgcctggggctcggctcctaagtgtcgatgtcagacgtcctcctggtagccatgaatccctccctgagcccgcagtatctccacacgcacactgggggccctgttccacagctcaaatatttccattttccttttatgttcaccttaagagggttaacagcttccattataacctcagactatgaatgaaccaggggactcctcgattaagctgatctgaaaagatggaaagaaatggcttgaaaacgttgtttccaagtagacggggcctacttattgaatgaaccactcaggttctgttaagtgtgagtcaatccagaaggatcttcgtgcaacattccaggatgtgatgctacctctgctgtacctgcactttccccagagtggcacccagggaggggggtcacgctcacgtgtaaggctcagagtaggcgtgtgaaggcttgcatctggaaggaagacagaccagaacaaagctgcctcctctcttttttttttttttgagatggagccttgctctgtcgcccaggctggagtgcaatggcgcgatctcagctcactgcaaccttcgcctctcaggttcaagcaattctcctgcctcagcctcccgagtagctgggactacaggcgctcaccaccacgctcagtttctgtatttttagtagagacgggatttcaccatgctggccaggctggtctaccaactcctgacctcgtgttccgcccacctcgcctcccaaagtgctgggattacaggcgtgagccactgcgccaagccgctgcctcctctctaattaatgaaacatttaccagacatttgtacacactacatccaagccaagagcaaatccttctggcttcacttcctaaataaacccagaccccggggagttgttgtttaatgggtataaaatttcggttttgtgagatgaaaggaatttggaggttggttgcacaatagtgtgaatgtacttgatgctactgaactgaacgcttcaaaatggtagacaggaaaattttgctgtagtttacatttaaaaaaaaaaatccacatacacacaaactcagacacagccatttcttacctccttcctgaaaggtcacaaaagccaagtaacaagcctccctgtccttatcccggcacttactcggcagccagagggaagcttctacaacaatgggtcttcaactttggggtctcagaacccctgtacaccaaaaagttactgagggacccaaatagcttttgtttaaatggattggtcagtcagttgattatccatccatccacccacctatctctatctatctatctatctatctatcagcatttatctatcatctatcagcatttatctatcatctatcagcatttatctatctatctatctatctatctatctatctatctatcagcatttactacactgaaaattaaaaccagtccaggagcagtgtctcatgcctgtaatcccagcgtgttgggaggctggccacacagatcacttgaggtcaggagtttgagaccagcctggccaacatggtgaaaccctcctgtctttactaaaaatacaaaaattagccgggtgtggtgacacgcacctgtagacccagcttctcgggcggctgaggcaggagaattgcttgaacctgggaggtgcaggttgcagtgagccaagattgtaccactgcactccagcctgggcgacagagcgagactgtctcaaaaaaaaaaaaaaaaaaaagcctgggagtggtggctcaagcctgtgatcctggcactttgggaggccaaggcaggcggatcacttgaa

SEQ ID NO: 12452 - DNA, 18248 bp, Human
aaatattttttgtagagatgaggtttcaccatgttgtctgggctggtcttgaactcctgggctcaagccttccacccaccttggcctcccaaagtgctgggattacaggcgtgagccatcacacccggccaacaaattggttttattatgagtagctagtaatacatgtaatttctcttttactttttaaaatattatgaaaaaatttaaatgtgcaaaataaagaagagtagtataataaactcccatgcaccaatcatctgcctggcccttatgtttcatccacaacccaacccacttacctgactccaggttattttaaaacaacttcaggcactatagcatctaattttcagtaatttaaaaaagagtgtataagaatgctttagagattacaaggcaaatgcttacacattatctttttccattctcataccctgttctttggcactttaccgaaaaggaaatgagaagggttcagagaaattaaatgacttttctttggtaacatgcctagtatacatgtagtcagaacttgaagcttttgcttttttttttttcttttttaacatcaactttcgtgcttagtccagtgtataacatcacaggcaaattcaaattgagaataggaatcagttgttctttaaccgtaacccttctaacttttacttatcctaagaccgggtagcaagtagggcaggagccttcatctagagggatggtgacagctctgataggggaaaattagcactggtctttccttccaaaaagccactctggctgctgctgttgacacaaggctcctggcttttgagacattatttgagtgctggattccaatactttttactttctcataagaaaaaaaaatgtgaagcatctaaggatatctcctgccttattgataaagtaagcctcaggctgaatccaaattgctgagctccaatagaactacagggcaaagcatctacacagggaattgccactcttctccaaaattaggctttattaagaggcaaggctatgttctcctcatatatatgtgtgtgtgtgtgtgtgtgtgtgtgtgtgtgtgtgtgtaaaaagtaaatgttttacacagatccccataagggaaaagtgggctatagtaatacagtatttttttgtttttcttttttttgggggggggggacagtttcgctctgtcacccagtctggagtacagtggcgcgatctcggttcactgcaaccgccgcctcccgggttcaagcgattctcctgcctcagcctcccgagtagctgggactacaggcaagcaccaccacgcccgggtgattttttttttttttatttttagtagagacgggtttcatcatgttggtcaggctggtctcgaactcctgacctcaaatgatccgcccgcctcggcctcccaatgtgctgggactacaggcgtgagccaccgcgccccgccaaatacagttttatcaggaatcaaaactgtgctctcttctggactctcagctttagctgtttggagcgtttagtctaagccttaccacttacattgtaatgtgaagatcaaattgtaacgacatggcaataataaggctcctattggttgggtaccaccagtttatgccaggcattgtactgattcatgtctttaatcctcaaaacgaccttccgaggtcagcgtttttattctttttccagaggagcaaactgagtttctgagaagtcacacccaacttggtggcagagctgacgctggcatggggttgactccaaagctctctacgccacgagggtgggaaagacaacgaaacacaagcgagaagaataatgagaactgggatcgcaacttcattaaatgagaagccaggaacaggtggcggagggcacgcggttcgctgcacggagtcgctcaggctctttgaaacaccgcgcgggggagcggggcggtgccggaagtcaggccatggcttccggttcttgcgtcggaagtggccggtcagcgtcgctgccggtctccggcggagacggactctggagtttgggcggcccgggcggccactaggtactctgatattccgtactaaacacgtctgcaagtcaagatgtcgcacccgtccccccaagccaagccctccaaccccagtaaccctcgagtcttctttgacgtggacatcggaggggagcgaggtgagcggagtctgacgctcgcggaaaagccccgaggaggcgggggttcccgggatttgggggattccaagggcggaatgcggctccggccggtgactgctcagtttcgcggaggggatggctgcctaggctggtccgccggagcaggcccggagatctagggctagatcgatccagcgcccttgtatcaatgccatcggtggtgcggaagtttctggaaatttctagttcgggaattgtggcgtcctttaggtttgcctcctgatttggtggcacttccacgccacctttgcactaccaagttagcatgaaatattttatgtttgcaatgggacagttcggaaagcatatcctgggatatgcgtctgctgggccccaggaaactatatttgccacatgagataatatatcagcacgtgctgtgttatttatacgttaaagggacttgtttgctcattgcttttgccttattactgattcttaatttagaggtccgttcagatgagcaaacattttctcttaatttgccattgggaaaatgcgctcaacgtagtgatggtgttgcctaggttacatagccgctcagaagttcctaaggcctggtgaattagggagcgtgttgctttgtaactggattggccttgttctggaacacgttggaattgctggccaggcaatgtgtttgaatgcatgtacaggacacacacacgtttacacgtacattcagtttgttgcaactagctagggctaggtttaatctcacctgtcttagctgctatctagaggaggaatttttacagcttttgcttcagaggttgcatgaggcagtttgctcagagcacaaaggctgcaggtatacgtaacacgtggcaagtccgcccacccaaagactgtttaattttctcccgttggttgcttggtgattggaaattctcagtacctcttgaagaaattactcaggatttaaaactatttgtatttaatgatatctcttacatggtgctaatcttttggctactataattggttatgatccttagtgtaatgtttcaaatctgtttatatacatacatgacagtaggtagactaaatttgaatattagaataaaataagattcactaattctagtgagtatattcaaaggaaatgaagtttgtatgtcaaagaggtatctgcactcccatgttcattgcagcattattcatgatagccaagataatggaatcaaactaggtttccatctacagatggattttttttaaaatttgatatatgtgcacagtggagtactattcacccataaaaaataatgaaatcttgtcacttctgacaacatgaattaatatggaggacattatgttacatgaaataagctgggcacaggaagacaaggcatgatctcacttacatgtggtttctaaaaagttgaccttgaagtagagaatggaatggtggatttcaggggttgggtagatgttgatcacgagagacctaatttcagttagaaagggggaataaatttaagagatctattgtataacataatgactatagttagtagcaatgtgttgtgttcttgaaattgcaaaaaagaaaaattacagtaaaggggaacttggtaattcatgattgatctgctaccataattataccaaccttctttttatcatttgtctatttggttgttttgcatactgacaagattttcttttcttttagttggtcgaattgtcttagaattgtttgcagatatcgtacccaaaactgcggaaaattttcgtgcactgtgtacaggagaaaaaggcattggacacacgactgggaaacctctccatttcaaaggatgcccttttcatcgaagtatgtgtaaattttcttaatcttgttattcttcatacagacaagtcctgttctttaggatttggggaagaaaacactaagtaggaagtgaagcttaaaaagtactattagcgtccatgtctgaggcagtaacgcagtttcgtaaaggttaggctgtgcgaggtggaattacttatggtactaaggtttatctatagagaaatggactcccctagctttacccatcctctcattctccttcactctaagatgatttgattgagaaaggaaggccgtagtcaaccaaccttaggtagcttcattgcctggtgacaaaaaagttatgcatagaccgggcgcagtggctcacgcctgtaatcccagcactttgggaggctgaggcgggtgaatcacgaggtcaggagatcgagaccatcttggctaacgcggtgaaaccccgtctctactaaaaatacaaaaaataagccgggtgtggtggtgggcgcctgtagtcccagctactcgggaggctgaggcagtagaatggcatgaactcagaaggtggagcttgcagtgagccgagatcacgccactgcactccatcctgggcgacagagtgagactctgcctcaaacaaacaaacaaacaaacaaacaaaaaaatgcataatttttgggcctgagtgcttgggaaggcagcagatttgaagattcagtgttttgggcacatgggtgatagtgtggtcaaaatatgccatttcatactgcttattacactttgtaatgaatcatacttttgtttagtgataatggttctcccaatagactgcaggctctatgagttcaagaactgtatgttttcaccattttgtttttggcatctaatacagttattgagtaagaactcagtaagtatttgtttaataaataggcaaataagcaataatcacaagagcaacattttttaaacgatttattaagaaaaaattaactttttaaaaatatttaaaatgtttactttcatgtttaataaaaacttgaaatatgctaataaactatatgcagaaaatatttaacatagcaagtgtgagactgctatctttagaaaggtctgcctgcaagagtagcacttgtttggagtctgggaacttgacacttgtaccatttcctaaatagtaatggtgatttactatgcctagcctatttgtacaaacatgaatgtgtgctctcttttggggagtctggaattttggtacatgctaggtagagtgtgcccaataaataccttgggtgctgagtctctaattggctctcctgggcagaaatactgtgtacatgttgctgcatttttgttgctgggggaagtgtgtgttctgtagcacttcatgggacggagaaagcataaggaagcctgcacatggatttttccagactctgcctgtgtctttcccgtcatctcgctgtgtatccttaccactgtgatccaaccacatactgatttgtgtgagctctagggttctctgaacatgaaagcaatcttggtaacctttgacacaaagtgatatatttgctgaaaattttccattagggtagaacaaatctactgggaatcattggtctgtattcagcagacattattgagtaactaatatgtactatgtgtacatgcacatagttataaggatgtaaaacaatacagttggtgtacttaaggagatcattgctggaaggggcagatcataatgccatatgttatgtaggcagagtcaagatactatgggagaaaaattaggacatacagcttagggatttcagtgacagttttataggggaggtatcatttgaaccgattttctgaatgttagcagggatcaggcagtgaaaataggttggattcagatggtgaaaagcctgaagcgtttggagttgcggagacgggtggggagggacaaacaggagagagacatgactagagtcatgcactacaaagttgtcttacgtacgtatccattagtaagcattgctaaaggcatccatgtctcagtcactaatagccattttccttttttgtagttattaagaaatttatgattcagggtggagacttctcaaatcagaatgggacaggtggagaaagtatttatggtgaaaaatttgaagatgaaaatttccattacaaggtaaagtagagaaaatgcatgttattgctgataaaaagattgttatatatctggaatacttgttggattaagacaccaaaaaatgtttcaagtgtgcttagattctccatttcttgtaataggaatcacttttgtaaataatggttctttaatatggaaaagttttcattcagtaatgattaattcagcattatttcattgtgatccagtttttatatgcttcagttaagccagtgagtttttaaatgcgaccagcatctggcaaaattgtttccaggaaaaatgtttccattgttggaaggatggtaacttgtgcatccttatccttgaatttgaagagcaacaaaaccatcactaatatccaggatgtcaggggatttgcacactagcagatatagttaaatgtccaagctcctaaaggacttcagtggtgcctgtgccttcttgtcttcgttgtcccaagatgtaattggggtatattgcatcattcaagttataagaatggacatgtaagtacaaaagtaaagtgatatttttggaaataaggaatatgagcaagggtattaggataatttgaaaaaatgtcgtcagtcttccagtcagtgtttattgagccactatcactggcaccaaagggtttataaaaatgaaaggccttgatgacaaggaatttataatcctacctcagagacaagattaagatacatgggactactggagaataatagtatataaataaatgctaaattgattgaatatccttgcttgtataacattgctaatactgtctatatactgcaggagaaagatgtgatttatgcagtctgaattattatggaagtcattgaggaggaatggctacttgggctgtgcagactgggtcttgcaaggcggcaacatgtctgagatttggttaggcaggaactgtagtattgatgcagaatttaaaaagggacgtcggtgaggaaagacaaaggcaagagacgttgaggaaataaagttctagttactgttgtaccaaaggaagctaccagaaggatgaaaactaaaggtgatgtgatgatcacattgacatagagaaaaggggcctatagacaagacacatgattcttgctttctataaacgtggtggccttaaaatctgaatttgatttagactgaggggagtaaaaggcattttggtggggtggggggtgtcatgaaacattatataacatgagagttacggtgcatgcaccaacaaggaatacatttagaaagcctaggagataaagtgaaaaggttaagaaattgggtttcatagatcctttgacaggattatgccaaggtagaattttgatttcaagatgtatgcagcagtttcttttgagcactctccgaagaggtgattcatctgggatgaaaacctaatccaaatcctgtatgatttggattcttttgagattaggaaagtaccaaactgaatgtcttgggtaaattcagtatcccattattgttccagtttattgatgttttgtaaaggaagacttatactgtaggcatatttatgaatttggaagaccgttcaggtcttcccagaaaaaaagagcattcatcataaagagggcaaaatatattacaagagtttcataatgctgcatcttcattttaaaggtgaagtgtaagtattttctcatggccaatttagaaataaccctccccccgactattgtttctgttacctatttactttgataaggttttttaaagtttaaagtgattaagtgccccatgttttgtgaattaaaggttgcagtttataaaaaaataaaaagtaattaaaaaattttataagtgaaaagtaaaaaaaagtagtttgatctaaatggtagtatagtgcaccccagttttatgttcagtaaaagaacagttcagactaacacacaattcagaaaagaacacatctaaccttggttttcttttaatttttatttctacagcatgatcgggagggtttactgagcatggcaaatgcaggccgcaacacaaacggttctcagttttttatcacaacagttccaactcctcatttggatgggaaacatgtggtgtttggccaagtaattaaaggaataggagtggcaaggatattggaaaatgtggaagtgaaaggtgaaaaacctgctaaagtaagtaaaaagttacagtgaaatacacttattatcttagttgctatctttttgagacggagtctcgatctgttccaggctggagtgcagtggtgcggtctcggctcactgcagcctctgtctcccaggttcaagctattctcctgcctcagccttctgagtagcagggattacaggcgcgcgctacaacacccggctaattttttctgtatttttaatagagacggggtttcaccatgttggccaggctggtctcaaactcctgaccttgtgatccgcccacctcggcctcccaaagtgctgggattacaggcatgagccaccgcacccagcctgttagttgctatcttaaagaaatataagtaaaaggatcaggtgattattagctggaaaaatgttataataattttgggtataggagccaggatctgccacttttttttttttttttttaacttttctacaatgggaaagacaattagggtagttttaaaggagatttttattatttcaactttcatttggtgatctttgctagtttacgttaagtcttcctatacctgcaaaactgttcagttggtatgtatagtagtacatagtggaatgaggataataagcccaaaatcttgtctggattgtagcattaactagaggcttggccttgactttgttacttaacttttccacacgtgttttctcctgtctaaattacttatgggtttagactagattatctctgaagacccttgtgtacttaatgtctgtgaatcaaaatgaccttaatattggctgggcatggtagctcatgcttgtaatcccagcactttgggaggctgaggtgggaggatcacttgagaccaggagttggaaaccagctttggcaacatagtgagatgctgtctctattaaaaaaaaaagaaaaaaagaaaaacccctaaacgaccataatactacccagcctaagtgacagggttgtgagtgggagttggaagctcagttacttgtaggaggtaggctgtcactcagtgtatgacaagaatagtagtaaaccggaagctcatgccccacctaatgccacttacatagacaatgataaaattgccaacttattctgtgtttattgagctcctgaatagcaataaaatgcttatgtaaatactaacattgtcgtattagttggaatgtataaaaacagcattatagtacataaatgagccttctcacataaatctgtgaattggacagtgctgcacatgacttcagctgtatagcttttatctctcattattacgatagtgcacttctacaatttagggttatttttacagttgtgcgttattgcagaatgtggagaattgaaggaaggagatgacgggggaatattcccaaaagatggctctggcgacagtcatccagatttccctgaggatgcggatatagatttaaaagatgtgagtactttcagattagtcaaactttaattaatttagtaagtgaaaatatttagtactaaaagtttgagcttttgtttcagtctctcatatgatagaatctagcattaaaccacattacttactaaaatccaacatatttgtatttttttatacaggtagataaaattttattaataacagaagacttaaaaaacattggaaatacttttttcaaatcccagaactgggagatggctattaaaaaatatgcagaagttttaaggtaatattatttctaacaaattatttttaagaaattataaattgaattataaactaaaattaagaattgctcattatatttttgcaaattacttgtggaataaccaggtgtgttgaaatagttgcatttccttttttttccctcagcttgttttgagaaatttcaaaagacagaagttgaacgagtagtacataattactcataagttttacttacattcaccaatttttaacttttgctgtttacgtttttacagaactattttgataggaagttgttgatactgtgatactttaccctaagtatttcagcacgtatttcctaagaaacaaagacattctgcataagttcaataccgttaaaacaccccaaagtaatattgatagataatatcaatccatatttaggctgggcatagtggctcatgcctataatcccagcactttgggaggccaagctgggcggatcacctgaggtcgggagttcgagaccagcctggccaatatggtgaaaccccatctctactaaaaatacaaaaattagctgggctggtggcgcacgcctgtaatcccagctacttgggaggctgaggcacaagaattacttgaacccaggaggtggaggttgcagcaagccgagattatgccactgcactccagcctgggcgacagagtgagattctgtctcaaaaaaaaaaaaaaaagtaatccatattccaacttccccagttgtttcaatttcttagaaaaatcaagggtccaaactaagattatgtgttatatttagtggtagtatctcttacgtttcctacctcccctggttttttattcatttgcatttttgtggagtccaagtcagttgtttttatagacttccatctgtatgtgtttgtttccttaagattagtttgaggtgaaatattttggcaagaagacttaggtgttgttttgtattacctatgatatcacatcctgaagacacatttcgctttggcctgtttgagttcacacacatggttaaagtagtgtcagccacaagcatttgttagtctgaggtggtatcgtgaaattgtatgaatttctagtccccaacaacttttcacacagtggatcttagcatcattgaaaatccatgcctgaatctgttatactgaacttctaagtttatcatcgtacagttattaactagcattcttctgtttgcgagagcctcccgcatattttttaagtatcactatagacctgtggatatttttcttttctttttttttccttttatagaaacaaggcctcctttatattgcccaggctggtctggaacttttgggcccaagcaatcctccctcctcaccttcccaagtagcagggactagaggatatcttatgggtagttttcaattccgtttgttagtacgctattattgtcattctttttcatgcccaaagggttccaaatttgttcagtggaaggcccctttcctttggcatgttcctattagtctgcgagcacttgcttgctctaagctcatcttgccttactttcagatctgatatggcagtttctccaaggacctctgatttcttttagagaaagaaaactttagaaaccaaattctgggggccaggtgtgctcagttttggggcccttttcagggacaatgcaaaatcaacacaatagagttctccttcatctttcctctactgaattcccttctcctattatgagaatcctggttccaaacataattatgttggaaagtacatagtggggacctgagttttaaaaatagaaaagtgttactagtgcataattagatttgggaattgctcttaaattggcctctttgaacactttggggaacaaaaacaattttttttaagccttcttaaaaattttaaaaagtgtgatcattaagattattaatagcatttttagagctttttatatcagaaatgacataacacttctggacatagagaagagtaattcctgtttatgtggtctttcatactgcttttattaatgcattctgcagatacgtggacagttcaaaggctgttattgagacagcagatagagccaagctgcaacctatagctttaagctgtgtactgaatattggtgcttgtaaactgaagatgtcaaattggcagggagcaattgacagttgtttagaggtaagtctgtttgattttgaactttttgaataagttggattaagacttagtttgaatagtagcaacttttatatacattaatatatcttattgcataggacctaatgaggcttaagaaaacattttgtttctaaatattttggaccctcagttctttctctacattcattttgcttataactctgtgtcacttaacagctatgaagatccttgcctttttttctcaaagcacatatatcagctcatgtattcacttaagagcacctattgtgtgttaggcattagaagacaaagtcagaaatgattaagatgtgggttatggagtcagtcaggcatggcttttttcttcttcttttttttttgagacggagtcttactctgttgcccaggctggagtgcagtggcgcaatctcggcttactgcaacctctgcctcccgggttcaagtgattctcctgcctcatcctcccaagtagctgggattacaggcatgtgccaccatgcccagataatttttgtatttttagtagagacagggtttcaccatgttggccaggctggtctcaaactcctgatctcaggtgatccacccgccttggcctcccaaagtgctaggattacaggtgtgagccaccgtgaagtagttatagagagttatataacacaatgtaaggcatttagtgtagtgcctggcacattttaagcacctaacagagacgagttattttaattaaaagatccataccctcaagaagcttaataagtgattcaggataggagggggtcagtttcaatttaggttcatcaggacttgtgtatggagaatgggttctattggaacaggtcatttatctttaggaggtcatccaggtatgctaactgataaagctagaaaggtggcagttttaccttcctcaaatagagcaattatgactctcttccctgttgtatagtttgaaaagttttccaaatgaaactttaagaattttacatattaagccaggcacctagactagctatgctcagagcaagtagaactaaaatgagatcctaattttgtagggtagatggaataagggataggaatatatttagaagggatcatacaacagaggaaaaaacttatcaaaagaaaagatgggtcttcactctgggtttttttttgttctctgtcacccatgctggagtgcagtgatgcaatcaaagctcactgcagcctcaacctcctgggctcgggtgatcctcctacctcagcctcctaagtagctgggactacaggcccttgccaccatacccagctgatttttaaattttttgtagagatgggtttttgacgtgttgcccaggctggtctcttaactcctgggctcaagctgtccacccgccttggcctcacaaagtgctggtattatagttaagagcctctctgcccagcctcgatctctttttgacctgtgaggcaggtaaaatctgagtattggccattaaaagatgttacataaacaaaagataattttaaaatgtttgttctaggggagagacctgatgcataaagtctcttaggttaaaagacctgttgtaggtaagaacctaggttgggtatggtggttcatgcctgtaattccagcacttagggaggccacggcggcgggcagatcgcttaattccaggagtttgaaaccagcctgggcaacatggtgaaaccctgtctctaaaaaaaaaaaaaaattagtctggtgtggtggcacatacctgtagtcccagctacttggaggctgaggtgggaggagcacttgagcctggggggttgaggcagcagtgagctgtgatcaggccactgcactccagcctgggccacagagtgagaccttgtcttaaaaaaacaaaaaacaaaaacttaagagtttataacttaagagttattaagttattaatgttcctaaaaaacttataattcaagtaaaaagtgtatacaaatgtttcttcaaaatgattttatcttaaaagtgttagttcaggcccattcgggagattgaaaccacagtggggagcatattggaaactagagaaatgtctttctcctccatgtccattcagtgccctctgctgacaaaacttagtgcccactggcagaggagagctatttgcatgtttcagctccattttcacagagcagtgaaggatgggtttggagttgataggcaatgaattgaaatctggcatataagcttaatactttgatataaatactagctttatacttttttgtaggctcttgaactagacccatcaaataccaaagcattgtaccgcagagctcaaggatggcaaggattaaaagaatatgatcaagcattggtaaattttgttccaaatgtttaattttttaaaatagacaactacctttataaatcatacacctaacttaaatgtttttttccaattaaaggctgatcttaagaaagctcaggggatagcaccagaagataaaggtaagttggcagcttttgtagtgaaagttaattttgttatttaaatacttatcctcaggaaccattgttcactttgccagattttagatgtttgttcaacagacactacagaatgcctgctgttgggccaggcattatcatatagcaatgaacaagacagtcaaagtccctgccctcaaagagcttacattctactcccattcaagaatatagtagtttttcacgttatttattcttcaagttatcatctctgtagttttttatatgtctaaatactgtttgtcttatggtatcctttgagactgtgttcctattctggttagtctagtcgagagctcagcattgtaagacacagtattcatggtaaatttaacatttgggaccattcaagttgaatgtggctataaccttagtattgatgtactggttatatgttttaggaaactatgacaaaaataagcttgtttttcaaataaaccaactatgaatagtgacactagatctgggtattacaaaatgtctttggtctcttattactaaaatgaaacaagggaagcaattactgttctctaatgtagaggcagaaggcaaatcttgatgtacttgagttctctcagttgacatcctctaaaattacgtttcatttctgtgtttgtgtgattgctcagattttctgttactagggcttagttactttgtagagaagttttttcaaggggtagttaacattaaaatagtttgttagtcaccataattttttggatattttgagaaataactcacattgcatatttattttacagctatccaggcagaattgctgaaagtcaaacaaaagataaaggcacagaaagataaagagaaggcagtatatgcaaaaatgtttgcttagaaaggattcagttttgcttattgtgtgttgattgtataaatgcaataagaaaatgtaaaggtttttgtctatgaatatgatccctaatgtgtttcttttgacaccttagttccttactgtttacagtttaggagtactgataggggttcatgcttaataaacatgtcacaatacagtaagtaaagtggttttgtttgtttctttgagatggagtcttgctctgtcacccaggctggagtgcggtggcgcaatctcggctcactgcatcctctgcctcccgggttcaagcaattctcctgcctcagcttcccaagtagctgggattacaggcacgtgccaccacgcccagctaatttttgtatttttagtagagatggggtttcaccatattggtcacgtcacgttggtcttgaactcctgaccttgtgatccaccccgccttggcctcccaaagtgctgggattacaggtgtgagccaccgtgcccggccaagtaaaatgttttttaaaatggttatgtgcattattcataaaaaataatggtgtccagtctttttaaacttgtaaagacacatcttattgaataaagagatgagagcttaagtttgtatattgtttccttcgattctttgatgtatccatggtggatgatgctaggttttcatacttatagataatacacacacacacacacacacaaacttgttcagggatgggcatacttcttctgcaagggccagatcataaagtttttaggctttgtagaccatgtaatgtcacacccactcacctgcacagttgtaattcaaaattagccatagacaatgtgtaaccaatgggtatggctgtgtttcaataaaactttagtctagaatatatattcatttttatatttgattacttaactttggcaagtcaaatgtaaagtccagtagtgaattttgctcttggtactgaatctctgaagaactgaagaggtaggaagatgctgcattcttataaaggttatttaaaagcaatacccgtaatttctttatgggacaatcttacatatagtataaaatttttatttgataatcattttgtgactattctgttcagtaatatgcagaaagacattctgaaatctgttaatctctaaacattttaacgttagcttgccatacttgaaagaaactggctagctgcagtttacattccattgtaagcaggtcctcctccaccttcaggtaccacccagttaatattctgacttggatctttaatatcacatgttttacaatgtacacagttctgagcatttatctgtaaccgaaatccatcaccttgttccacaggtacaaattcataaactcctgaaaagtaaaaataaataatattgaagtgcctaactttaaaaaatttttaaattcaaaagtaaaaattaaggaaagagtagccacagaaaccttaaaggttgctttctgaatgcttacccatagagattatgaagaccttggtgcattgctattgatgtgagtgtaaattacatgtacataataaaaggaggtacagcggtattcagctgagttgtctcactatcaagggtactcgacactgagtgtttgagttccacacaacctcgaagtcctcccttattcacagtcatcctctcattcacaggggacaagttccaagatccccagtagacgcctgaaacctcaggtagtactcaacttagattgtcagtcagaacacgtttctgttcatgtatttcacccacaaatgtgatgccttttccatcttaaggaagcacttgccacactctggccataacttctacagttcgaggtccaacagcaaaacgcacaaatttctttttcctctttcacagaagatacagtcttaccatagaccttagcaacctcagcataggatttttttctctttatagagaactttctcctttcacttaaaggaagcactttatggcatctctgaattgtcagcatcactactcttgcgttgtggggatatttctaaagggttactggacacaagtatgataatgtgacagtaaatctgataacttagatggctaccaagtaacataacgaatgttaggtgtgaatatgctggacaaagggataattcacattcagggtggggcaagcccgaatggtacacaatttaaaacttaacgtgcacaatttaagactcaagaattatttgtttctggaattttcttattttcagaccgtgggtgactgggggtaagaggagcctaacggtacagctaaaaaaccaaatttaacctcagggagttttcaacccactgtaatgacaaaagccaaaagaccaagtcacagtgtatcttcttttgtgaatgtactacttttcgagtatcggaatactattttgttctaccatatcatttgagacctggttcctattactgtaatttcagttgaaagctcagcactgaaagaatattcatggtgaatttaaagtttcagagcattccttggactgaatgtaatcataatgtgctgttctagtacatgcacccaaatacatacagatgagctgccatgacagaaatgactttaaatagtcacat

SEQ ID NO: 12453 - DNA, 112219 bp, Human
  misc_feature (1)...(112219): n = A,T,C or G
acgtgcagggtctatttataagaagaggtagctatgcggtcaagttcagggtgggttcggtggaatcagaccaaccagcagctcaagcagagtttaacgctgcaaatctgtgccacgttcttcttcctgcgtgcaatttgcaggcaaggacatctgcttaattgggtgtgaaacccgggccttgattaaaaggactttatgaggccgcagccttgcatttccaaggtcaggccctagtggagagggcgcgcgttccgcggggagacacgaacttttcctgagtgcgcgttccttgctggccctgaacccctcggccaggcagggcttggcagggccgtttcctgtcctaaccaggatcaagggattgcgcggcttgctggtgaagcttggcagggccgtgacctgtcctaaccaggctcaggggatggcaggggcctgctggtgtcgcatatgttttgcattccagctcaggattttgcagagcatagggagcgggtgtcacccccggggggaaatgccacccacaaaatgcaggtggaggctgggcgaggctggcagccaggggccagaaatccaaagcctgagccaggttcagacttcctgactccccctccccgttagctgtggaaggatggctcggcctggtccccctaaaaatgtgtccgttctgacttagaggccgctttggctctcggaaagcccccctgacctgcggactgagggactggagaccccctccaatcgcagaatcgctgagatccctcaaaacaaaggcgtttgcagtttgaccccttgctgctcaaactgtggtcggcgaaccggcagcctgggccgccctggtcgcgggtcaggggcgcagcgtccaggccgtgccaggcccgcaagttaagcactgtctgcatttccctggggaaaggggtgaccaaatatctagctatatttgcatttcaaatccacacggatatgggttttaaatataagtatgtccaactattgcctgagccacacttaagccaggaaaaaaaaatctttggggtttctgaaattgaaatgcctctgcacaattctttatagggttgtcgccggggtgtttgaaacagtgaccaatcaagtttcacgcactacatttggtcgggcgatctctcaaatctgtctttccctagttttttaaaggaatgtttatttgtaaagaattctagatccacaggaagctgcaaagaaacgcacagggtcgagcccgcccttccccgccccttccaagtagaaatctagaatcaccagagtcctacagcaaaaccaggacgctgaactcatcccgaagacccggcagcccctcttggggatccgccctcattccaaattctctcaggtcccaaacaagcacccgcaggagtactgaactttttggggggagggcagaggggatctgtatgcagattgccagctgagcaatcctattttctatgacttaaagccaatcagaggctgggcgtggtggcttatacctgtagtcccagcactttgggagaacgaggcaggcggttcacttgtgctcaggagttccagaccagcctggccaacatggtgaaaccctgtctctactgagaaaatacaaaaattagccgggctaatccgagcccctctcttcaccaaacgccagtttcactttttagttttgaacttcacttctgctgagctacgccctccctgtccccgggccccctcgcctccccatcttccgggcttgggtgcagcgacgcgggtggcccgccagtgcgtccccgaggagaagtcagcctgggtcccaccccaggggtgccccgggcgcggagggggcgtgggcacctccccagcgccgcacgcccgggtctccggctcctgggctgggtcggggcgggggcggacgcgcgcgcgaaggcgacgccccccagccccgcggccgggttagggcggggagaggcgcggtcacgcccaggcggcttccgcccgccccaacagcgcgcacgcggctaccgagctggaggaggcggcgggcgcgagacccggaatgcgcagggcccccgcctcgccccccccagcccgggccgcggcccccgccttccccgcagtcgtcccgcactcggtgcccgccccccgaggccggcggctgctcccactcggggccgttgctgcttgtgccgtgagcgccgcccagccattgtccccgtcgctccgtcagccgcgccggaccgcgcaccaggaggcgagagcgcgcatggggagcctctgttgatgccgccgccgcgccgccctccgaggctgcgtcccgggaagcccggctccccgagcgctccggcctggcccggtgccccggacctgagtgcgtccccatggaggcgcccgggctggcccaggcggccgcggcggagagcgactcccgcaaggtggcggaggagacccccgacggggcgcccgcgctctgccccagccctgaggcgctgtcgccggagccgcctgtgtacagcctgcaggactttgacacgctggccaccgtgggtgagtgagtgcgggcggggactcggcccacaggggcgcgcggcgtggccgggacgttgtagtaggacaaagggccctgggtgccgacctcctggggagggccctgacccgctacttcggctcggagtccccgtgcggggctgcacctgcgccccgggtcttcccgggtggagcgcactccccagccccccagcccaggcaagtacccccgaccggccgggtgcctaacctgaaatgccgacggctcctctcggagaccaccctccacccccagcacacacagcactctggggcctgggccgtccgacgtcacaaaacctcctgcgggtcacctcgcctgggggacctcgtgctccctccctggcagcggccccagggacactggcgcggggtgcgaagacccctgcaggcctcccctaggccagcctccctgtgtgcccagaggcagggaatgtacagatttctccaggggctgcaggagcagctgggctgtgggggacaggtgtcccggggcgctgtggggacgaggacggcagcgctggggacggatcctaacatgtcctgacaccgcctgtgctcttcgtcttgtgcctctgaaatgggtaattcttgtatcggacgctttatccgtttcctttgtcctctgtctttgaacttaaccccgaatgggcagcttgacagagaggtttcgagttctcggtgctcttgcatccggacacgcgctgctttatggagcagccctgagtgggtcagaatatcccaactgaacgtgggcgctggatttaaacagttgtcatcggcccgcctgtgccacttagggactccgtatggctaagtggggtgttggctgtcaagaaaataaatgggagagtagagggggctgtcctgggtgtgttggtgaggcgtcggctctcaggccctctaactcctgtttgtcctcattttggaaaggaggaagctgggctgggaagcccaagggctcgaggccatagcttatgacttaggaagaccagcgggcatagccagtggggcctttagaaccgctgaggaagaggggacttagcttccttcagtgacctctttgccacttagaccttgaggaagggcccacgaggaaagcctgaatttggaaggacagagtgggaggaggccctctctctttctcctctccctccctcctcctctttatctcattctctctctcttttctctgtttctcttctctctccctctttctgtctctgttcaagtctctctgcatttctcctcctctgtctcttggtgtctctctccctgtccccttccggtcttggtttttctgtctccctccctcctctctctctgccttcccccttgtcttggtccccccggaaagctgtcctggtctaatcttagagctgggtgtgttttgcgcggaagaagggtggggcaggaaccctgactggcgcagccgccacagtaggtggaaatacaactcgacaatggaaaattgatgaggtccagccgttccttggcactcagcaccagcgtttgtcattctttggggcacccacatgggtcccttgggaaaggtggagctggggctggaggccggggcagagagcaggatgcgggcaggagggcggcagaggtgaggggttctggtgtcacagggggccactcagtttgacgtcaagtcagcttagggtgcccagcgggtaacctcatctttaaaaatagagtgtcgctgcctctggggaccaagctggctgggcggggagtcagctttttttttcagtccagtcagtgctctcttaatgaggatgaggatgatgctcctttctcaaggataacttcctgtgagctccaacgatgtgacaggagggctaggtatcccacactcattggacagcaggggaccaggacccaggggtgtgtgtgtgtatgtttgcatgcacgtctggaacactctctcatgacaactgcacagctttggtgacattatctgcaaccttttatccaagcccgtttctttattgttggttaaagagcaatctgagtgtgattcacctaaaataatacattttataaaatcctaagccttttagatccttcacgattgtgtctctaagccacaatctacagcagctttggactgttttccaaggcgtgatggagaatagtgaggggtgagcttgagtctcagtctggagttgaaacccagtctgggtgggtgtgacctctcttcatcctaaactgtcactacaggaacataagtttgcttttaagtgctctttcgccctcattccgaattctctcaggccccaaacaagcacccgcaggagtactgaactttttggggggtgggcagaggggatctgtatgcagattgccagctgagcaatcctattttctatgacttaaagccaatcacaggctgggcgtggtggctcatacctgtagtcccagcactttgggaggccgaggcaggcggatcacttgtgctcaggagttccagaccagcctggccaacatggtgaaaccctgtctctactgagaaaatacaaaaattagccgggcgtggtggcgggcgcctgtaatcccagcttctcaggaggctgaggcagaggaattgcttgcacccaggaggcagaggttgcagtaagccaagatcacaccactgcgctccagcctgggcgacagagagaaaaagaaacttgtcagcgttctagattgaccagttttcctcaaggtcaggtagttaggaagaaagagtgcagtttgcagttgtgaaaagtctgataatggattctttttttcttttttatgcgtgaagggattctggagtacgtctggtctaaaggccgatttcgttttaggaactttggatcagaacagtcatactagtcctcagagaaaaaatggttttcaatctggttcttcaaatttcttgttcatataaccaagccatgcttgttcctatgatggagaacaattgtgctttaaaaaaagaaatttcagggccaggtacagtggtgcgtgcctgtagtcccagctatttgggaggtcgcggtgggaggatgacttgaggccgggagttccagaccagcctgggcaatatagtgagaccctcatctcttaaaaaaaatagtagtaatagttagctgggcatggtggcgcatacctgagttacctgggaagctgaggcaagaggatcacttgagcccaggaggtcaaggctgcagtcaaccacaatcgcgccaccgtactccagcctgggtgatagagcgagatcctctctataaaaaataaaataagaaaatgatattatggaaatgaaaaactcaccctatgtagagagaagaggatgaatctgtgcagccatctaccagccttattttaccaatttcctacttaaaatgaccacttgagaattcctttctctatatatcagataaaaaatacttgggttttttcccagaagtgtccttatggaatcatttggcatctacaacccagtgcttgcttgtcatgggtaccccaagtgttaacctgtcaggaaggaggtaattcaacaggtaaaccagtggccaggccttgggtccacatttcattttccttttctcagcctagttctgcatttactcatctacagagggaaataatgacggaacctgtcctacacgatgacgatgaggaagactccaaagttcctagacccctattaaaaatatatattttttgaaatacagactcacaggggatttcaaaaacagtacctggagtctcatggacccttcagccaacttccccatggtgacgtcttcatatccgtgggacaatatcagaaccatgtcatcgatgttggtatatccttattaaagagaacacatacctcgttcagcttttttttttttttttttttgagacagggtctcactctgttgcccagtctggagtgcagtggtgcgatctcggctcactccagccttgaactcctgggctcaagcaatcctcctgccttggcctcccaaagtgctgggactatatacaggcatgagccatcgtgcccggcttgttcaggctttattagttttcaaaaggtgctcatttgtgtttgcgagtgtgtgtgtagagttctgtgcagttttacccagtgtgtggatttggcagctaccaccctccaaaccatggtgcaggatgaattccctcaccacagaacacccctcggtcttgctcgacactttttttttttttttgagacagagtttcactcttgttgcccagcctggagtgtattgaccacaacctctgcttcccgggttcaagcgattctcctgcctcagcctcccgaggagctgggattacaggcatgtgccaccatgcctggctaattttatatttttagtagagatggggtttctccatgttgattaggctggtctcaaactcctgacctcaggcgatccgcccgccttggcctcccaaagaggtgggattgcaggtgtgagccaccgtgcctggccagacactttttttttttttaaactttcacacactatacaatctgaaaatattttattttcttaagagctaggagatcttcataattaatgatacatggttctcagatctaaagtgcttatactggtaggttttctcttgtccttggttctcctgaattggccagaatttcctttcctctccttgttgctgggttcttattaatgcctcaagttagtcggttcaggcagttgtagcaaaacaccaccgactgggtggcttataaaccacagacatttattcacagttcagaggctggaggtccaagatgaaggcatggcagatttggtgtctggtggggacctgcttcctggttcatagatggtgccttctcgctgtgtcctcacatggtggaaggggtgagggagctctctggggcccctttataagggcagtgatcccattcatgaggctccaacctcacgacctcatcacctccctagggcctcacctcctgacaccattaccttgcaggtgaggatttcaacacaggaattttagggggacacagacattgagtccacggcatccccaccctgtctgtcacacagcatgctgccgggacgaatggcatctgaactggtgagattctactgtgtgcataaatcagcagccttgtgggcagtgttgacatagcaattaggagtgttgtttgtagcctaacaatacacagaaagtggagctcagccctttgatcttatttaccttatgtgggtgctccgtgtgagacaggctcatgcatgtgtgaatgacagtttcctttaagtgcatcacgcaaatgccaagagatgagatcaaatattacacatcagagaacatttccaaggatagaagtcctgccggtttctcctcttcattgtttatttcattttatttttttaatttaagttaaaatacatgttaaattaaatttaagttaaattaagatacatgtgcaggacttattttaaataaaagagacagggtctcgctgtgttgcccaggctagacttgaacccctgggctcaagcattctgcctgcctccgctgctggcacataaatgccaagtgtgcagggacctctgtgtgttggagccactttcatctcccacatccaaagaacagacccggcacttagtgtgtgcccaagaccatccaccgcatgaatagagaaatcaaccctcctcatgtgcctggggtttcctgaggtgggaaaccttcagtgctagctgggagagtcgcaggcagagacagggacaagctggtcactctgtgtgtgaataaataaatgaatggatgatggcattatcggcagttgttctttatgacactcactgatgccaagtactggacgggtacaatatgtacattagtttctctatgggcagaagctccaccatgacaacattagtgttattttctttttgcttttttgtttagagacagggtcttactctgtcgcccaggctggggtgccgtggtgcaatcaacagctcactgcagcctcgacctcccaggctcaagcaatcttcccacctcagtctcccaagtagctgggactgcagacgtgcaccaccacactcagctaatttatgtatttatttttgtagagatgggcattgctatgttgcccaggctggtctcgagctcctgggctcaagtgatcctcccgcctcagcctcccacgtagctgggactacaggtgcatccaccatgcttgtagccttattttcttaatgggaaagagggtctgagagaagggatgctgtgtgcccaatgggtttcgcctgcagcacgctgcctcctccccgggaaagcagggcgtgcacattgggattggacgacaaaagcagagtcatctacagttcatgggcacgctgcaaagaagggagacgttaaactctcgaaagcagcagacaccccccaccaggaagagacatacttgtaaaaatcaaaggagggcgaaggcatgagaatcgcttgagcccaggaggttgaggttgcagtgggctgagatcgtgctactgcattccagcctgggtgacagagaccttgtctcaaaaaataaaaattcaagggaggccaggtgtggaggctcacgcctgtacccagcactttgggactctgaggtgggaggatcacttgagcccaagagctcaagatctgtctggacaatatagcactaccccatcgctacaaaaaaaaatttttttaagtagctgggtgtgatggaatgcacctgtagtcccagctactagggaggctgaggcaggaggattgcttgagcccaggaggtggagactgcactgagccatgatggtgccactgtgttccagcctgggcaacagagcaagaccctatgtcaaaaataaagaaagtatcaagggagatgagtacacagtgcctggcacactgtagggtctccaaaaagtaaaccttttctatccatcagtttcctcttctctccagcatgaaatcgcatatgtaaagttgaaaaaaagagtgagagatatatcttaaaaaggtagtaatgttgatgacattgtggttttttttttttttttaaagaaaaaccggccgggtgcggtggctcatgcctgtaatcccagcactttgggaggctgaggcaggcgggtcatgaagtgtcaggagatcgagaccatcctggctaacacggtgaaaccccgtctctactaaaaatacaaaaaaaaattagccgggtgtggtggcgggcgcctgttagtcccagctgctggggaggctgaggcagcggaatggcatgaacccgggaggtggagcttgcagtgagccgagatcacaccactgcactccagcctgggcgacagagcaagactctgtctcaaaaaaaaaaaaagaaaagaaaaaccttgggggaaatacagaggaagccctaaggcatcccttccaaaaagctgaaagtgctttacttagaattgtgacctcgttttccctgttagaaaagtctgtggttagaagcttcctggtaagcccagtgtgagaaggtggaaccgatgtttctgtgtgacgggttccctctgcctgtttctccaggtggcctccccgtggtcctctactgtggtgggtccagtcccaaaaccaagtctggggccaccatcatcatatttgtgtcccccaccccaagattcttatgtcaaaaccctaatccccaaggtaatggtgttaggaggtggggcttttaggaggtgatggggtcactagggtggggtctcatgaatgggatcaatgtccttataaaagggaccccagagagctccctcaccccttccactatatgaggacacagtgagatggcaccgtctgttaattagaaagccggtccccaccaaactctgaatctcccataccttcatcttggacttgtagcctccaggactgacagcggtaaatgtctgttgtttctaagccccagtctgccgtgttttgtgatggcagccgaaatggatttagatggggctctattcaccccacgcggcagggtccatggaaaggcagctgcaatgcgctggtctatcattacctcttttatgctctttcacactgtcttagtcttgcgtggctgctggaatgaaggaccgcaaatatagtagcttaaaaccacatacagtgaagagatacctgcactcccaggttcactgcagcacgagtcacacaacagccaagatagggcaacaacccacttgcccgtcagcagatgactgggtgaagaaaatgtggtctctacacaatggagtactattcagcctgtaaaaagaataaagtcctgtcatttgcaacaatgtagatgcaactggaggtcattatgctctgagaaatgagccaggcacagagagacaaatacggcattatctcactccttttttttttggacagggtctcactcggacacccaggctggagtgcagtgacgtggtgtcactgcagcattgacgtcccaggctcaagggatcctctcacctcagcctcctgaggagctgggactgcaggtgtgcatcaccacgccaggctattgttttgatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacaaccagagtcactcttgtcaccatcttggtttgggtgggatttggccagcttctttaccgcaacctgttttatcagcaagctccttatgaccggcatcttgtgctgacctcctatctcatcccgtgacttagaatgccttaaccatctgggcatgcagcccaacaggcttcagcttcattttacccagctcctcttcaagatggagttgctctggttcagatgccgctgacagaactagcttatggttggagacaatgtcatagggaattattcttcaaagatcgcaaaatccagcttggatgagattccaaaaatcaaaaggtgctgagaaagcaacttgtctagaatttcctcttcatgggctggttgattttgtttacaatgacaccttcagaaaaagtaggcgacacacagtggctcacgcctataatcctagtgctttgggaggtcaaggagggagaatcatttgaggctagcagttctagactagcctggacaacatagtgagaccttgtctttacaaaaaataaaatcagccgtgtgtggtggcgcatacctataatcccagctgttcaggaggctgaggcaggaggatcatttgagcccaggagttggaggctgcagtgagctatgatggcgccactgcactccagccttagtgacagagcaacattctgaaagaaaagaaagaaaagaaaaaaagaaaaggaaataaaagatgaagaaagaaaacagaagaaaaaaataatttatatagaaaaaaagtccataatgactcaaaatattccctggacactggaatagaatgattttgtttattaaagcttttctttagttcgtccttaaacagtttagtattttcttttgaaaacagattgtgtcttgtcaacttcattgattttcgggctgggcttggtggctgaacacctgtaatcccccaacactttgggaggttgaggtgggtggagcgcttgaggccaggggttcgagactagcctctagcctcggcaacatggtgaaaacctgtctctacaaacaacaacaacaacaacaacaaacaattagctgggcgtggtggcacgtgcctgtagtcccagcaacttgggaggccgaggtgggaggatcacttgagcccaagaggtcgaggtcgaagtgagctatgattgcaccattgtactccagcctgggtgacagagtgagaccatgaaagaaaagaaagaaaagaaaaaagagaaagaagaaggaaaaaaaaagagaagaaaaaagtaaaagaaaaacatagaaaaaaaatcagtaacgactcaaaatattccctggatagttgaatacaaatagttgttgttggacgtgattttatgtattaaggcttttgtttagtttatccttaaataggttaggattttattttgagaatagattctggtttatcaatttcatcagtctttgcaaagaaacagcttagggtttcctttatgtttctccgttaacttcctgttttcagttacattgcgttttgctctggtttttctttcgttttttccactcgttttaggtttctggaatttcctgaaacattgtattttgatacagattctgagctggtgctttggctgtcacaagccagagggtcctagaagaagtagaattgtaaccgaggaaaactgttaggaaactccatcccttttgaccttcaaaggtcaccgcctaattttggtgttttgtagtctgatgtgttcatagcttgtgactattaggctctgattgagctctgcttttttttaagtttctcttactcagctggtgctgttttagctccagcttcctcctctgtgtaatcaacactcccagtctcctcttcacccaaaaagccacagaaataagtgcagaaaacaaggcagccgccacctgctacagaggcatgtccttaaatacgatgcatttcaggacagctgtgtgagttccgggagcttgtcttccttcaaagggaaaagtaaaaataaacaggaaggttgcactgaaagcattctcaattgaaattgtgccatttggctgtagtgtttctgatgctcatttagaactttggaagttgtgggatggtgggcaagtgtgtgacctgggatggagattctctacctctttaagagtgaaaccctggctgggcgccgtggctcactcctgtcatcccagcactttgggaggccaaggcgggtggatcacctgaggtcaggagtttgagaccatcctggccataatggtgaaaccccgtctctactaaaaatacaaaaaaatagctgggcgtggtggcaggtgcttgtaatcccagctacttgggaggctgacgtgagagaatcacttgaacccggcaggcggtggttgcagtgagctgagattgtgccactgcactccagcctgggtgacagagtgagactccacctcaaaaaaagaaaagaaaaagaaaaactttaaaaaatgccgggcacggtggctcccgcctgtaatcccagcactttgggaggctgaggtgggtggattgcctgagcttaggagtttgagaccagcctgggcaacatggtgaaaccccgtctctcctaaaatgcaaaaaattagccgggcgtagtggtgcacgcctgtagtcccagctgcttgggaagctgaggcaggagaattgcttgaacctgggaggcagagattgcagtgaaccgagatggtgccgctgtactccagcctgggcgacagagtgacactctgtctcaaaaaaaaaaataaaataaaaattagctgggcgtggtggcacacatctgtgacagagcgagactccatctcaaaaaaaaaaaaaaaagaattttggaagttgtgggatggtgggcgagtgtgtggtctgggatagattctccacctctctaaaagtgaaaacctggttgggtggggtggctcacatctgtaatcccagcactttgggaagctgaggtgggcggatcacttgaagtcaggagtttgagaccagcctggccaacatggtgaaactctgtctctaccaaaactacaaaaattagccgggtgtgtggtggcgggcatctgtaatcccagctactcgggaggctgagacacgaaaatcgcttcaacccggaaggcggaggttgcagtgagccgagatcacaccactgtgtatgccactgcactccagcctgagcggcagtgagaccctgtctcaaaaaatacacacacacacaaaaacaaaaaacaaaacacatgtagaaaaaaccacaaagacaaaaacaaaacaacaacaacaacaacaaaaagtgaaaacctacttctttttctggacacggtggctcatgcctgtaattgcaccattttgggaggccgaggtgggaggatcactctcacctttcaaggcccaggagttcgagaccagcctgggcaacacagcaaaaccccatctctctaaaaataaaaaagagaaaaagagaaaaattgcttctttctatgtagttggtgagttttttcagtaggatgctttgcatttcttcctgcgtctgtggctctgtggtatgccagcatatacgatagtcactacaagatccgtagttgtacacccagccatacgcatcacaggtttttggctgatttcatgacaacgcttaaggctgctgaaaacactctaattctttggatgttggcaaatgttcagatgaaactaagcggctggcccacccacctgctcaggaaagaatggccgcattgtgtgggaaaggaatcctctgttccctagctggctgcctggtgttcttgttgagtgagcagaacagagagtgcccctgggtagacctgtgtgtgctccaaaaggcgattttgtcaattgttcccttgggatgcccttgttccagaaagcatgttctgtgtgactctcagctggggttcccagactgtgtaaagaaaacatggtgattcatggctgtgtgcggttgcccatgcctgtcatcccagcattttgcgcggccgaggcgggaggactgcttgagcctgggaggtcaacgccagcctaggcaacacagtaagaacctgtctctacaaaaacaaaacaaaaaaagtgtagccgggcatggcgacgagcacctgtggtcccagctactcaggaggctgacgcaggacgatcgcctgagcctggaagttggaactgcagtgagccataatcacaccactctactccagcctgggtgacagagtgagaccgcatcttaaaaaaaaaagaaaaaaaaaaggacattgtgattaatgaaaacaaacattgcctggtgataaggaaagtaagaagtaggattgttctcagattagtgacccaggagataaaggagtaacagagtgtgcaggaagcaggtctccaatttaatagcaggatggtgaagatagagcaagtgacttctttctattttttttagaaactgggtgttgctttgtcacccaggctggagtgcagtggcgtaatcatagctgactgcagccttcacctcctgggctcaagcagtcctcgtgccgcaccttcccgagtagctgagactacaggcacataccaccatacttggttaattttttgtatttttagtagacatgggggtgtggggatggtttgccgtattatccaagctggtctcagacttctggcctcaaataatcctcctgcctcggcctcccaaagtgttgggattacaggcatgagccactgtgcctggtgagtaggtagctttttgtttgtctgtttgtttgttctgtttgtttgtttttgagacagtctcgctctgtcgcccaggctggagtgcagtgatgcaatcttggctcaccccaacctccacctcccgggttcaagtgattctcgtgcctcagcctctcaagtaggtgggattacaggcacatgccaccatgcttggctattttttgtttttttagtagggacagagttttgccttgttggccaggctggtctcaaactcctgacctcaagtgatccgcctccctcggcctcccaaagagctgggattacagttgtgagccaccgtgtccagccaaacaaaaaaaagtctgtcttataaagaagatccctaatttatgatgattccatttatgatggtttgagttatggtagtttgagttaggatagttcgattgaagattttttgattttacgatggtgagaaagacacagtccgtggaacccgggcttcgagtacccatgcaactgttctgtttttaacttgcagtgcagtattcagtaaattacatgaggcattcaatacttgattgtaaactaggcttcacgttaggtgattttgcccagttgtaggctaatgtaaatgttgcgagcacgtttagggcaggctgggctaagctgtgatgttcgtaagttaggtgtattcgatgcatttttgacttaccatattttcaacttacaaagggtttatggggtgtaatgtcatcattgtaagttgaggagtgtctgtatcatagactggggggcttaaacagacatttattgctcccagttctggaggctgggagtcacagatcaaggcgtggcacattcggtgtctggtgagggcttcctggttcatagacggcgccttctcactgtgtcctcacatggtggaaagggtgagggagctctctagggtccctttaataaggacattgatcccattcatgaggctccaccctcatgacctcaacacctcccaaaggccccacctgctaacatcatcatcttggggatgaggattcaacacgggaattttgggaggatgcaagctttcaccagtagggttttctttgtaaagaaatagaaggaaatgaaaaggcaggcactgggtaggagagagctacagaagacagcggggtggtggcactccaggatagtgctgtcccccagcatcatttacaccgaagaaacctgaggcagtctttctgatgtgtcattcttaggaaaaccaccatgaatctggcatctagctatcagtgaaactgtgggagagcttaatggaagtaaagacatgtggtcccagaaatgacagatcattcggagaacctaagagaggattaaaagcaaaagggggtcatgtgcgctgtgactcaaactttgggaggtcgagtgggaagattgcttgagcccagaagtttgagaccagcctgggcaacatagggagaccctatctctacaaaaaatacaaaaattagctgagtgtggtggcacacaccttagtcccagctactcaggagtctgaggtgggaggattgcttgagcctgggagttcaaggctgcactgagctaagattgcgccactgcactccagcctgggcgacagaacaagatcctgtctcaaaaacaaaaacaaaagcaaaacaaaacaagaaaatccaaaagggaaatataagagaaaacaaaaaatctcactttgagacatcttttttgaagagttggagaggatattgtctccatccacaaaaataggatgttacaataaaagagaaagaggaaggaagagctttatatgggactgctgaaagttaaaagaaaaacattgcattaaataaattagaagggtgatctcatctgtgcctgtgacttcagttatcatcttaaggctttgggtctcaaagcacacatctagtttagacctttcttaggagccctgaagggtgcattgccaactactgcccgttggagggtccatttttcccaagatatccagcaacactcttatatgagtgtcctgctccattgtctcaaattaccataaactggggaacgcaagcaacagaaatttatgctctcccaggcctggacaccaggagtctgaaatcaaagtgcaggcaggattgtgctccctctggaggctctgggggaggaagcttcctgcctctcccggctcctgggggctccaggcatccctgggcttgtggccacagcactccagtctctgcctctgtctccacgtggccttctcatctgtgcctgtgtctcctcttctgtctcttagaagtacactggtcattggatttagggcccacccttttccagcgcgatctcatctcaagatccctagcttaatcacgtttgcaaagttccttatttccaaataagttcccattccaggttctggacatgaggatgtgaatatatctttgtggggaccacagttcagtctactagagttgtatgcagttccttctggaggctctaggggaggatcctttctgcatctcccagctcctgggggctccaggcatccctgggcttgtggctgtatcactccagtctgcctccgtctccatgtggccttctcctctgtgtctgtgtctcctcatctggctctttatttttttaaattatttatttatttatttattttttattttttttggtgacggagtttcgctcttttgcccaggctggagtgcagtggcatcatctcggctcactgtaacctctgcctcccgggttcaaatgattctcctgcctcagcctcctcagtagctgggattataggcacccgacaccacgcctggcttattttttatgtttttagtggagacgggatttcaccatgttggccaggctggtctcgaactcctgtcctcaggtgatccgcccgccttggcctcccaaagtgctgggattacaggtgtgagccaccatgctcactggccattttttattattactcttttttcctcttctgtctcttagaaggacacccgttgttggatttaggtcccaccctaaatccaggatggccttatctggagattgtttacttaatagaaactacaaagaccctattttcttttcttttttttttttttttttttgagacggagtctccctctgttgtccaggctggagtgcagtggcgcaatctcggctcactgcaagctccacctcccgggttcacgccattctcctgcctcagcctcccaagtagctgggactacaggcacccgccaccacacccggctaatttttttttgtatttttagtagagacgcggtttcacctcgttagccaggatggtctctatctcctgacctcgtgatccgtccgcctcggcctcccaaagtgctgggattacaggcgtgagccaccgcgcccggcctcaaaaaccctattttcaaataagacgccattcacaggcaccaggggttaggatgtagacatatttttggggggcaccattcaacctagtctatccctcaatctcaatacatcccctgggttaaacatgaaatgtgtccccttcttcccccaaatcaaagcaacccaaaagacccctgtgcacctgcacaccttgcctaagtcggcagcactcactgcgtagatgcccaaaccctaagctgtgatcatctccaccctccctcttgcagcctaattgagcccattctctgcccaagcaccttatgaacaggactttaaccctccatctccaccaccttcccattttcactggaaattttacttcttaaagaggccttccctgaccccttgaccaaggttagatgcatcccaatgttctcctatggatatgttgtttgaagtcctcaagtctgaacaaactcatgtgaggtcacccaagttgttagacttactgtcattaatgcttcctgccctccttccagcccgactggaactaaacaaaactaaatgagggaccaaccttgtgttgttcattgcagtttctcggaggtagacagcacctgagacccaggaaaatatcaatcatgatggaagtgatgcattcatttattatattgactccttttttttcccaaaagctattttgtgttcaaaacctggactgcataaaccacttcattgtggttatggagtgttagaagccgacacctaatcaaagaattcagtgtgtctcagtggtaggaactctaaagccatctaacattaaatgcaataaaagttcagttgcttacgacctggcgccgtggctcacgcctgtaatcccagcactttgggaggctgaggcgggtggaccacgaggtcaggagattgagaccatcctggctaacgtggtgaaactctgtctctactagaaatacaaaaaattagccaggcgtggtggtgggtgcctgtagtcccagctactcaggaggctgaggcaggagaatggcgtgaacctgggagacggagcttgcagtgagctgagatcgcgccactgcactccagcctgggtgacagagcgagactccgtctcaaaaaaaaaaaaaaaaaagttcagttgcttactctccatagcctcaattcaaatcctcagtagccacttgtgagcttgtggctaccattttggacagtgcagatagagaacattcctatcattgcaggcgatactacgggcagtgcttgctccaaaacagggggtctcaactgggggccggccttcccccacagggcacttgacagtgtctggggacagttgtggttgtcactactgggggtggatgctgatggcgtgtggtgagtggagcccagggacgccgctctgcaggtttgcagtgcacaggatggccctacagagaatcatccagcctcaaatgtcggcagtgctaggctgagagaacctgctttagcgtgagagtcagtctctctctttctgtctctctctctctctccccctctctcccctccccactctcgctctccctccctcccccctccacccatcccatctgttatctacctacctacctacctatcaattatctaaccatcctaattatctatgtatcacctatctatcctatctgttacctatctacctacccacctacccatccatccatccatccaatcaattaatcagtgtatcatctttctctttccatgtatgtatcatacccattgtccatccatccatccatccatccagtcagtcattcaatcaatcaatcaatcatctttctatctatccatctatctgtctatcatacccatctacctatctttctatctgtctgtggcagagattctctgccaatggcaattcagctccatcagggagatacttcttccctggacaagtctggagacatttttgttgtcacagctcaggtaggtgctactgataacaggtgggtggagtccagggtcactgcttgccaccttacagtgcacaggatggccccaccacagagaatcatccagctccaaatgttaatggactcagtttgagaagctgatctcaagggtaattcgggggagtcctgcgggattgttgcatcctattgaaggggaaattaatgaattttgtaagtgtaatggggcggggggactgggttaagagagaatactaactgcttatccctcctctatgcccagagaggcttatctgtgttccatcgttttacattccttgaggcacggcgagttcttgcttccctccctagtgcagctgtaaagtcacaaggttgacaagcaattgctgcaaaagtatgtattcccaagaatgtaagacgtacggtgtaacaaatgcaaaagagtaattaactgcctttgttctcgcttctgcaagtatgctttctgcagcacgtaactcccgccacaaactgcttaaaaggtgattgatccctctgtacggggctcagactttctagaccctagtccgactgagctggtgatcaccttaataattataattataatggtcatctcctaactgtgctcggtctctaccgtctctgatttatcccgcaacactatcgtggaggtaggctaggatgtatctttaacctggctggattgtattgtagatgtgtgaaaaccagcccttgtttttcttggtagagttgcactcaaatgttattgaaagctgcacatactgtgcttgtataaatacactgagccagaaatcacgaacctttccctggcttcacatctgttagtgttgtgggagaagatgagaatttcttgtttttcttttcacttctgtgattatacattttgtattttgttgttgttttttgggacagggtctcgctctgtcacctaggctggagtgcagtggtgtgatcatagctcactgcaacccccgcccccaggctcaagtgatcctcctgcctcagcctcccaagtagctgggactatagtcgcatgccaccatgcctggctgttttttgtgtttttagtagagatggggttttgctttgttgtctagcctggtcttgaactcctgtgctcaagtgatccgcccaccttggcttcccaactgtggggattacaggtgtgagccactactcacggccacattttgtatttctgatgagaaagtgtaatttaatacactgtacatcggagagtgtagttctgaaacatctgcatcttttaaattaggacagtgtaaaaatggaatgttgtttgactcagcaaaattttgagggagtttgtttccaactgtctagaccagtgaactcaccaaactatctaccacacactgcttggctgaattggctctactgtttttaactgaagtttgaagtaaatattccaagcttaaaaatatatcttgttcctcccccacccactggttatagcagcaatataaataaaaaataccttcccaagaatatccaaagcatacattcttttctaaagtaaacattgtttatagagatacaatttctataccataagattcaccctttaaaaacacatagttctttagttttcagtttattcacagagtaagcacactgttttttgtttgttttgtttttttcgagacagagtcttgctctgtcacgcaggctggagtgcagtggtgccatctcggctcactgcaagctctgcctcccgggttcacgccatcctcctgccccagcctcccgagtagctgggactacaggcttccgccaccacactcggctaattttttgtatttttagtggagacagggtttcaccgtgttagccaggatggtctcgatctcctgaccttgtgatccgcccgccttggcctcccaaagtgttgggattacaggtgtgagccaccgcgcccagcccattcattcattttttgagacagagtcttgctctctcacccaagttagagcacaggggtgcgatcactactcactgctgtcttgaactcctgggctcaagtgatcctcctgcctcagcttcccaggtaacttggactgcaggtgtgtaaccaccacgccctgctaattttttgatcttttaatagagacggggtctcgttatgttacccaggctggtctaggactcctgaactgatgtccttccgtggcctcccaaagttctgggattataggcacgagccaccatgcctggcaacacacactcttttttaaaaatactttttaacagctttttttcctgtctataaaatagaaggtcattatacttgtttgcagcagtaattccaaaaatcgacttcgtaaagaagaactgcgtgtttcacacacttatttcctccatggtagcatttaatgttcttttattgattttacccaggggggaaaatgtcaaggaaaagaactgagtttgaggatgataaatgtgtacgttctgatatcattattttgaaacaattatttaatgcaatgcgtcggtttcacttatcaatttaacataaattgaacctatgttgatgaactatttctatagtcataaattttaaaaggtgagaaagttatatagtgaaatgcatctgtttttgtgcctcacctgtgcagaatttgccctctccttccacccaggtgcccatattaatgtgtcttgtatatttctccaaagtcctttctcaatatagaagcaaattatcacttatggagaagagcctcactttttttttttttttttaaacagatgggggtcccgctcttttgcccaggctggaatgcagtggtactatcataattcactgcagcctccaactcccgggctcaagcaattctcccatctctgcctcatgagtagctgggactactggagcataccaccacacccggctcattaaaaaaaattttttttttttatagatggtgtctggctatgttgcccaggctagtctcgatctcctgggctcaagtgatccttctgcttcagccttctaaagtgctgggattacaggcatgagccactgctcctggcctccacccatctataggtgtggaacaagagcatgttccctcccaagctaatgtggcaggtaactggcctcccaggctgtagacaagatggatgggggctgtgcccacttcttgagttaaccttttttttttctttggagacagagtctcgctctgtcgcccaggctggaatgcagtggtgtgatcttggctcactgcagcctccgcttcccaggtttaagcaattctcctgcctcagcctcctgagtagctggggttacaggtgcctgccaccatgcccggctaatcgttgtatttttagtagagatggggtttcaccatgttggctgggctggtctcgaactcttggcctcagatcatccacctgcctcggcctcccaaagtgctgggattacaggcgtgagccagcgcgcccagctgggttttaccttttttgtttgtttgttttttgagacagagtcttgctctgtcgcccaggctggagtgcagtggtgtgatcttgcctcattgtagtctctgcctcctgggttcaagcaattctcctgcctcagcctcccaagtagctgggattacaggcatgtgctgtcacgcccagccaattttttgtatttttagtagagatggggttttcccatgttggccaggatggggttttaccttttttgaagtgtattttccatgtagccacctctcttggagtgtccatgaggaacacgatgctgtccttggtgtctcagcggagccactgtgacgctctcctcttgcaaagatttctggtcatgatgtctcaacattggcctgtttggggttttttttctcctgcattttagggagaattagggctcatccaccctcaccttctctcccccattgaattggtgcatcctgtttttttttagcccctgggatgcccatgttcaagattccttaagcatcacagtttaaggaaagaaatgcagattatttaaaatatgtggggtgagtgtgcagggtggtgatggacaatgcatgtgtttaattcagggactgttgtgccagctgtgtttgagccttaggaattcttatagttgactggcatttacagtttattaaggcacttacctcttaggtgtataatcctcaaaacatctaaaaaattagtgatttttgttatccaagttactttgacatcagccatttgctgtctcacccacatgatttctcattatgttaccttattattggctaagttaatctgcttactgaggacctgcatgtgacttttcccattaaaagtaagttaagtctgggcgcagtggctcatgcctgtaattctagcactttgggaggctgaggtgggaggatcccttgactttgagaccagcctgggtgaaaaagtgagatctcaaaaacaaaattagccagacatggtggcgcatgcctgtagtaccagctacttgggaggctgaggtgggctgatggcttgagcccaggagtttatgctgcagtgagccgagattgcatcactgcactctagcctgtggcacagagtgagacctgtctcttaaaaaaaattaattaattaattaaaaataaataaaagtaagtccaagtggagatggttggtggtgttggttggataacattgtgaatgtatttaacaccgttaatctgtacacttcaaaatggttaattaagatggtaaattttatgttgtgcgtattttaccataattaaaaaatagatttggtctgcgtgatggctcacgcctgtgatcccagcactttgggaggcgaggtgggcggatcacctgaggtcaggagttggagaccagcctggccaacatggtgaaaccccgtgtctactaaaactacaagaattagtcgggcgtagtggcaggcacctgtaatcccagctactctggaggctgaggcagaaaaatcgcttgaacccaggaggtggaggttgcagtgagctgagatcgcgccactgaactccagcctgggtgacagaatgagactctgtctcaaaaaaaaaaaaagatttaaaacaaagtaactatgttcaaggccaggtgtagtggctcacgcttgcaattctgacactttggggcgctgaggtggaagattgcttgaagccaggagttcaagaccagcctgggcaacagagtgagaccccatgtccaaaaaaaaaaaaaaaatcatcagctttcattctgggatcgtaagtagagacattgtttcccagacctggtacagatggaacctgcctacgtgtcttcaatgggcatcttaagacttatgttttggacatatcagacttttggaataaaggagctgagttgggagtacaaactcctcttcttatccatttccctgtggcaggagattttgctctcagcccccacttactggtgtgagatccttgattctggaaggtgagctgtgctgttcagcccacaggtcctcatgaatgtctacattcagtgccacgcagaataagaagaaacacacaccagctctgcttctgtgaagcttactttttgttgttgttgttgagagggggtcttgctctgtctcccaggctggagtgcagtggtgcagtcatggcactcattgcagcctctacctcctgggctcaagagatcctccctgctcagcctcctgcgtaactgggaccacagatgtgcgccaccatgcccagctaatttttaaattttttgtagagacagggtttcaccatgttgcctgggctggtcttggacgcctgggctccagtgatccacctgccttggccttccaaagtgctgggattacagacatgcgccaccgagcctggttttgcttactttttctttttttttttaaattcctcttagcctatcttgggggaggcgggtcagtgttattccggtgtacatacaacaaaatcacccatttgaagtgcacactgggaggagtccttgccaaatggatagggctgggtaaccactgccacatgggacatttgggaagccgatgtttgaatgttttcacgcttacagatgcattcatttactacgtttattattctgtgtgatgtgctttctgtgtgttatttcacttaaacccagtgggggtaaagattatgatccctatttggtagatgaattttagagaggttagggggcttgtcaaggtcacacagcttttaaccgtgatgggatgacgcctcttgaatgaggcttagtagtgagatggctgaggaaggaaaaaagtaggaaggagagaaagagagaaggagggaaggaagaaagtagggagaaaggaaggaaaggagagggaaggaagggagaaaggaggatggaaagatggaatgagaggaaagaaggaaggaaaccgatgaaagaaggagggaagggctgaaggaaggaacaggtgccctgttcaggtgggtttatcctcaggaaggacccaagatggaaagtgtgtatgcaagaattattttaggccaggcgttgtggctcatgcgtgtaatcccagcactttgagaggctgaggcaggcgaatcacttgaggtcaggagtttgagaccagcctggccaacatggttaaaccccatctctactaaaaatacaaaaattagctggctgtggtggcacatgcctgtaatcccagctacttgggaggctgaggccggaggatcgcttgaacccaggaggtggaggttgcagtgagctgtgatcgtgccactacactccagtctgggccacagagcaggactctatctcacaaagtagaaataaataaaaaataaataaaaacagagatgaggacacagacgcacatagaggacgaccctgtgaggacacagggagaagatggcatcgacaagcctaggagagaggcctcaggaggaaccagccctgcccacacctgggtctccgacttccagcctccaggactgtgagagaagaaagttctctttaagtcctccagtctgtgttaggttattacagtagttcgagcaaagtactttatttacatagaagtctgccacaattatgagccctgaaaccctttcccaggatgaaccgaggtcagagtgtaattaataggtactttttttcatttacgtttagccactagattttttttttcaacagagagtagcgaatactgcagaagctgaatgagatgaagcttaagtcagatctttatgcacctcagaatatttgtactgatgaaaagaaataaccaacacttgatagagggaaagattgagacccagaaagtaatctctccctgtgaccactcctaccaaattcttgcttaactaccttattttgttcgtttgtttgtttttgtttttttgagacggagtctcgctctgttgcccaggctggagtgcagtggcgcaatcttggctcactgtaacctccacctcccgggttcaagcgattctcctgtctcagcctcctgagtagctgggattacaggagcgcgccactaccacccggctaatttttgtatttttagtagagacggggtttcaccatgttggtcaggctgatcttgaactcctgaccttgtgatccacctgccttggcctcccgaagtgctgggattacaggtgtgagccactgtgcctggccaactaccttgttttttttggatgaaaatgtggttcttacctcagtaaagattatgaagggatttatgtacagatgactaaaatatcagccattagtttcctatttgtttttgttgttgtcattttttgttttgagacagggtcttgctctgttgcccaggctggagtgcagtgatgcgatcttagctcactgcagcctcgacctcccaggctcaggcaatcctcccacctcagcctcccaagtagttgggacgacggctgtgcaccaccacacctgggtaattttttatttttatttttgtagctgggatctcgctatgttgcccaggcaggtcttgaactcccggcctcaagtgatcccaccatctaggcctcccaaagtgctggacttacaagcgtgagccaccctgcccagcctagtttacaatttgaacttggtttttcatctcggctcctttgaagacttctgtcttctcccatgtttggggcagctgtgtgttgtggacattccttagtgatcggcctgggaaggctcagacatgtctaggctgcctttgtaggaatagggattagtagctccttagccccactctttcctgggatgttgctgtttgctgaggtctgcacagttcagaccaccctggaagcctctctcaggttctcagagatggtggagttatacctttgaccgtgagctcgcagcattgctagggaatgtacttggctaaatttggaactatttggttgaatttgtaccccttgggcatatttgctttggtaacataccacagactgggtgccttaaaataacagaagttaattgtttcacagtcctggagaccacaactctgaagtgcagatgcggcagggctgtgctccctctgcgggctctaggggaggctccttcctgcctctcccagctcctgggggctccaggcgtccctgagcttgtggccgcatcactgcggtctctgcctccgtctccacatggccttctcctctgtgtctgtgtcttctcttcttctcttacaggaacacccgtcattgtgtttagggtccactccaattttggatgacctcaccttgagatctttaacttaattacatctgcaaagacccttttcccaaatgaggtctcatttacaggttctgtgggtcaggacatggacatatctttctgggagaccatagttcagtccactacagttgtatccagttgtttctggaggctccaggggaagctccttcctgcctctcccagctgctgggggctccaagtgtccctgggcttgtggccgcatcactgtactctctgcctctttctccacgtggccttcccctctgcgtctgtgtctccttattagttcaccactcatattgcaccaccttcaggatgacctcaccttaatatatacctttttttttatttcattttttaaaaaagtggagctgaggtcttgctgtgttgcccaggctggtctcaaactcctgtgctgggattacaggggtgagccactgtgcccagcctttgtgtatatcttaatcacatctgcaaagaccctgtttgcaactaaggtcccattcacaggtaccaaggattaggatgtcaacgtatcttttccagggcaccccattcaatgcacacaaagtggggagaggggagattggctgtgtttaggtgacctgtgaaaggccgagctagctgtgcggcgttgctcttgcagcacagaggaagaactgggctcagatggtgtcagctgttggtgtctgagatcatccgtgaatctactcccgggaatgtgctgcagtgagacacggtccttctcccgtcaccttcctgaccccatcccatatacccacggaccccaagggaaagtactcagggttggttggtttcttttccgttttgtgaccgcgtgaaattccatgtcacggtccctgtgtttattccatacagctctcctgaagtgttttgagttctagcaaaatttaaaaatataaccaaagaaacttaaatccgtgtttctcctctttctggacacttctttagtatgaatgggcatcgtgatgataaacacggtggcctgctgtctttgcttctctctctgctggccgcctccttccttccctccaaagtcacaggcaagagggatttagggtttgctgggcttgaggaagagaggaaaaggccatctcttttcacagtgagaaatgtgttttctgttctttctcatacctcgctttgtacatttaaaaaaattatttctctttagatttttgaaccaagagagatatatttattatttaaaaaaaatttttttttgagacaaaatctccctctgttgcccaggctgcagtgcagtggtgcaatctcagctctctgcaacctcctgctccctggttcaagacattctcatgcctttggagtagctgggattacaggtacccgccaccatgcctggctaatttttttgtatttttagtagaggctggggtctcactgtgttgtccaggctgatctcaaactcctgggctcaagcgatcctcccatgttggcctcccaaagcactgggattacaggtgtgagctactgtgcccggcctatttcttttctaaatagaggcagggtctcactatgttgccctggctggtctcaacctcctgggctcaagcaatcctcctgcttcggcctcttgagcagttgggactccaggtgcacacaaccatgcctggctaatttttgtattttttcgtagagatagggatctcaccatgttgcccaggctggtcgggaattcctgggctcaagcagtcctctgacctcagccttccagtgtgctgggattacaggtgtgcaccactgtgcctggccttatttattttttatttatttatttttggagacagggtttcattctgttgcccagactgcagtgcggtggcaaccatagctcactgcagcctccacctcctgggctcaagtgatcctcccacttcagcctccccagtagctgggactgcaggagtgcatcatgactcctggctaatttcttttaatagggatgagatctctatgtttttgtagacaaggggctctcgctgtgttgcccaagctggtcgagaactcctggcctgaagccatcctcttgccttggcctcccaaagtgctgggattacagttgcgagctacggtgcctggctgtagattccccccagcccccaagccgccagttgtgagtcttcactaacaagggaacctttcagcattttccatggtcatggtgattcacctaatattttagttctgctgagttgtctaaacattcgggataaaggctgtcattttttggtgaccgtaatgtgtatgtgtatgtttacagttacacatgcctgtatttgggtggagctcagaagatgcccatggcatttttctgggaaagttgaagtttatgatgtttgctctttattgggagtgtggaggtcgtctttctccttcttcccatccctccagacagaaagctgggatgtggccaggtgcagtggctcatgcctgtactcctagcactttgggaggccgaggtgggtggatcacttgaggtcaggagtttgagaccagcctggccaacatggtgaaaccctgtcactactaaaaatacaaaaattagccaggcggggtggcgggcaccggtaatcccagctactttggaggctgaggcaggagaatcgcttgaacccaggaggcagaggttgcagtgaactgagattgcgccattgcactccagcctgggcgacagagtgagactctgtaacaacaacaacaacaacaacaacaacaacaacaggccaggatgtgtttgtgtgtgagttggacccaagggcttgggaaggatggatagggtaggggaggagggatagatggatgagggaatgcagagagagtggccacactgtcagaggctttcaaaaagcaggaggttctccagtgggagagaggagacctgagtccaccccgcattaatgtttacagatcagaattgcacacatagaatggctcataaatctgatccaccttcctcgtctggcacttggctggagaaacaactctttgaatgttggaggaaaagcccactgtattgcacctgctataaaaagggcgtgcccaccttaaaagtagccacaccttcccgagattgccatggtccttctaagtctctgaaatgtatagatcaggtatatttgggaatttggggatttttctaaatttgggatgagaatgggtgcatgtcctttttaattatacaacaccctcagcagagtctgggctggatgttgttatcaagacaagaatatttctgtagtgaaataggtagatattcaccccaaggaggatcaagcctgaacagtctcacgttaggcaaggtccagttttgcggccaggtgtgttgatgaagacactttgagtattcagagcctttagctttagccactgtgggtaagggattgtagaacccatacttaagctttccccttaaagctttgactttaatctccacattgcagccctgcaaaagaacagaatcgtgtcctttgcagcaaagtggatgcagctggaggctgctatcctaaacaaattcatgcaaaaaatcgagagccagatattgcatgttctcacttataagtgggatctaaacactgagtacttcatggacacaaagatgggaacaataaacactggggattccaaaaagaggaagggagggagtggggaaaagactgaaaaacttcctattagaaactgtttactacttgggcaacgggatcattagaagccgaaacctcagcatcatgcaatatacccatgtaatgaacctgcacatggaccccctgaatctaaaattaaaagaaaagacataaactccacatctgatttccctcgtgcataacactactacttagcttggagagagatggaggggatctctagggtggggaatggaccacttaccttcaagatctcccttatcaggaaggaaagagctgacctgcctagaaacacttgaaaacactctttttttatgtcttattgggcaaagctgggtcagatggccacccttagctgcagagaaggctacaaatagacattttctcctcaagtgggataatgataactggggaatgtgtactggagagccttccaacaccaagcggggaagatctaccagcaccattaaatgttgcctttgtcttctgtgcacttaagctgataaaccttaaacattacagcatgccacttctgtctgctttgaataaggttgtttaccgacatacttctgcagtctgattgtggcgttggcgggactgacaatatctcccagggtagcgcaaagatccgctgcagtgcataagtaacgtgttttgagttttgtatgtttataatgcacacagctcagagaaagctttaaagaagtcacagaagtgtaaaaaatctgttgagtcatagctgttgttcttaaagtaggcatggagaattctctctgttgagggtcaaatacaagtactaagacagaatgttatgcagtaaacacagccaagtaatgaatgggttccttggggtgggtgatagagaaagataaataaggaggaaggaaccagatagaggaagaaaagtcaaggaccatattcattgcattattagaattttagggtgtggcaagaatttaatgtttcctaataatatgcaagttctgttggaaagaagagcaacaggagactaaaaggttaaaaggttactctgttgcccatttcataggtccaatggcaggataagcttgggttggatgccagtgttcctgattcctaattgtgttttatccaattgaaacatcagtggccatagtcaaacacctaaactgtatcagttcacagtcctcaaagcccttctcccacttcctgtctttgacctgattccacctaattttgtccacaccatgttgtactgtaataaaacctattttatttccaaattaactaagagaatatactttaaaaatgtgttactatttcattatttgtttactttttttaaagaaatatttaacacctgtcagctattgacattgtttccttcttacactttttctttatcttgtagttcactttctatttctgccataataaaatattcagtatcggaaacttcacttaaaaagcaaaggttacttctcctcctcccttcccagtctgccctataagctagtaaattcatcattcattagcttagatattttacaacatggggattttagtttacagcaaatactctaagtaaaattggtagcttaagtacaactttttcttttcacgttaccatgtgcaatcaatggcattccagactcttggaaggaaatccattgtatggttgtggtctttttttttccttctcaaaccagtcaaaaatacccagtcacaatttaaaaaattatccgcccttggtggtgcacgcctgtagtcccaactatttgggctgaggtgggagggtcacttgagcctggcaggtcaaggctgcagtgagctattgattgtgccattgcacttcagcctgggcaacagagagagaccctgtctcaaaaaaaaaaaaaaaaaaagacaaaacaatataatgtgatctaccctctaagcaaattttcatatatacaattttactattgtatatgtgagctatttatatataaaatttcatttatcagttcagtattgttaactatatgaactaggtgtatggtagatctccatggtttatcttgttcaactaaaactttgtatcctttgaccaatatatttccccttccccctcaagccctaccctctgataactacctctctactctctgcttctatgagtttgactattgtagattctgcattagtccattctcatgctgttaatgaagacatacctgagactggttaatttataaaggaaagaggtttaatggactcacagttccacatggctgcggaggttccgacagtcatggcagaaggtaaaaggaggagcaaagtcacgtcttacatgacagcaggcaagaagagagcccgagcagggaaactcccatttattaaaacatctgatctcgtgagacttattcactatcaggaggacagcatgggaaaacccacccccatgattcagttacctcccacctggtctctcccacaacacgtggggattatgggagccacacttcaagattagacttgggtggggacacagccaagccatgtcagattccttgtataagtgagatcatgcaatatttaatatttgtttttctgtgcctatcttatttcactgaacataatggcctccagttccatccatgttgctgcaaatgccagagtttccttcttttttagggctgaatggtattccatcgtgtatatgtaccatgttttctttatccatttgcccttggacggacactgaggttgtttccacgccttggctgttgtgaatagtgctgtcataaacatgggagtgcaggtgtctggaagatcctggttctcttgggttttgcaatctagcataaagcaggcacaggagtaccagccaatgaatggataggtaaatggatcaatattgatcggtgagatttgctcgtcaacagatgttggttcctcagaaggatacacttccaaaccatcctttctctgaatgtcagtttctgagaagcctctctgctgtttggggtgggtgtgatcacataatacgggagggcagttttgttttagttgctcatctctgtctgcagctgtgaatgcgttgtttaaaaatattgctgaggaatgacttgcatgtcagtaaggggctgctgacgctgggatcaaggtacgtcaaaggcaatttagggatactctagaaatcctgcatcagttgcagtggctcatgcctgtagtcccagcactttgggaggccgaagcaggaggatcacttgagcccaggagttcaaggctagcctgagcaacgcagtgtgaccccctctttacaaaaagtacaaaaattaactgggtaggctgaggcgggaagattgcttgagcccaggaggtagaggctacagtgagctgtgatggcgccactgcactattcgttccattaacccaagaacatttatgctacgtgaagaatatttcaatatgtgcgtgaacacgtgcacaccttgtaggatcagtgtgttacaggaagaggaggaggatgaagaggaagaagaggagagggaggaggagaaaggaggaggaggaacaagcaaagcttgtttagagattttgattttcttttatatctcattgactattagatttcttcatttacatgcaccccagtgggaggaagaggagggagaggaggaggagatggaggaggaggaagaagtggaaaagaaaaggatgtagaggagaaggaagagatgaaagagaaggaggagaagattgaggaagagaaaaaagagaaggaagagatggaggaggggaaggaggagaagagagtgtttggattgaaaatgtcccagcagaatacagtagagctattggttttcttttatatttgtagtggttgcagttgttgttgttgttttgttttctgtttgtgggcacctatatagcacttcatcccaacccacgccagattgtagaatacggactccgtactttgagcaagccttaatgtgcgttaaggaaacagccgtgttgaggagggctgtgtgttttacaccctgtctgtatttctgataaaaccagagagcctgaagagaaaaaggcatgttatataaatacatttactattactctaatgcttctccatgtgggtgtgtggggcgtgtgggtgtgctgtgtgcgaagactgatctgcagaaattatggccagtttgtccccaaattgaggaaccattcagaggcagatggctctctctgtctccctctctctccctctttctctctctgcaatttctgtattcagtggaaaattccaggtgagcgcctctcactaaatgccatcagcccacgtgcaccatgacacaaagtctctgaaagtttcacttggggtctgtgtttgccgtcctggtgcagccccccgctgattgcatggctgtggtggtttcttcctttgtcggaagacttaatgacctctgtcgatttcttctctctccaggcactgggacgttcgggcgggtgcacctggtgaaggagaagacagccaagcatttcttcgccctcaaggtgatgagcattcccgacgtcatccgcctaaagcaggagcaacacgtacacaatgagaagtctgtcctgaaggaagtcagccacccgttcctcatcaggctgtgagtcccctcctgaagcctctccccacgcactctccctagacccctgtgtgtctcttcttataagaagctgggtgggccgagaccatggcctgcgtgcaaagccttaggccacagcagtctccacctgtcaggtcttatcagcctctgatcttagagctggaatacctccagggctcctgacctccatggctgaccaggtccaaaaagaaacgctctgtgttcagaagtccgtgcccaaggccccttgctcctctcctgggtgaaccaagtatctctgcccggaaaaggatgcagaaatctttgtctcctcacctccttgggttctgcatctatagctctcggcagaactggttaagttggtttttaagggaccacagtcacgtggacggggctgggcttcaggtttcgttgggtttctggttgactgtggatgagagataccccgttgagatgcagcccacacacttccagctgatggtacacaacagtcttatgtcctagggtaggtgtgatagtccattcaggctgctataacaaaggatcttagactcggtaatttacaaatgacagacatttgcctcatggttctggaggctggaaagtccaagatcaagacacggtggattcagtgtctggcgaggacccgcttcctggttcatagatggcgccttttcactgtgtcctcacatggtggaaggggtgagggatctctctggggtcccttttataagggcactcgtcccattcatgagacttcaccctcatgacctcccaaaggacacaacacctaacaccatcaccttgggggtgaggatccaacatagggatttgggaggacacaagatattcagaccattccagcagggtaattccatttccacccagatgccttagacaaggatgtcctgcgtgtctctcctttccctccatgggtgccttccatccaattcccacgtcttccctccgccatcttgctaccatgcctctcctgtccacctatccatcttctgctttatctgggtcccgtctctctgccctgattttctgtactggcttccctcctacctggtctttctctcccagccttgctccccttgaagacattcctcactttatagcctcactggtcctcccaggtacctctgcaatgacctgcctctctcctttcatcctcagggtactcctgaagtatcccatataaagccccagcaatgcagcatcctcctaccagtatcctcgtggactggccccctgccaccacctccctacaggagaaggtagaaggtgctgttcacacactcattccggggcttctcccaggccacccttctttgacaggcctccttctttgctctcatcattgtccttcacttcccccatctaagaaacacctacctgttttccctcattcacctgctgtccccgggacacagggtgcctcccatcatgttcttgaagcacctcgtgtgtactggaacaagtgcacctgccttctcctctagacccaatgctgcctaagctccgaacaaaatcatatgcagaggatgggcgcggtggctcccttcctcccttcctttcttcctttctgcatttctctttctttcttgacagggtctcactccttcttgcccaggctggaattcagtggcacaatcatggcccactgcagcctctgccgcctcccaactagttgagactacaggtatatgccaccatgcctgaccaacttttaaaagtttttgtaggatgaagtcttgctgtgttgcccaggctggtctcaaactcctggcctgaagcagtcctccagcctcagcctcccaaagtgctgggattgcaggtgtcagcccctgcacctggactgagaatgcatgtctgttgtctgccgcgtccctccaccccaacccccagtttgtggtactttgttaatgatagccctgaggaactcacacacaccccctgcgcctcctggagcaggagagcagccgagacgatgggctcctgagtactctacagttcagaaatctaaaatcccacagaagaaccgcatggacatgggagtgggtggagtatacaagtgagagaattccccaggatggaattcttgagctcccgcaagttaaaaaatagggaggagcttgtagaacagagctttagttaggtagttctcctttcttcaaggcaggatagctcaagactgttttccttggcagataaggtgcattcctgcagggacgtggattctgattttgatattccctgctttcaattaaggaacaaagtcgtttatatttcttaagtcttatataaagccctagagactttagaaattctattcaaagttacctatgttggtttatttttatcttttatataaaaaagtatatatatagatttacatttagagacgggttttgctctgtggcccatcttggagtgcaacggtgcaatcacagctcactgcggccccaacctcccgggcttaagccatcctccttcctcagcctccagagtagccgggactacaggcacccatcactacaccctgctaatgtttttatttatttttaatttttaaaaaacatatgtatatatttttcacaacctctttggtgaagataatgtttttgttttttctctatgaacagggtcttgctatgttgcccaggctggtcttgaactttaggctgcaagcaatccacttgccttggcctcctgacatgctgggattacaggtgtgcaccaccacacctacctcattttaaaattttctgtagagatgggatcttactttgctgcccaggctagtctcaaactcctgggctcaaatgatcttcccacctcggcctcccaacatgctgagattatagatgtgagccaccgtgcctggcctatttctaacttttaaggagtgaaatttctctgcaccgtgacagcttttgaagaggacattttggatgcttcatgggttgtcctttgcccgtacagctcaccggctcctccgagtgctggttacagtcgaatgtgagctgttatttgtatgtcaggtccgcctggtggtgttgccaaaaagcatgaatttttcctcatcatttaaagtctacatggaatttaaggccactttcgatattattcttgggaggattttattcagtgttttgggagaacatggcaggggctcatttcagaattctctgatttggggccgagctcggtggctcacacctgtaatccctgcatttttggaggccaaggcggaaggatcacttgagaccaggagttccagaccagcctgggcaacatagtgagatctcgtctcttaagaaaaaaaattaaaaagaaaattctagcctggccaatatggggaaaccctgtctctactaaaaatacaaaaattagctgggcgtggtggcgcacgtctataacccagctacttgggaggctggggcactagaatctcttgagcctgggaggcagagcttgcagtgagccaagatcgtgccactgcactgcagcctgggtgacagagcaagactttgtctcaaaaaataataataaataaaaataaataaataaatacagttctttgattttgaaatagtgcagaaaacaaggcaggccctgaagtccacagctctcatgaaaagttttggatctagggaagtgattgtcaacaatgagcctttaaagacttaatggtgatagcaatttacaggtgacttttcccaaaaaatgacagaaaatgagtttgccacttgggcatgttgactcacacttataatcccagcattttaggaagctgaggtgggagtgtcccttgcacccaggagtttgagaccagcctgggcaacatggcaagaccctgtctctacaaaaagtacaaaaattagctgggtgtggtgggggggcctgtagtccctgctactcaggaggctgaggtagggggatcgcttgatcctgggaggcggagattgcagtgagccgagattgtgccactgcactccagcctgggggacagagcaagaccctgtctcaaaaaagaatccgaaaaacaatgtagacttggagggggtgatgtaacttagcccatgagaccgccttagtgacttgctgataattgatctttcggtgccctgcagtattatgataacctgctatagcattttgctttttctgtgcattaacactttagggaccaagtggctttaagaactggattaaagttgatccagtgcattcagacacttggcattccctgtacataacacgagagagcacgccgggtctggccagccccatggataagatgctggagggtgtccaacgttgcatgctgaggagcatgtcttagaggagaatcctagatcctctgtgaagaatgaatttcatcctcccagctgtgcagcttctcttctaaatgtaagttgccttgctcaacatctgcttcccatacgggcagttttaggccttggacttcttgatgaaggtataaaacgaggactttcagcggaggtgcctcccatttatggctggaggagtctctggggtggggccgtcctgcacacttcagggtgttggggagtgtccctgggctccacccaccagcggccaggagcagcaacctcagttatgaaaagcagaaatgtctccatacataaccaagtgttccttcagggagggagggcaaagttttctccactagtgaaccactgtgatagacagacgacggacagagagagatgatagatacgataggtaggtatatgttgagatggataggtgatagataatagatattaagataggtgtaaatgatgggtgattgataggtgagtagatagatgatgggtagctaatagatgatattaagataggtgatagataatagatactaatatatacagctatagatgatagatgatattgaggtgggtaggtgattgattgatagattaatgaccgattgcatgtaggcagagctctcatgctaaaagagagtttctcaacctcagcagtgctgacacatggggcgggatcatggaggactctgtggtggggcatcctgtgcactgtagggtgttgagcagcgtccctggactccacccagcagatgccaagagcacccatcccatctatgacgagtatctaaagatgtctctagatactgctaagttccccctatggggggacaaaaagttatccccagttgtgaaccactgtgacagatagttgatggatggatggatggatggatggatggatggatggatggatggagatcaacattgagacagatatttgatagatgacagatattgaggtagatgatagctatagatgatagatggttgatagatattagataagtgattgatagatgatagctatagatgatagctgattgatagatagctggtagctatagatggtagatggttgatagatattgagatagataggtgattgattgatagattgatgatggaacgtattagtagagtttctcaacctcagcactgctgacatttggggctggaggattctctgcggtggaaccgccctgtgcactgtagggtgctgagcaatgtctctgggctccacccaccagatgcctctagcacccccactccagcgtgacagccaaagatgtctccagacattgtccagtgtttattgtggggagcagaatcagctccattgacacccactgtagcggatgcacagacagataaatacctgtgcgtgtggagtccctttctcccttttctgccccagcccctgagcctgcagccccactcttctgtcatgattgattggcttatgggccaaacagtggttccagtgccatattatctatggcacagcagccgagccaagccagtgggtttggtctgtggttgcagggcttagccagctttcttctacagaacttggaaggcaagaggtctctccactccgggccacatccttctagttcctggatgaccgctcgtttctccatggagaggagttcatgccagaacctcttcttcggggagagtggatgcatctcttggaaacatctttttttaaagtctgcagacttgagtgtggtccccattgtcattggtacttgttgggggtaggagtaaaatcattcctttgttttactgagagttcaggaagaaagaacaccatgttctctccttttatttatttatttattttgctctctatttgaattttaaaggcaaaaatctagaaatagcgcttcttgctctgtcatcactgcctgcaaagcacagagaccagagtgaaggcaggcagctcctgggtcttctcttcctcttctttgtccaaaaaatgatacattgcatgtttagtatttggggcaaagcagacgcttcaaaaagggaggcttattttattatctatatttttcttttttattattttttaccttgattccctttttctatgtatgaaaagggaggtttaagttcttgcaagagaatgcaactgtagtgtcttctgaatggagttttccatttgatgccaagccttccagtgccttggtctaaggagaactgcgtagggtgagaagagtcccagcgatacgtggaaaaggggccttaccagctctggagggcaagaggtagggggtgaagacgcagtggacacctaaggagaattttgcaggaggagtaggggtttattggctgaaaggggtgggtggtggaaactcattctagacagggagtgacacggaagccatgggtcactacggggcaggagggacatgggggagaaactcaaatctgagttcagccaggaggtggacacaggaatgcagtgaacccagatgtgtaggagactgccatggggactggggtatgaggaaggactggctctggctcggctgtgcatataaggaaggactggctctggctcagctgtgcatttgggctgctggacagtgaggagatccagggagagagagtgcattccaatttgggaaactttgagggcaaaacatctgcagcaactgtctcagaagagagcctgaggcagggtccttggagggaggaagccacaggtggatggagccaccgagggctgctaggtcaccttggttaagggctagttgcagtgcagccaggtcggaaagtagagccgttctggagcctcacgtggcatagatgttggaggagatgggatgaggatggctcattttcttcttctcaccacaaaagcccagctttatggcgggctctggagagaggaggaccaacttctacggtaaggcgtctccaaattagtgaggctgatttgcctgttcataaaaacaaaaacaaaagcaaaaaaatcccttagaggacaagccatccccgcagaccctgcaaataaaagactgcagatcagcttcgcggatggaaaagtgctgctgtcagctaaagatgaggacagagctgctcagctgaggtcactggagaggatggggaggggacttggaaacctcccttgtctcagtcgttgttgacgacattgactctttcttcatgttgactttccccccgttcatagattcatagattgctctctatgctggaaaacattctttaaaatttaatttttttattttgttaacatatatcacataacagtttactattttaacttcctttttttttttttttttttttaaaagaaatgaggtcttgctctgttgcccaggctgcagtgtactggtgcaatcatggcccactgcagcctcaacctcctgggctcaggtgatcctcctgcctcagcctcccaagtagctgggactacaggtgcgcactaccacgcctggctaattttttaatttttggtagagacagggtctcgctgtgttgcacaggctgatctccaactaccaggctcaagcagtcctcctacctcaggctctcaagttgagctgggactataggcacatgccaccatgcccagttaatattttaatttttggcaaacatgtgatcttgctttgttgcccaggctgttctcaaactcctgatctcactcaatcctcctgccttggcctctcaaagtgctgagattacaggcatgagcgtccatgcccggcctcattttaaccatttttaaaatgtacagttcacggctgggcgtggtggctcacgcctgtaatcccagcactttgggaggccgaggtggacggatcacgaggtcaggagatcaagaccatcctggctaacacagtgagaccccgtctctactaaaaatacaaaaaaattagctgggcgtggtggcgggtgcctgtagtcctcagctacttgggaggctgaggcaggagaacggcatgaacctgggaggcagagtttgcagtgagccaagatcgcaccactgcactccagcctgagtaacagagcgagactctgtctcaaaaaaaaaaaaaaaaaaaatgtacagttcactactcgggaggctgaggcaggaggatcacttcaacccaggaggcggagattgcagtgagctgagattgtgtcgctgcactctatcctgggcaacagagtaagactctgtctcaaaaaaaaaaaacagaaaacaaaaaaaacaaaacactgtttagtggcatggagcacattcatgtttctgtgcaaccgccaccccatccccatccccatccccatccatctccagaactccttttcatcttccccaactgaaactctgtcctcatgaaacacgccttattgcccctccctccagccctgccctggcaacctccctcgtactctctgctctatgaatttggtgattctaggagccttatataggcagaatcatacggcatttgtccttttgcgactggcttctttcagttactgtaatgtccttcagattcccccgtcctgtagaaaggaatttccctcctttctaagcctgagtactattccatcgtatagaggatacagcatgttgtgtttacccattcattcatccttggacactggggtgccttccacctcttggctgtagtgaataatgctgctatgaacaaggtttggcaaatatctgtccagtgcctgatttcagctgcttgaatacattgttttaatttattattattattttttagagatggagtctcgctctgtcaccccagctggagtgcagtgttgtgatcttgggtcactgcaacctgtgcctcctgggttcaagcgattcttccaactcagcctcctgagtagctgggattacaggcatgcaccaccacccccagctaattttgtacttttagtaaatatgggttttcaccttgttgactgggctgatctggaattcctcattgccaggtaactatttcacagcctggtatggatccttctgtacttttctttgtgttaaaaaagccccctcacacaaacgcacacacacaagcacgcacacacacaagcacacacacgtgcacgtgcacacacacatgcacgcacacatatatgcatgcacacacacacacgcgcgcgccccgtgcagttttggcctcatgccactagagtatgcatcatttttgtctcttgttttcttggagatccctctggggtattttgaggaggagaagttgtattattattgtgttgttgttaatctttagacattcagggatacacgtggacgtttggtacatggatgtatcatgttatggtgagctttgggcttctagggtaccccttacccgaatagtgaacattgtacccaataggttatttctcagccctcaaccccttcccagccttccccttttgggagtccccgtatctgttatttccatttctgtgtccatgtggacccactgttgagctcctacttttgagtgagactatgcggtatttgactttctgtgtctcagttattttacttaggatagtggtttccagttccatccctgtcgttgcaaaagacatgattttattttttatggtggtgtcgatatactacattttctgtgacttttatatactaaattttctttatccagtcatctattggaatggctgttacaaaaactcaaaaaaatccaggcatggtggcccacgcctataatcccagcactttgagagacccaggcaggaggatcgcttgagcccaggagttttagaacagcctgggcaatatagggagaccctgtctctacaaaaagctcgaagaaatagcgagggatggtgttgcacgcctatagtcacagttcttcaggaggctgaggtgggagaattgctcgagctcaggagttgaaggttgcagtgatctatggttgcgccactgcactccagcctatgcaacaacagagcgagaccctatctaggaaaaaaacaaaaaagtaagaaaacaacagatgttggtgtggaagtggaggaaaggggccatggatgcgctgctggtgcggaggaggtcttccagtgcgtgcagcaggggaggtgacctcacttctcctcgagaggagctcagctgtgcaaggcagtgttgcagaggatgggagggtgcatgtgaccctaggagcaaggctgtgtgcctgtgggcatgtacttcctggtgacgtttccttggaccccacagtgggaaacaggagcccctctgccctctcattcctctttctctgtatttgcattcgctgtcttgctggtctcaagattcccaagcgctgctgccagcccaccccttcagcctgccaagctacatgtgtgcgcccacttgaccactctctgagccttctgctcagatgcctctcaccaaaaatgagttcctgctcttcctccttgcccctcagccctaatcagttcctcatttgcacttccccatttcataggtggtccttccagctcttggggctcacccaggaaccattttttattccttttctttgactctgcattcactgtaatcctgagtcctgcccttttaacttttttttttttttttttttttaagagatgtggtcttgccgtctcatccaggctggagtgcagtggtgcaatcatggctcactgcatccttgacctcctgggctcaagagatcctcccacctcagcctcccaagtagctgggaccacaagtgcacaccactatgtccagctaattgaatttttgtgtgtgtgtgtgtgtgtgtgtgtgtgtgtgtgtgtgtgtgtgtagggacaagatctcactgtgttgctcaggctggtctcaaactcataatttcaagcatttcccctgcctcagcctcctaagtagctaggattataggtgcacaccgccatgccttgcccctttccaattctcaaacacatctccagagcccatccacatcaatgatgtcttcacagaagctgccatagcttatctaaattccctccccttctctccactgatctctgatctctgctgaactcaccccttcctgctgtatcagcccaaacgtttctgatgtgaaaataggcagggcgtagtggctcatgcctataatctcagcactgtcagaggctgaggtgagaggattgcttgaggccaggagtttgagaccaacctgggcatcttagtgagaccccatctctaattttttttttttttttttttttaaagacagggcctttctctgttgcccaagatggagtgcagtggtgccatcatagttcactgcagcctcattctcctgggcccaagttatcctcccacctcagcctcccagatagttgggactacaggcctgcaccaccaagcctggctgatttttaaattttgggggtcttgctatgttgcccaggctgatcttgaactcctgggcacaagtgattctgctacctctgtctctcaagtagataggagtacaggtgcatatcaccatgcccacctaatttttaatttttttttttttttttttttgagatggagtctcactctgtcccccaggctggagtgcagtggtgtgatcttggttcactgcaagctccgcctcccaggttcacgccattctcctgcctcagcctcccaagtagctgggactacaggcgcccgccaccacatccagctaatactttgtatttttagtagagatggggtttcaccatgttagccaggatggtctcgatctcctgacctcgtgatccacctaccttggcctcccaaagtgctgggattacaggcatgagccactgcgcctggccctaatttttaattttttgtagagacgtgatcttgctttgttgcctaggctggttttgagctcctgggctcaagcgatctgccaccttggccccgcaaagtgccggaattacagacgtgagccaccgcacctggcctccagctcttttgtgtccctccccaatcttcctttggccttcagctgtggggacagagatgccccctgcctccctgtccccaccttctacctggtcttacaggaccccctccagccatccttccaagtttactatgtaatgtctgttccacatcaagcctgcaaagctcatgacagtcacaagatctgccgttcctgatactatgtaccgagaacattacttggcacataaggggcccttgtccaaaacatttggaaaccaataaagaatgtggctggtgagttactgattaatgtgttgatgaattcattgattgctgaggctagtatgtacagtaagtgttagatcttgaacatacttctcatatccattgtgataaaccctcttatcttctattgcttttgaacttttatagacttgatgtcaggggcagagtccctcaggtaactggaatcattgaactgatgcattggtttctaattttctaagctcagatttgaaatcacctgtggtcactaaactcgtcctatcccacagcccctgcacatgatgacttaagttttgtgaatgttttttggagatagtaaagtcagtatctctttcaacattttgttccttatctttagtgatacccagctctgtacaaattctgtccacgtaagcaaagtctttttttttttttccagatagggtctggctctgtcactgaggctggagtgcagaggttcagtcatagcttcaactcctgggctcaggctgtcctgctgcctcagcctcttaagtacctgggactacaggcctgcacaaccacacctagctaatctttttattttttgcagagacagagtctccctattttgcccaggctagtctcaaactcttggtctcaagtgatcctcctgcctcagtttcccaaagtgctgggattacaggtgtgagccaccacactcgcctgcaaagtcttactgataaaagatttgaaggaaggatgtgtcagagaacttcttttttcttataatatttacttaatcttattggtttggggaagggcaagagaatcccagttatctagatttttctttttcttaaaggagtatgtttttacttgctaactctctttgtaaactgttacttcttaaagatgctgaagggtgatcccgcattagtgtataggtaaaaatgatgtctccatttcatatatactgataaggtgactttattaagccttgtggtttgttgatgttgattttactgagacacttgtggaacagatgtattttcatacaaccttacacatctcagtagttttccccactcgtgcagtaactttttctcccctgctttctctcctcctctccccacctcttcttccttcccctcctctcctcgtcccttccctcctcttctcatttgatacaaagccctaactctcttcctctacagatcatcctacccatggttgaaattgcaacttcccctgcaagccaagtgaccgaacctgagatgtttgtattgtcagggcttgcgtattctacatgcctgtgtaatcctcaaagttctttcattccttgcttctaacctacccaaatccttctaatctcccaccatggttaattatctctgatgctcctgaaaggtgacctgctgctacattgtgacaaggtgatgcattattcttaagaggatctgtgcagattattatcccagagtgaggtagatgggggaggatacaggatatatccaaaaatgtgttgcaagctaattgatagagagagagagagtgtgtttgtatgtgtgtgtgtaagcatgcgtccatctttttcttacatatttgagccatagggaagtagagccatgtatattctcttcaaccaaattaacagttgtagacagtggtcttgctattgctttgactattaatggtattttcaagagctcagtgttacccccaaatgttcagtatcacaccttggctggtcagtcgtagctaaattttccttccaccttgcgccctgaagaaatttagaaagtcaccagctgacacagaagtttattgtaaaagttcactagtacgatagtatttggaccttggaaaatatttccccaccagaacagtgaaatcatgaaatcatggttgtcttctaagctcatccacaaaagtacagtttgactgtcatgcatttgagatgccatgtgcttaatcacgaaatattactgagaggaacactcttgcccaaccaataacggtgcaaagcagaaaaacagggcatttagctgggagaaaatgagtcgagatgtcagtgataagatggaaggaatgtgggtatgtgctgggtcttttagaactccagcagattgctctggaaaacagccactacataccaaaagtagccggtcatggtggcatgcgcctgtaatcccagctactcgggaggctgaggcgggagaatcacttgaactcgggaggcggaggttgcagtgagccaagatcgtgccattgcactccaagcctgggtgacagagcaagactgtctcaaaaaaaaaaaaaacaaaaaaaaaaacaaaaaaaacaccactccaacaaaatacttctccttcctcatatagtgtccctgcttccctttatgcctcaagaccacacattttgaacttgctgagctataagaagtgaatggagaggtgggacacaggtgcacagccttcagtaactgaaggaaaaaaaacagaagaaatgtctaaccctgagcttcctgagctcccttcagccacccagctgctgaggggcaggaatccagcagcaaggtggagagcagaaggcattcctgcaacctgtatgtgtgggtcattagtcccccacctccagcatcattgcagaatctgcaaatttaaaagtgcgttaggtaagagccttttttataagaggcccatatttttgctaatacataaaaacattgtgattagtcaaataaatgttcatttaaaattcacagtagcatgtgtctatttttttttttttttccttttagaaatgaggtcttgctctgtcacccaggttggagtacagtgatgttgtgatcatagctcactgcagcctccaattcctgggctcaaatgatcttcccacctcagcctcccgaattgctgggatgccaccatgcctggctgattcttttattgtagagacgggatcttgctgtgctgctcatgctgctttccaacacctggcctcaagtgatcctcctgccttggcttcccaaagtgctggaatgacaggcattgagccgccgtgcccagcctatgatttttcttagcattaatctctgtgtcattgcaagctgtctcccacgtccttgccttcattctacattgttttggtggaatggcctgtgctagcagacaagaccatccggtcgaccttgagcatccttccctgtcctcagggaaggtttcctgggcctcattttgttttctttgtataccagcggggtgcagctcatttgaatgagcttgcaggggagcatctgtgatagcatcatgatcagatgagacaaaactggcacgggtcctggtcatggttgaagacctttatgctcctgattctattgggtgtcttctactggtgaaggctcatgtgctcatgggaacacgggcatgctggtgtcttccgagtcctctccaaaaacaaagcccaggtcaggtacagtggctcacgtttgtaatcccagcacttcgggaggatgaggcgggaggattgctggagccctggagttcaaaaccagcctgggcaacacagtgagaccctgtctctacaaataacagtaaataaaaattagccaggcatggtggcatgcacctgtagtcctagctacttgggaggctgaggtgagaggattgctcgagcccgggaagttgaggctgcatgagccttacctgcaccactgcactccagcctggcagacagaataagaacctgtttcagaaacaaacagaccgggcacggtggctcatgcctgtaatcccagcatttctggaggccgaggcgggtggatcgcctgaggtcaggagttcgagaccggcctggccaacatggtgaagccccatctctactaaaaatacaaaaattagctgggcgtggtggtgggcgcctataatcccaactacttgggaggctgaggcaggagaatcgcttgcacccaggaggcggaggttgcagtgagccgagattgcaccgttgcactccagcctgggcaacaagagcaaaactctctgaaaaacaaacaaacaaaaatcccaaagcccttagttccaaatcttgcctcataccccacccgtcccatctttaggtgaaaacgttctttcattatcagtgcgtatctctccaaactgtatttgtaacttgtgctgagatgttgaatgcacagacgcacctcagtatcttctgttccttctttcatccctacccccaccttcctcaatctctcattgctgcgttttcttccattaatcaacacctttgtaaggagaagcacctcaggcaagctcccacaagcaagtgcttcgaaatacttcatttggggctttttaaaagggctaccttttcctagcaggtttgggatgcagtctgctagtttattgttaattctcaggcttaatgatagttccaggttactgaatcaggtgtgatctctgaagatgtgtgtgttgtaggttagttagttagtgctgccataacaaagtagcatagacggtgtggattaaacaacactgatttattgttttataatttttgaggctagaattttgagaagaacgtcttaacagggctggtgcctcctgagccctctctccttggcttgcagacgctgtcttctccctgtgtcctcacgtggtcgtccctctgtgtgtgtctgtgtcctcatctcctcttcttaggactccagtcctgttggaatagggcccattctagtgaccacattttaccgtaatcacctgtttacatgacctgtctccaaatacagtggatattggaaggacacagttcagcccatagcatactgttggctggtttattatgagaccatgatatttactattcattcatcccaagacaatgagaccttttacccatgtcccaggatacacatatcttaacatctgctgttgtctgaatacgtcctttccaaattcatatattgagacagtaacccccaaagctatggaattaaaaggtggagctttgggggaagtgattagatcgtgagggtgaagccgctgaacaggaccagtgccctcggtgaaggggcctgagggagcccgtttccccttggtccatgggaggacagcgagaagggcccttccctcaggaatgggcccttaccacgcagttcatcagcaggcgccccgacctcggacttccagcctccagaactgagggtaatacatttttcttatttgtaagaccccctagtatatggtatttttgtgatagcagccagaatggactaagacaacatctatgtaacatctgtggaacttgtactttaatgtccatctatatgcttatcccagtatctgattatacacctcttaacatctacacacgtcttagcatctacctatactgatgaattacacctttctatatgcagacctcagcacctgtctatacctgtagagtcacatctacacacacgcatatcctaacatctgtctgtatgcacaccttagcatctgtctatcacatatattagcatctatctacacctacatattaacatctacttccacccatatcctaatatctgtctgcacccacagagcaacaccggtctacacgtctatacccatatcctaacatctctctatacctctgttaatatctatctacgttcatattctaacatctgtctttacgtgtatattaacatctctctacacccatatcctactatccatctacacccatattgtaacatctgtctcttcctatatgttaacatctctctacacccatattctaacatctatgtccatatattaacctctgtctacacccgtatcctgacatccatctacacccatattgtaacatctatacgtatagatatcatctgtcttcacctatattgtaacattgatctctatccatattctaacgtctgcctacatccatatcctaacatctatacctacatattaacatctgtctacacctatattccaacatttatctatctgtattttatttgtctatgcccatacattaacacctgtctacacccataatctaacatccatctgcacccatatactaacacctgtctacatccatctacacccatatattaatacctgtctacatccatctacacccatatcctaacatctctctatacctacatattaacatctgtctacacctgtattccaacacttatccatatccatattgtaatatctgtctgcaaccatatcctaacatctatctataactacatattaacatctttctatacctatatgctaacatatatctatatccatatttaataccatatggtaacactgtttacacccatgtatcagccccgatgtacacccatatcctaacatctgtctctaagcacatcgtaacatctgtatgtacgtgcattcgaacacctatctgtacccatatattaacatccgtctttacccatgtgctgatatctgtgtgctccatgtcccgacatctgtccccagctattactgtctgtctgtacacacattttggtatctagctgcatctgtaccccaacacctagctgacggcgtaccccctgccctgccttggcggggccctgagcatgtgctgtctgtccccgcaggttctggacgtggcatgacgagcgcttcctctacatgctcatggagtacgtgccgggcggcgagctcttcagctacctgcgcaaccgggggcgcttctccagcaccacggggctcttctactctgcagagatcatctgtgccatcgagtacctgcactccaaagagatcgtctacagggacttgaagccagagaacatcctgctggatagggatggccacattaagctcacggactttgggttcgccaagaagctggtagacaggtaagaggaacgtgaactccgatggaatctacactgcttggcaatgagaaaggtggtggtagttgtggcaggtcaggcagggaaagattgggaaccagagtttaactctcatgtgtaggagacacttgcaaccagggatgagagagccaggttgacccacagctcgttttaggtgggctgcgattgctggcaaagagccagtgggcaggaagtcagtctccttcactggcaccgtggaggaaatcagaacaccacatatccgctattgatccgaaatgatgaggaaatgagtcatatccaagtttgaattgccctgactataaaatagatctgcatcgaataggatacaatatctcttaaaattaaatgccaggtgctgtggctcacacctgtaatcccagcactttgggacgccgaggtgggagaatcatttgagcccaggagtttgagaccactgtggacaacctagtgagaccccgtctctacagaaatatatatatttaaaaaaaagttgattatggtggtggatccctgtagtcccagctacttaggaggctgaggttggaggattatttgagccccggaagttgaggctgcagtgagctgtgattataccactgcactccagcctgggtaaaagagcaagatcctatctcaaaaaaaaacaaaacaaaaaaaaaaaaaaaaaaaaccaaattgaatattccatacacacctgctcacacacacgtgcacttatttttttctgttatctatatttctattatgtatatatatatttccactatatatgtatattaaatagaaatatatataatactatattattgtatataacatatagtatattttatgtacatatgatatagtattatatatgtatagtatatattatactatatattatatagtatacaatgactatgatatagtatcatataggtatactatatattataatatataatatatattatatagcatacctatatcatactatatcatacatatcactatactctatatagtatatattatacgtattatatattacacatactacatatatatattatatagtatattatactatataatatatataatatatatattacatagtatataatatatatagtatatatcacatagtatataatatatataatatatatatcacatagtatataatatatattatatatatcacatagtatataatatatattatatatatcacatagtatataatatatataatatatatatcacatagtatataatatataatatatatatcacatagtatataatatataatatatatatcacatagtatataatatatattatatatatcacatagtatataatatatattatatatatcacatagtatattatatatattatatatatcacatagtatattatatatattatatatatcacatagtatattatatatattatatatatcacatagtatattatatatattatatatatcacatagtatattatatataatatatatattacatagtatataatatatatagtatacctatatcatactatatgacatgtatgatatatgtgtttcttttctggaaacacacagacataccccaaaacagtgtttgaacaaacatctgggcaccccacggcccatcaacacatgaaacaaaccattacatgtcgtctcagccagtgcgggctgcactaacacacactcatagactgggcagcctcaacagcagacattcatggctcacagctctggaggctggaagtccgagatcgaggtgcgacagattctgtacctggagggaaccagcttcctggttcgtagacggcgccttctcgctgtgtcctcacatggtggaaggggcgagggggctctctggggccccttttgtaagggcactcatcccattcatgagactccacctttgtgacctcatcacctcccaaaggccccacctcctaatcctatcactttggggatgatgatttcaacataggaattttggcggggggcacatacattcagcttataatacatgtatatgtatttttttttccatgattggattcatttaaccagtctgtcttgacaaaagaccacacactgggcattttaaagaatagaccttttcctctcactgtcatggaggctaaggtctgagatccaggtgtgggcagggctggttcctcctgaagcctctctccttggcttggagacgctgtctcctccctgtgtcctcacaggattgtcctctgtgcatgtctgtatcctcatctcctcttcttatgaggacaccagtcctcttggatcaggacccaccctagtgacctcgttttaccttaatgacctctttaaagatgctctttcccatatagtcacattctgaagttctgggggttaggactgcagcatataaggtttaagggatacatttcagcctggaacaagtatatatagatatgtttccgtacacacacatactccattgaggagaaaacagttatccttttttgtttgtttttttgtttttttttgggacgaagtctcgctctgtcgtccaggctggagtgcagtggcacaatctcggctcactgcaacctccgcctcccagattcaagtgattctcctgcctcagcctcccaagtagctgggattacaggtgcccgccaccaggcctagctaacttttttttttttttttgagatggagtctggctctgtcgcccaggctggagtatagtggcatgatctcagctcactgcaagctctgcctcccgagttcacgccattctcctgcctcagccccccaagtagctgggactacgggcgcccgccaccacgcccggctaattttttgtatttttagtagagacgggatttcactgtgttagccaggatggtctcaatctcctgaccttgtgatgcgcccaccttggcatcccaaagtgctaggattacaggtgtgagccaccgcacccggccccagtatgtagtcttttatctctcacccacctcccaccctttaccccaagtccttgaagtccgttgtatggttcttatgcctcagcgtcctcatagcttagctcccaatggatctttaatttacattcataaaatcaacagtcataaaaagtaaattcacacgcccaagctgctgaaaaatactcagaaagatttttggtaactacactgagtgtcagtttttcaattagattaaattaatgaaagtagaattagataatgacatccgttccttggtagacaagctacatttcaaatacccaggattgcacatggctatcggcttctgtcttggtcagacaagcctagaaaatacattttatatttccatattctttgatgtggtggggttgggtaaggtgataattacactaattatactcctaacattgtaaaaccgtctgcattttgagaaacttgatgtgggggcagttttacactaaatgactctcttctctggcagcttttagaaaagggctctcctaggaaaattttatgatgcgtttacattcaatctgattttcccctatagtatttcttgtactacatttccaaaaataaggcacatggaaattaggtgcattttacatggagtaggaaagatgcaggattttttaaaatattgatttatagcatctgtgctgccctctcttggcagcacacggtatattagtaaattcttttaaagtcattttatttgcaagtctaattcaaagaaaacagataaaatatttcatatattcacttgtttataagtttgacaaaccatgttactgtccagttaattcatcatatctatttaaatggacgaaaatggtttcgtatataacatgcagcaattattttacttaatgaacatgtgaaaatcttagaaaatgtctcattaccatattgatagattgcttttgcaaagaactgcatcttcctctgtatgggtagtgtagcttctggaaactttttttttgtgggggcttttttctcctttttttttttgaccatcattgtaacgaagcatctctctgctggcccggccccagggaagttgtgttcatgggggcagatacatggccctgcctctgattcaggattcaaacagtacctgtgccttttgaataaaactgaaattcaccactgtatcgtggaccactacagaatagatggaactaaacagggaggcctcatcttgaataatttttttttttttttttttttttttttaaagacagggtcttactctgtcactcaggctggagtgcagtggtgggatcttggctcactgcaaccttggcctcctgggctcaagcgatcctcccatttcagcctcccaagtagctgggattacaggcatgtaccaccacacctggctaatttttgtatttttagtagagacctggtttcaccatgttgcctaggctggtcttgaacagctggcctcaagtgatccacctgccgcgaccttccaaagcattgggattacaggcgtgagccaccgtgcccggccttgaataacatttttgaacatatcccagaaagaagtctgtttctcatttttctctcttttttttttttttttttttggagaggagtctcgctctgtcgcccaggctggagtgcagtggtgcgatctcggctcactgcaagctctgcctcccgggttcacgccattctcctgcctcagcctcccaagtagctgggactacaggcgcccaccaccacgcccggctaattttttgtgtttttagtagagacggggtttcactgtgttagccaggatggtctcgatctcctgacctcgtgatccgcccgcctcggcctcccagagtgctgggattacaggcgtgagccaccgtgccccgccatttttctcttatagcatggggtaaaaacatacttaagcatgttgtaatgtaatctactcactacatgaatttctttctttgttttttgtttcttttttgagacagggtctcactctgtcacccaggctggagtgcagtagtgcaaccatggctcaccacagcctcgaacttgcaggctcaagcaatcctcctgtctctcagcctcccaagtagctgcaactacaggcttgcacaccctgcctggctaatttttggattttttgtagagacggggtttcactatgttgccagggctggtcttgaactcctaaactgaagcagtcctccaaccttggccccccaaagttttgggattacaggcgggagctacggtactcagcctctccctcccttccttccttccttcctccctccctccctccctccctcctttcctctccctcccctccctcccttccttcctcccctcccctcccctcccattccttccccttccctcccctcccattctttccccttccctcccctcccattccttccccttccctcccctcccattccttcgcctcccctcccctcctctatcctcccctcccctcccctcgcctcctctaaccctcccctcccctcccctcccctcccctcccctagcaaccctgttaactggatgacttgtaccctacttattttaaaccactgctcttggtgacttgatttctgactttcctaggttgtcagtatgttcagatggtgttcttttgtgacttgcgttcaccaggctcttgttttctaacagcaatattacgtttgtattgtaaatattttgcacacacactttatgttatctagatagctcccctaaaagatttggtggcaaactagaattatttctggttttatgaaatggtcaaaataaaatactgatgtgtttaatttgattttataattcaaatgcataacacaagcatcccttacctgaaatacttcagaccagaattgttttggattttagatttttttcagattgtggaatatttgaattacacttacctgtgagcatccctaatttgaaaatctgaaatccaagatgctccagtgaggatttcctttgcgctgtgagcctcatgtcggtgctggaaaagtattgacttttggagcatttgggatttcagatttggattaaagatgctcaacctttatacatctgtctttaaaccataacagatggttttctttctctgcaacagctcttttttgtttgtttttggtgttttttatttctctgcgacagctttttgtttgtttgtgtttttttgtgtttcttttgagacagggtcccactatgttggccaggatagtcttgaactcctggcctcaagcaatccttccacctcggcctcccaaagtgccaggatggtagccgtgagccaccatgccaggtgcaacagctctttcctagttcctctgttgtagcattttaaatccagatgttacattgattactgtcctctggatttttatttctagccttatagggataacattgaacctagtctttcaaaattactacttacccctttcacacacacacacacacacacacacacacacacacacacacacacacacacaggagtagagagagtaattcacattgaaaccttatggccccatcacccagcttcgattgttatcaaagctttgtcactttgttttttttctctttgcccatttgtttcttgagttattttaaagcaggtgcactttatcctatctttaacagataactccctttaaaaaagaacttcagtgccattatcacatctgacaactatttaaaaaaaaaaaacccagcctgggtaacatagcaagacctcatctctacaaaacatcaaaaacaaaaaaattagccttgcataggttaaatccagccccctatgtgtctgttaataaagttttattggaacacagtcacatcttgggggcttttgagctaccgtagcagagctggatatttgtaacagagaccatgtgattcacaaggcctaaaatatttgccgtctggctctttacagaaaatatttgcccacccctgagccaggccatttgctttgtgaactggttaaaattggccaggagctctgtctgtgcagtggaatattatttggccttgaaaaggaatataattctgacacattctacgcgttgataaaccttgaaaacatgatattggacgaaataagccagaccaaaaaggtctcatgtcgtgtgattctacttgtaggagggccctagattcttccaaatcataaggacagaaagtagaatggtgggtgccaggggccggggaggtgcagggaaggggaagatgctgtttaatgaggatggagtttctgtttggaatgatgaagaagttccagcagtggacggtagggagggttgaacacgaaggtcagtggacttcccaccaccgaactatacaattaaaaatgcttaaaatggaaaattctatgctgtgtgtattttaccacattagaaaatcatacatataaaatcataattatgtatataattataaataactatataattgtaatatttacacataaataatatatccgacattaaatttatatatttaaatatatttatctctttaatatattaaatattttagtatattcatatataaatttaatacataaagatattaatgtaatgtgttaattactaatataacaatgtatgtatatattaatatactaatatattctaattataattatatattaaatatgtaatttttagttaaacataattatatttaaaaaataatttaatacaattaaatatataataaatggatacagttttatatttaatattacatatttaattttataaacatggctaccaaataattatatgtgctcataaattatggtataaatatgtttagaaagttatatgtagctataattatacattattatccatagttttatatataattttataaatatatatttatttttaaaatttaaatttatatattagtatgtgttacacatttagtgtttagattataagttcaaatttaaacatatacatttataaatacataatcgttttatatatatttcataacaccagaaaagtctttctagttactttagaccttttcccctagcttcttactttgagtatttaacggaagtcaaggagggcctgagatgtcgagtctgtttgcagtcggtgttgttactttcccttgagccccttttaattttgctgtagttcatactaggacgtgggtattactgtgccgaggttggtgacaggcacccttctccctgctgatcagtggtgcctaggagccattgtcaccgaggaaacccctcccagggcctgggctggccatcggaagctgtcccatgctcgcaaacacacaccttctcccttcacgggcctgaaattctcaactgtttgtccccatcagacagttctaggaactgtgattgtgtccccataaaaaaaaagatgacaaaatcttccctttttatgaaaaaccccacaccctgctgctttattgcaacccaagatcctataagaaaaggcaatgtagtattttcaccatgagtactgagcgaacatctatttcctgcattaccaaacccagacaaaacactggctcatacttttctgataaaaagggaaaaaatgcatttgtatctgtaatcaagtgtaaaagctgtaatcagctgtccttcctcctgagccctaccatgcccctgttagctgagtgacatgctcaccatgtcataaagccatgaggagagacagaaagtgaggctggtgacgccacctgctaggacgtaagagggactggactgaaactcagcttggagatgtcatccgtttctctctgtctctctctctttttttttgagacggagtctcactctgttgcccaggctggagtgcagtggtgcgatctcggctcactgcaacctctgccacccaggttcaagtgattctcctgcctcagcctccggagtagctgggattacaggtgcctgccaccgcgcccagctgatttttgtagtttttagtagagacagggtttcaccatcttggccaggctggtcttgaactcctgttcatgatccacttgcctcggcctcccaaagtgttgggattataggcatgaaccaccgtgcctggcctctttttctctttttattgtggtaaaatacacttaaaatgtaccatcgtaaccatctttattaacattttttatgtttcagaatagggtcttcctctgtcagccaggctggagtgcagtggtacgatcatggctcactgcagcttccaatgcctgggctgaagcaatcctcctccctcagcctcctgagtacttgagactagaggtgtgagccaccatgactggctaactttgaaatatttttgtacagacagggtcttgctatgttgccttggctggtctggaactctgaggctcaagtgatcctcccaccttggcctcccaaagcgttgagattataggcatgagccactgtacccagcctgtttgaaccatcttgccgtgcacaattgagtggcatttattgcatttaccatgtcgtgcaaccatcacctctctctagttccagaacattttcacgatcccaaaagagaacttgtatctgttaagcaattattccccatcctaagccaggatgatctcatcttaacttgattgcagctacaaagatcgtgtttgcacataaggtcccactcacaaatactggggtttaggactttggggggtgcacagttcaaccagtgcaggtgtggcggaaggcgtgggcattaagaacacaggagtcattggatatctatactttatagataatcctatccttagctctgtttctccttcgttaacatggcctcctccctcccctccccccggccatagtgaaactaagaacagtgagaaaactgagaacagcaggtgtcaccttccttctacccaaaagccaggtgagcaaaaggagacaggagcagggaagtggataattcactgcccagaccagtggtctcgacataacactcaggctgtctcatctcatattcattcacgcagtcagcatctctccatagcagcgtatgtctctctgtacattcagctaggcgttggggctttttgcaggaaggagtgactctaacagggcaggagtcctcctgaggcaagttagaacctggatacttatacagcctcatacaacctcaggtgtgtgtccttaccctaacacggagccaaaaagagcctcatctttcaaaaggtaagtggagaagttgcagctaatgcctgtagcatgacctgtggcctctacctgggcttcatatcagctaagatctaggcttttagctactttcaggccactttggatgggctagaaaggtggaaatacaaaactagcaggccagtaagtcgctcgtcttgcagaatgacagaagtgtcgtgcattgaagcagccagggtgtacttggagttgattcaactgctgggcagggcaggggagagcgtgtttctaaaatagtgcgcattgtactttccatttgtagacttaattctaatgagtgagaagcacttaacaggaccacaaggtggtccctgttccatacttagctctaacctgcagatagagagtaagtcccttccacatgcttccatgggaggagaactcaatttctctccttgtcttctttcctggtttcctgatttatatctgctacatcctgcagtaattttttttttttttttttttttttgagacagtgtcttgctctgttgctcaggctggagtacagtgacactatcatgctccctgcagtgttgacctcctgggctcaagtgatccttccatctcagcctcccgactagctgagactacaagtgcacttcagcacacctggctttttttttttttttttttttgtaaaggagtggtcttgctgtgttgtccaagctggtctgaaactcctagcctaaagcaatcctcctgcctcaacctcccaaagtactaggattacaggtgtgaactaccatgcctgaccttgtggtacttttatttcatggatggccgacagaatttgaaatttggatggcagccagtttgttgttatcccaagggcttacagattagtgtggaaaagtctgttgtctggaaagagatggggtatggaggtgtggtggggaagggaaggaaagataacagtaacaacattttgggtgggttcctgcaagcaggaagctgaggagctgaagccaagatacgtgcccacaccactgcaaacagtgcggactcaggcaagatgtgctgggtataaaataggctttgcacatgcttgatacattgtgcaaagaacttgagagtggataaacatgtatattaccagactctgtggaacttgttttttgttctctttacattcaacttacaaaataagggtttcttctttcattgatctgagtggtgggagggaagggtcttttgcaaagcatctatatattttttccctctgagggtgttgcttctttctgcctgtctacagacaggctccacacaccagggcagcacttggcaggaagggtggatgtggcccgcatttgtgctacaggtctgaattgctgaaagcccgaagcgacattctacccagcagtagagcgccaatggagtacggcccagacaaggccccctctctggggttactgatactcagctcctttccagcccatgagtcttccagcttctgctgcagtccttgttatcttgccctgactttatttagcagattcttctgtaaccaaaatgcaggttcagccgctcgccgtttgcagagtgcaattagcaagagcgaggtctagtgtaaagaaagtgattttttattccagagctttcttaggggaagaagtacaggcttcctgcttgaggccacccctttgcttttggagcacaaagcaggcacctttaaaggaaaatggtatgcaggggaggaagtgtatttctgtctttacactggtttccagggggcaagaaatgtttttttggggggtgggggtgtaaagagccaaagagaacatacgtaagctttgcaaaccatccagtctcagttacaagtacaaacccagctcttgcacctttttttttttttttttttttttttgagagagagtctcactctgtcgcccaggttggagtgtaaagtgcagtggcgcattcttggctcactgcaacctccgcctcctgggttcaaacatttctcctgcctcagcctccggagtagcttggactataggcatgcatcaccatgcctggctaattttgtatttttagtagagatggggtttcaccatgttggccaggctggtcttgaactcctggcctcaagtaatctgcccaccttggcttctcaaagtgctgggattataggtgtgagccaccatgcccggcctaagcgagttcttgaattattcttttcactgccacttttttttttggataaaggattttctttttacttaattttatttatttatttatttaaagaacttttaggttcaggggtacacgtgcaggtttgttacatgggtaaactgtatgacacttggtgtactgattattttgtcacctgggtaataagcatcatacctgacaggtagattttccatcctcatccttctcctgtgcttctccttccagcggccaggtgtctgcttttccccctctctgtgtctgtgtgtccccagtgtttagctcccacatacaagtgagaacatgtgagtccacttaggagaatggcctctccacctccgtccatgttgctgcagaggacatgatctcgttctttttcctttaattaattaattttattctttatgatttatactaaggtataaataactcaaaaaaaatgaggtttttttttgcttctgagtaacagtggtaacagtaccagcaacaggagcaaggatgataaaaccaattcttagcttccaagcccgttaagaaatgtttctatggaaaggaatcagcgaaaacaatgttactgtctttacacattaaaatatgtgcacaggagggtaaacggagcgtggttttactcaacgaagttattgtaacaatcagagcttctaaggtgactgcattagccaagcaccactgagtgttgtgggggcctgtctctgtcgcccatataggacttggaccctctgtggaacacccggagtacctagcccccgaagtcattcagagcaagggccacggaagggccgtggactggtgggccctcggcatcctgatattcgagatgctttcggggtaagtagagtctctgtagagaatcttcatcttacaggccagcaccccccttcccccacccattcgtccactcggcatttctgtaaccttgaaaacagtacgtgagtgtcgcaaacacacagtgtggctgcacacacatctgctgccctgctgaggttggcaatgtgaattagcaattgagcttgtgtgaataagaggcaaaaaacccaaacttgtgaaggaaccacccatgcatgcccattgagatttttatattgaaatatccatatcttctttaaatatacaattaacattctgggctgctctgaaggtagtgagttatctcagttgattttcacagtcagctacagattgaactccttgctctactcttttccccccttatcacttctgcgcttgtttagtcttaaaaagaatttaaaaattaaattaaaaaatgaatcttctgcacagaccctttctgaagtaacctgcagagctcaggggggcacaggttgggtcaaggtaaatcagccaaatacagttcagtggtttctggatgaacagctggcaaggaaggcgagaatatgttctttcctaaaaccgtatgtctgtggtacaggaaaggggtcccgacccacaccccagcacagggttcttggatctctcgcaataaagaatttggggaaagtccataaagtgaaagcaagtttattaagaaagtaaaagaataaaagtatggttactccttaggcagagcagccctgagggctgctgtttggctatttcgatggttatttcttgactatatgctaaacaaggggtggatttttcgtgagttttccgggaaagtggtgggcaattcctggagctgagggttcctcccctttttagagcatacagggtaacatcctgaccttgtcatggcattcgtaaactgtcatggcccttgtgggagtgtcttttagtacctaatgcattataattaatgtataatgagccatgaagacgatcagaggtcacttgtcgccatcttggttttggtggcatttggccggctttactgcagtctgttttatcagcagggtctttgtgacctgtatcttgtgctgacctcctatcttgtcctgtgacttagaatgccttaaccgtctgggagtgcagcccagtaggtctcagcctcattttacccggcccctgttcaggatggagttactctcgttccaacgcctgtgatacctgtgttgggtgagatttggaagtcaggagaggtgccatccaccctgcaaccacataacagaggtcggtcatttgttgggacgtcagcatgattgagtgttcaagtctagcatatgcctgagacagctccactatgactagaccagaaacgcaaaggaagcacgcaacacttggaaacccaggacgtgggcgtcatcctcgttccgttgttagtgctaagatgacacagtagcgtggcacttttccagataggaacctgtaggaaggagtgagctacgtgtcagaggaactgttgcaccatgtggctctgcacgaaaggctcttctctctgggatgaagacgagaggaagcccagccagcgagggcccagaacaccggttgggggagcctctgccgcgctttgccacagccgacactctgcctcctaggttctctcttttcctgtttccttctttcttctgcttgcccctgagtctcaaagacagacaccagcgtatcctctgagtggcctccattgtcgcaaaagccagatcctctctcacatctctctgattccctgcagggggtaaagaccagagttttactggggaaccttccctttcagttggaaacaaaggagggaaggaagagaggcattctcctgcctggaaggcgtgtctaagccaggtcctgctggtggggagcaccgagcgcttgttcctgggggtgtggagcatgtgacattctaacatccacctcaggaaatccaggcagtcgctgactttgtttggggagcagacaggggtcatcgtcccatgtgcttatctctgccctcttttataaagaaagtgaatccgttaattcccacactagcttagggatcagaacgatgttgaacaagcactaccaaagaattccaccacaaaaccggagcctgagatgccgcaggaggagagtggaacccgtaaaaacctgtatttcattgtctagctatccatgtgtattgtttatcatccatccatccatctacccacctgtctatttatctatgtttatatacttttccatccatccacccacctaccccccaaccccttcatccatccacccacccaccccgtcatccatccacccacccactccttcatccatccatgtacccactcccccaccccctaccccttcatccatccacccccccaccccttcatccatccacccccaccccttcatccatccatgcacccacccccccacccctctaccccttcatccatctaccaccccaccccttcatccatccacccccaccccttcatccatctaccaccccaccccttcatccatccaccccccgacccccccaccccttcatccatccatccatccatccatccacccacctaccccttcatccatccacccacccaccccttcatccatccacccacctgcccacccaccgcttcatccatccacccaccccttcatccatccatccatccacccacccttccatccatccatccatccacccacccacccacccacacacctatccctgtctatctctatggtctacctattttgtaagtatgtatgtatctgtttatccatttatccttatctatcatctaagttgtcatttatatatttatatatccatctctctccatctctttatctctacgatctttttatctgcctacctacctgttatctatgtatttacctatcatctatctgtcattcatgtaccaatctatccatctacttcctatttatctatgtgcctatccatctatttatcatctgtctttctatgtaactgtttacctccctacctatccatctatcaatcatctatctacctattcatctatctgcttttctatatatctatgtatttatcaatcatctacttacctacctatccctctatctctacctttctgtctatctagctatcaataatctacctacctaccggcctgttggtcttttgaattttccattactctttgctgagacatgcctacaagtcatatagaaccaaacttctcaatatgcaccctagcccattatgtcctaggcaaacccaaaaggttaaaaataacttaggcatattgatcagcgtccacccaaggaaaagcaccacattttccttcggtgataacactgaccacacgagggcagcattgcctgaggatcgttgtatcctgtagtctaatggttttaaatagagtgaggttcgtgtgccccaaattttattgattctaggatagagtagactattattagaatacaatatactattaggacataatattgttagaatacaacatagaattattagactataattaaaacagaatattagtctcagggtacgctgaagttaaaaatacataaaaatacatttaaaaagaatagaatattacactcttagaatgactgtattcgaattatataaagttaccagaattgttaataggctataacattggaatatttaaatatattagaatacaatagaatagaaaataacctaattgtaatgtaataaatcattaggctaattgaaaatgaataattaggccaggcaccatggctcacacctgtaatcccaacactttgggaggccgaggtggttggatcacctgaggtcaggagttcgagaccagcctggccaaaatggtaaaaccccgtctctactacacatacaaaaaaaagccaggcatggtgcctgtaatcctagctactcgggagtctgaggcacgagaatcgcttgaacctaggaggcgggtaggttgcggtgagccgagatcgcaccactgcactccagcctgggcaacagaggtgagactccatctcaaaaagaaaaaaaaaaaaaagaaagaaaatgaataattaaattaaatgaataaccgtctcccaatcaaagcccagtctgctgacctgtgcatttcatgaggcagggagctattgattcacagtaagcctatttttattttccttttttctaattagagtctatttctgggtgaatattgttttttcaatttctcagcagccctgtgtctcttcacatgggtgggtgtcttgagagttaccagcttcgccgaccccaactctcccaggcattcctgtgctcttccccagctccagccggcctgagctcgcctggaccaccccaagccttctcagtctcctgcatcccctcctgcctgcagtacattttcctggaagcagctgcaggcatcctgtccacgtacccatcagctgtgtccctattccctgggagcccgcttgttgcttcccggatgactggagcagaatcggaggctcgttatcatatgaggttctgagacggtctgcctgtgggttgtccacccctcttagacaacagcctggcccctccttgtcttcccactgctttttaaacgtgccaggaagcctgacctgtccccctgcccaaaggctggcttccttcctccttcttttctttttccctttcctttccttccctttcctttcctccctccctccctctctccttccttcctctctccctccctctctctctctctctccttcctcccttccctttcccttcccttcttcctttccttttcctttcccgtctccctcttcctttcccctttcccttttcccctttcccctttttcctttcctttcctttcatttcctttccttcttcctttcctttctgttccgcctcgctctgtcacccaggctggagtgcagtggcacaatcttggctcactgtaacctctgctttcttgtctcgctctgtcacccaggctggactgcagtggcgcaaatcttggttcactgcaacctctgcttcccaggttcaagcaattctccttcctcagcctcctgagtagctgggattacaggtgtgcgccaccacgcccagctaatttttgtatttttagtagagagggggtttcaccatattggccaggctggcctcaaactcctgacctcaagtgatccacctgcttcggcctcccaaagtgctggggttacaggcgtgagccaccacacccagccagggctggccctttctcttccactgcacatgctgcaggctcacctgtcacctgctcccacagccctctggggcctcccctgttctcctgggccatgccctgtccgaccagcccatctgttttctttatactgattagcagctctgaaaccatctaaattttgtatgtgttgactgcctctgagagcaatgctcccaagctgctctcctcacctccttgaacccagaaacttctggtggctggagggagggcactgctgcacatacaagtggagccggcctgcagtcagagtcttcctgctcccttcgcagcctgtgtctgcacctttcctatcgcagctccatttgctggattcccactcttagcaggatcaagtgagactgtgccttgtctgtgttattgctttaagtgattatctcaatcttccactaagcacagggaaaaccatctatttggtaaaatctgccatgtgattaggaaggagatcatatcatgatgcagattttattttcatggaatgagacatgtttaggtcagatgaaaattgtgtggcacattctggaacaaaatcactcatgcactttccaaggacccaagctcagctccgatttcttccatcctattctctttcctcatccatttctgtggttttattctcccagagagtttaactcaagagtcaggtaaaggctggacgtggtggttcatgcctgtcatcccagcactttgggaggctgagacagaagaactgcttaagcccaagagttcaagaccagcctgggcaacatagtgggaccccatctctacaaaaaataaaaataaaactagctgggtgtggttgtatgttcctgtagtcccagctactcaggaggctgaggtgggaggattgcttcagcccaggaagtcgaggctgcagtgagctgagattgcaccagtgcacatcagcttgggtaacagagcaagacactgtctcagaaaaagaaaaaaaaaaatcagctaaagcatcaagaacaaaacacagggacacacaagacatacagcagagtgcagggtaagagaaagcccctgggccatcttgtcttagttgtgacagcagtgattctcaaagtggcatcccagaggactatggggttcccgaagtgtgtttcagcagatgagtgagatcatttttccaatgacagatctgaatagtgatgaattttcttcataggtgtcaactaagacaatacagcatagcagacagggtgcagaagatcctagagaaggtggaatttggctgcagtggagcctcttccacggggagcattaggcattgcgcagtggttctcaaacatgttggcctcgggaacccttcaacacacagctcaaagttattaacaacccacagaactttcatttctgtgtgttacagctgtccgcgctgactacatttgaaattaaagtagagactgaaatataaaccaacagaatacataaataatatatatgagaagttaaataatcagaggagaacataaatagcatttttaaatgaaaaaaatgtgtaaccacactttctagaattaaaaccattcaggctggacatggtggctcacgcctgtaatcctagcacttcaggaggctgaggtgggaggatcacttgagcccaggagttggaggccagcctgggcaacatagtgagaccccatttctacaaaaaataaaatgaaataaataaaccaattagctgagcatgatggtacacgcccagggtcccagtactttgggaggctgaggtgggaggatcactgaggctgggaggtcaacgctgcggtgagctgtggtctcgtcactacactccagcctgggtgacagagagaccctgtctctaaaaagagagaaaacatttgtgaggaggttggctgtattttctgggttttgtgaatctctttagtgtccagctttcacaagggctgctggcctctcctccctctgtctgcagcctgtctgctgtgctgcgtggcacgttgtttagttgaggcataggagaaaattcatcactattctgaactggagtcagaaaaacgatctcagccatccctaaactgaggtcgggaagccaccctgggactccactttgagggccactgctgtgatgcccaagtcaacgtgcccggggctatattttcaccctctactctgccccaaccctcacacaccccagtgcctgctccttccgctttaactggccctcaagttcccctttctcatctcccacctcagcctccctgattcatctgaggagcacagattttatatttatttattaattattattattttttttctttagagggacccctgctctgtcacccaggctggagtgtagtggcgcgatctcggctcactgcaacctctgtctcctgggttcaagcaattctcctgcctcagcctgccgagtagctggggttacaggtgcgtgccaccgtgcctggctaatttttgtatttttagtagagatggggtttcgccatgttggccagcctgctctcaaactcctgacctcgagtgattcacctgcctcagcctcacaaagtgctgagattacaggtgtgagccaccacgcctggcctaaattttagtttttaatctgaaggtatcgggacaaggatttttgaggaagaagtcaaggtgggatgaaattctagtgaaattctagtgacggctttcttcttttctctaaaaacctctgccttccttttcttgaatgcatttccaaagcacctgtcttccaaggccagccccggtcctcagaactggagcaggtagtgtgtcagctgatagtttaggagggtgtttttccagctgagtaggagggagaacatcagctcacagcgcccagggtatctctgcctgcaccatccactttactggaagatgtaaataggcggaatggttacattcaaattttactggcaaatgatagagctagtggcacaattggtgtaaatttttttcatttttctttttttgtttttgcagacagttttgctctgttgcccagtcaggagtgcagtggtgcagtcacagctcactgcagcctggacctcctgggctcaagcaaacccccacctccgcctcttgagtagctgggatgacaggtacacgtcactgtgcctggctaagtttttaaaatttttttgtagagatagggtcttgctatgttacccaggctgatttcaaattcctaggctcaagtgatccacctgcctcggcctcccaaagtgctgggatgacagccgtgagccactgcatgagcgttttttttgttttttttttttttcttttgagacagggtcttgttctgtgtccagattggaatgcagtggtgcagtcatagcttactgaagcctcgacctcctgggctcaagcgatcctcctgcctcagcctcctgggactacagaggctgtagctggggaccgcagaggctgtagctgggaacacaggcacacaccagcacgtccagataatttttaaattttttgtagagacgaggtctcactgtgttgtccaggctggtcttgaactcctgggctcaagcagtcctcccgcgttggcctccccaaatgctgggatgacaggcatgagccactgtgcctagcctgggcatgaatttttcaggcgaaaatctggagcttgcattcatgctgattagcagattgtccttgcaagtgtagctgtcaccacagatcaatttaacttgcttaataatgccaaatgccatataatgagaatttattctccacttggtaagaattggaagcagtctgtatgtttagagacagaaatttgagggtttcagagggcactgcccaggcgtccgggggagtgctgtttctcagacacacacacacactgtctctgctttttctttcaggcaagatcatcagttagtgctcacttattatttatctttttccgcttattaatacctttcccatgatcttatgtaatgtctactgtccaagagcacttcgtttaatattctccataaatgtttttaggtatgtatggcacatttcctcctggagtttaatgctccattcctgtatttgtgcattattcacacagctgaatgtattcagacagggtcgccacccaaacccagagagaaacaggaatacaactcccccaactactgttacagagaacgctgcgggcaggtgagggaggacgggctcgggaggttgttaacgtctgaggcggcagggttggcgcagatcgcatgagtgtctgtactcagagctctgcttcccagcctggcctgggtggtttttcagtacgttgtggtggctcgtaactccaggaccagcggcccaaagagataccctattgggaaactcaccttcatgctaaagtgcaaaacaagcaactgaaatgttatttaagaaggaagaaatgctgtgttagggccacgtcgcacgcacctaatcatttacctttctctggtaactttcatttcctcatgtaacccacccccacttctctgtcacctctcccattgatttccatttttgtacttcatatttctcctctttgtttttctttgaatttttctccactgcagtgtattggacagttcatgtgtgtagttctacgtatgaatgtcctgacgctgctgttagaaactaccacagactgaaaggtttaaacaagagaactttatcctctcttagtccgggagaccagaagtttgagatcaaagtgtctcaggactgtactccagggaaggatcctttctgcctctcccagttcctgggggctccagcatccctgggcttgtggccacatcactgcagtctctgcctccaccttcatgtggccttctcctctatgtctctgtctcctcttcagtctcttagaaggaaggccacctgtcattggatttagggccatcctaatccaggacgatctcatctcaagatccttcaattaatcacatctgcaaagaccctattgctgaataaggtctcattccaggtctgggcattaggacgtggacagatctttctgagggccacagttcaatccactacacgtgtatccagttccctctggaggctctaggggaggatactccctgcctctcccagctcctgggggctccaggcatccctgggcttgtggccgcatcactgctgtctctgcctctgtccccatgtggccttctcctctgtgtgtgtgcctcctcttgagtctcttatgaggatacctgtcattggatttgggcctaccctgttccaggatgatctcatctgaagctccttaattctatctgtgaaaaccctgtttcccaataaggtcccattcacaggttgttggggtaagatcatggatgtatctttttggggacctctcattccgtccactccactgaattttgttaaggtcaggaagtgatttggaatctacaggagaattatttttgctcatggacatttctgataatcaatgagggtgtcatttgaaagctccgttttataaggtatttccgttgctagcatacctgaattagaatatcttaagtcaaaagaagctaaatggaaaacatgactttgagccaatatgagtatctgtcctgatcaatatgagaaaatctcagaagtacaacttgtgccacggacatgtaagtgtctagtatacacttactggttgatgaaatggtttggctttgtgtccccacccaaatctcatgtttaaatgtaatccccagtgttggaggtgggacctggtgagaggtggttggatcatgggagtggtttctgacagtttagcaacattgccctagtacagtctcatgatagagttctcaggagatctgatggttttaaagtgtagtacttgcccctttgctcgctttcactcatctgccaccatgtaaatgtgccttgcttccccttcgccttccaccatgattgtaagtttcctgaggcctccccagccatgcggaactgtgagtcaactcaatctcttttcttttcttttttgttttttgagacagagtcttgctctgtcgcccaggctcgagtgcagtggcgtgatctcggctcactgcaagctccgcctcccgggttcacgccattctgctgcctcagcctcctgagtggctgggattacaggcttccgccaccacgcctggctaattttttgtatttttagtagagacagggtttcactgtgttagccaggatggtctcgatctcctgacctcgtgatccgcccaccttggcctcccaaagtgttgggattacaggcgtgagccaccgcacctggcctaaatcttttttctttataaattacccagtctcaggtagttctttatagcagactgaaaatggactaatacagttgacttctagatgttcttggatttatcttggtctttgcagttttaagtatatatatttttttagtttgtttcacatattttgaacatttctaggtattagtaaagtctgctggtttctgcagcaggactgtaatctttttactacagtcaacaaagcatagtatgacaatcttgtttttacacatgcaccattttcaaggctgtatttgcatgtatttctgtctttttcctggtctccaggggtcaagaaatggttttcttggggcaaagagcttcggtcagctttgcagactacccagtctcagttacaagtacagactctgctcctgcaccttaaaaagtagtcacatagtgagaccgcatccctatagaaagtcaaaaaattagccagacatggtggcacacacctgtggtccccgctacatgggagcctgaggtgggaggatggcctcctgggggaggtcaaggctacagtgagctatgattgcaccactgcactccagcctgggtgacagagtcaaaccctgtctcaaaacaaaagaaaaatatgatatctcaggctctttcatttggcctgtacacatttattgagcacctgttgtgtgccacatactgttccatgaatgaggaatataaagaaattcagtaatgggtgtggtggctcacatctgtagtcccattactttggaaggctgaagtgggaggatcacttgagcccaagcgtttgagaccagcctgggcaacatagtgagaccttgtctctaccaaaaattaaaaaaaaaaaaaaaacaaaaccctggcgtggtggtgcagacctgtagccccagctgctcaggaggctgaagtaggagcatagcttgagccctggaggtgaaggctgagtgcactgagccaggatcacgctgcagtactccagcctgggggcaacagagcaagaccctgtctcaaaaaaaaaaagtagttcactgacattcacttgcagtttattgaggatgccttatagtgccgtgcaagcaggctcagtaccgggctggacataatcaggtattgctcgtgctgtagagtgaaggaagcctcgagaaaggtgtcctgttcttggccatagtggcgtattcaccactgtaaactttattttaacaattattttatatttcatttcatttatgtactccatctctctctgtcacccaggctggagtgcagtggcacgatctcagctcactgcaacctctgcctctcaggttcaagcaattctcctggcccagcctcctgagtagctgagattacaagcaccggggaccatgcccagctaatttttgtatttttagtagagacgggtttcaccatgttggccaggctggtctggaactcctgacctaaagtgacctgcctgcctcagcctctcaaagtgttgggattgcaggcatgacccacagcatccagcctattttatattttattttattttgagacaaggtctcactctgtcacccaggctggagtgtggtggtgtgatcacagctcactgcagccttgacctcctgtgctcaagcgatcctcccccctcagcctcccaagtagctgggaccacacatatgcaccaccacactcagctaatatatatttttttaagactgggttttgccatatttcccaggcttattttattttttaaattgacacataataattgtacatattcatggggtagacagtgatgctttgatacaaagaatggagtaatcagatcagggtaattagcatatccatttcaattatttaccatttctttgtgttaggaacattcaatatcctctatgtatttgaaacaatacgacatgttattgctaattatagtcaccctacaagactatagaacactggaacatattcctcctatctgcttgtaattttgtatcctttaacaaacctctccctatctctcacttcttcccttcccagcgtctagtatcctctgttcttctttatcctttcaggagatcagcttttttttagctttcatgtatgagtaagcacaagtgctgtttaatgttcttttcctggcttatttcacctaacataatgtcctccagtttcatccatgttgctgccagtcagaggattgtattccttttcatggctgaatagtattctactgtgtgtagataccaccttttctttacctatctgctcatctgttgatggacatctacgctgattccctatcttggctgttgtgaatggtgctgtggtaaacatgggcgtgccgatgtctctccagtatcatgacttcctttcctttgaacagatacctagtaatgtgatggctgggtcatatgggagttctatttctagcttttctgaggaacctccatactcttctctatggtggctctactagtttacgttcccaccaacattgcgtaagagttccctttttggccaggcacagtggctcacgctggtaatcctagcactttgagagaccaagctgggtggatcacttgagcccaggacttcaagaccagcctaggcaacatggtgaaacccccgctctacaaaaaaaaatacaaaaattagctggcatggtggcagatacctgtgatcccagctacttggaaggctgaggcaggtagatcgcttgagcctgggaggcagaggttgcagtgagctgagattgcaccgctgcactccagcctgggagacagagcgagatcctgtctcaaaaaaaaaaagagttcccttttctccacatcctcaccagcatttcttatttttgtgtgtatgtgtcttttttttttttttttttaattttttttgagacagagtttcactcttgtttcccaggctgaagtgcaatggcatgatctcggctcactgcaacctccaccttccgggttcaagtgattctcctgcctcagcctcccaagtagctgggattacggacgcgtgccaccacgcctggctaatttttgtatttttagtagagatggggtttcaccatgtcggccagactggtctcaaactcctgacgtcaggttatccacccgcctcggcctcccaaagtgctgggattacagtgtctttttgataatggccgtcttaattgggttgagatgattgacacctcattgaggttttgatttgcatttccctgatgattagtgacgttgagcattttttttcatatacatgttggccttttccatgtcttcttttgagaaatgtctgtgaagaccacctgtccattttttaattggagtgcttatcttttcgctcttgagacatttgagttccatgcttggtcatggtggtggattcaccccggtaaacatgagagagcattgctgtccagtgtttagtgcacagttaaggaatgggctggtggcccctcaataagatgcccaaaggagttgccttctgctcagcagacgcctctcaaatggtctttatattctctccaagggagcttcccctgcatcggactgtggcacacgatgccttgcctcttagaaccatctgactgtcacgtgctttcagatcgtgacaacttcagtgtgcggggaagagcatgtgaaataaattaccttctgcctgtgtgaagcagaaatagctatcgttacaaagcagggatttttttccatgcttactccccactaaaaatacatgtttgtttttctaacaggtttcctccgttttttgatgacaacccgtttggcatttatcagaaaattcttgcaggcaaaatagatttccccagacatttggatttccatgtaaagtaagtaaaccgtttgcctcatcatgaggtgtgtttatttttaaagtgtctaaaatcaccgtgaaagcacgcactcagcaggataccatattgtgttattaaatgtgctgcgcataaactattttggacagttgtcttttccacaagaaaagaaaaagattttcagtattctactttaatgatagcttcacattttaatgagtcttggccgtattgtgttcttttggtggtatgttatatttaaaatgagccaatgaacgagtttgtcatcgtattttataagagagcagttttggaatttgacaagaaggatcctcctagttctgtggctaacagaactgttgatgggtttagcagagttttatcctttctctcctgcttaaattatgctcaacctctaagtcctttttaacgtcaacattttcagttctgagcatgttgcttcaaggatatttacagttgctggatattggcaactttggatgcacattttataaaggtcgtggcagtagggaaaaaatatattattttcttaaatataagaacgcggctgggcgtggtggctcatgcctgtaatcccagcactttgggaggttgaggtgggtggaacacgaggtcaggagatcgagaccatcctgggaaacacggtgaaacctcggctctactgaaaatataaaaaattagctgggtgtggtggtgggcgcctgtagtctcagctacttgggaggctgagacagcggaatcgcttgaacccaggaggcggaggttgcagtgagctgagatcgcaccactacattccagcctgggcgacagagcaagattctgtctcaaaaaaaaaagaatgcttttggttttctggctaccttacccaatctggtcaactggtagccatttttactgtaataagcactgatttctgtttgtttcactgtatttttcagatgagttgatgggtgcaccagccccctgggcacaaactagagctaaatgcatctagttgagaattaaactttttcttttccatggtctattttcttatgagccggtggaagttcagttcagagaagacttatttcagggcgatggagcaggttgttttgaatatgccccttatggggccactggctacgttcagttgagtttcttggtggtgaacgcaccccatcctaaccagaggttcttagtctgaacagaagataaggtcgtgttttattggcttgagcatgtgttgtgtttgacacactaagaggcaggctttaaaagactttagcaagaaaacgaggctccgcttaacaatgagtcgcctagaagggacaccctgtccagtgaatggtaagacagggaggtgtcaggggaaacagcacctcagaagccgactgctctggaaggaaatagaaaggattatatagaacctctctctcaggccccaaatcccatctgagttgagtgacattatattaagtggatggcaaagcacttttatgatcgagtttggccaggtgaggtgctcatgcctgtaatcccagcacttcaggagcaatccgaagtgggaggattgcttggggccaatccaatagtttgaggccagcctggacaatgtagcaagaccccatgtctacaaaaaatttaaaaattagctgggcatggtagcaagtgcctgtagtcccagctactagggaggctgagatgggaggactgcttgagcccaggaagtcgaggctgcagtgacctatgattgcaccactgcactccagactggatgaaagagtgaaactctgtgtcaagaaaagaaaaaataataaaattaaaagatataattatatatatatatggggggggtttccaatgttctgtggaaacaacaacaaaaaaaggaattgcagaaatagaataaaccagaagcgtaatcaaagtctggtctcttgccacttgtccttctttctctcctagtttatcttctttgagagtagggaaccagcagcgaccatcttggtactgtctgatctaacatgcctctctttatgcagctcccagccccttccagtgttccccacagtgcccctgtttctttacatacccagtgtgggttccccaagagcagaaacagtgatagatagaagtgaactgacagttcacttcttcccattatttgttaaatcttatcaaattggctgagaagcaagacctcaatgactcatatctttcctttttttggtagagatgggtatggggatcttgctgcattgcctaggctgcttttgaactcctgggctcaactgatcctcctgccttgtcctccccaagtgttgggattacaggcgtgaaccactgcacctggccttaatgaggcatttttcttatccaaatcactgtccctggttgtccatgatgctagaattttgattctctgctttttaaagtcatatgttggttcctgcaacttttatcatttgaccaggtaaacatgtcgcctgggcaaatggcacatcaggattgacattccttatagaaataaatatcatttaaaacaaaacaccaaaacaaagctttgggacttgttgccaattcagtagaggtattatctgccggtgttttttacaacacctgaaagtacctgcatctgagaggagccagctggtgccaggatcgtaaataaaatgtagaattttggctacagtgcatcaaaagagtgccggcagatgtgtcgcttatcccggggtcaagggacccatctacagctgtggacacttctgtcgttcctttatagggctttgcatcttcaggggcctcttctcatccatactctttactttctagactgctttataagagtttgctttggtattttactttttcttttaaagagacgggtgtcttgctctgtcaccccggctggagtgcagtggcacaatcatagctcactgcagcctcgacgtcctgggctcaaatgacactcccacctcagcctcccgagtaactggtgctacaggcatgcaccaccatgcctggccaatgttttgatattttgtagaaacgagggtcttactatgttgcccatgctggtttcgaactcttggtctcacgtggtcttcccacttcagcccactgcatagctgggattacaagccactgtcccctgtattttaaataaatcttcattttcttacatgccaaacaccaaaaaaatttaaaaaaaaattcaaggtcatcaaacattttgttttcttacatgacacacacacacacacacacacacacacacacacacgttgaaatttatcaggtgatcaccaaaacattctgaaataaacatagggctttttttcccccctataatttacaccactgcctgccccattagcgtatacacttaaagctgattggactgggattataagaaaacaaaggtttatctaaaatataaaagcataaataaacctgtcttataattgcactccagtgagctttaagtgtgtgtggtaagggggcaggcagtggtgtaaatcacgtgggggacgaagccccacatttatttgggaatgttttgggggtatagtgtttgataaccttgatttttttttggcaggggggagcatgtcaaaataatgaaggagaaactcactaagtagtggaaaggtttctaacttttaggtgatttttatattccccatcctgctcaaagcttttcagccttacaggatggatacaaaatcctagccttaggtgggcggacagatggtctctgagttttactttgtggcagagaagcggtgaagtctgacaagcatcccatcctaattcagaaagcatggtggcaggaaactgtaaaatttccgatcagacagcactggcgagattcacaatctagatggtggagtctgaccctaggacgtcacctggcttgtcggagactccacagtctgtcacagaacctgggagtggctcagtccaagttcgtgctacttaccttggggcatagtttatgctgggaaagcctagacgcttacaccggggtcatgggtattggattgttttgggggacttcaatatattatattattatatcatattatgtatgttattatacataatgtactctgtgtattttatgtgtacacacagacacacatgatcatttctacttccataaatatgcatcttttagaactcacctaatctcctggaagtcttcaacatcatctccaactacccatcctaattgaagcagcttgctgttttttgttgtcgttgttgttgtttgtttttgtttttttttgagactgactctacctctgtcacccagactggagtgcagtggctcagtctcagctcactgcaaccttcgcctcctgggttcaagcggttcttgtgcctcagcctcccaagtagctgggaccacagttgtgtgccagcatgcccagcgaatttctttttctttttttttgtagagatggggtttcaccatgttggccaggctggtctcaaactcctcacgtcaagtgatccacccgcctcggcctccccacagtgctgggattactggtgtgagccagtatgcccaacctccccacctgctgtacttctgacatggtctgttatttaaaaggaagattataagtgaagaagcagacttaggagactcatcctaatgtgtgtgcttatgggaaagccagccttttaaaacaggaatcccatcaataagcagacccccaggacagcgcgtgagtgttgatgttggtgaaagcagatgtcttctattttgcagggacagcctgacaggcatgtttacgttaagtgtctggatcctccctgcaggcacatataaatttcacccttttctactcagaggtgtattttctttacaaagatgtaatcaacccccttcccttagcttcagccttgcacggggcaacccagccttgcataggtgatttaagagccggtgatggtaggaaataagcactagaaagtgttttgccaaagtggaaattgaactgcggtcctcatgtcagatagatcttatctctgttgccatgctgcgtttgctgatgttgatatataatctgtgtactttttttttttttgtctccttccccaacatagagacctcattaagaaactgctcgtggttgacagaacaaggcgattaggaaacatgaaggtcagtatttgatcccgtgggtattcagtggtacccgatgtgcgtgtctgccgtctaacacccacattggcatgtgcaggtataaaccaaggcttagcggtcgtatttaatcactgcccaaatttcaaatctggtgttttatttatttttttaaattttacttgaaactgccaggaaagatctatcaaatctcggtttctgggcccacaacgtcaaactgggtctacaccgtatctcccctcccctcaagcaaggttaatagagcaataacaatgtataagttattactcattattttgtttacttatttattttattttttaaacagttttacggagagtgaattcacacgccatgccatttacccatctaaaatgtgcaattcggtggcttttagtatacacacgattatgtacagccacccctgtggttaatcttagaacatcttcatcagttcaaaaaaagaaaccctgcacccttcagttatcactgtgctattctttcatcctctcttgccctaagccagcggtccccgacctttttggcaccaggggccagttttgtggaagacagtttttccacagaccgcacaacctaaatcccttagttgcgcagttcacaatagggtgtgtgctcctatgagaatctaatgccactgctgatctgacaggaggcggagctcaggtgctaatgccagccatggggagcagctgtcagtacaggtgaagcttcgctcacctgcctgctgctcacctcctggtgtgcggcccattttggttcctcataggccgtggaccactaccagtttgtggcccaggggctggggacccctaccctaagcagccactaatctactgactttctctgtagggttcggtgttctgggctctgctaaaaatggaattgtacaaaatgtaagcttttgcctctggcttctttctctgagcacgatgtcttcaaggttcatccaggctgtagcccgtgtcagagcttccttccttttcctgactgcatagtattcgattgtgtgggcagacctcgttttgtttatccattcatctatggatggacatctgggctgtttccaccttttggcttttgtgaatggttctgccatggacatgagagtaggtgttttgtgtgcgcaggtgatgattttaaaagttgtgcatcaggtatgatttccacaaactttttgtgtggaggcaagtatataattgacaaacagactattccttaagtagtatcatacctgatatgcgtgttttgacatccctgaatttgacagaattcatggactttttgttggccatttctagctctggacaacctcagagggacttatacatggaggaacttccatatacgtcttgaccctgtaaattacagtctggagagacacagtacaccggggtgtgaggcttgaaccacttggctctcttggggccctctgtgtggtttacgagtctccagtagctgccataagaactgaccacaaactaggggcttaaacaacaggaatttctgctttccccatcctggagacgaggagtctgagatcaaggtgtctcaggcctccagaggctctaggggaggatcattcctgcctctcccagcccctgggggctccgggcatccctgggcttatggccgcatcactccagtctctgtctttcttcacgtggccttctctgtgtctgtgtctcctcttctgtctctcagaaggatgcctgtcattgggtttagggtcatcctaatgcaggattatctcttctcaagagccttcccttaattacatttacaaagaccctatttgcatgtagggttccattcccaggtactgggagtcaggacatgggcatatattttgagggccactgcccaatgtgtgataattgtgtctgcttcctgctagaggctctagtgggggatccttcctgcctctcccagctcctgggggctccaggcatccctaggcttgtggccacaccactgcagtctccacctccattttcacatggccttctctatgtttgtgtctcctcctctgtctcttatgaggacacctgtcactggatttagggcccacccttctccaggatgatgtcatctcaagaaccttaatttagttacatctgcaaagaccctatttccaaataaagtgatattcacaggcactgggggatagggatgtgcacatatctttttgagggacattgtttaccctataacagtagtcaagcttctgtcctttacattatttgcggacagcaacgggataccttcaggtctccgaggagcctatccagccaggttgcacggtgtggactcatctgtgccacggctcttcataagattggacgagtcctgttttaatgccacagccatttagaaaagagctgggtctcttgctgggactgcagggaatcacagacgacccatatctagaatctgctgggaatggcgtagtgaccatcataggtaccttccaagggggaagaacaagtttcccaatcaaaggaattggggaaaagctcacaaactcccaagctaggtcttaaagtctagttaaagcttcctgatatggagataaactgaaagagactcaagaaaacactgactttatattttttttaaattaacacatgaaaatggtattatttagcatgtacaacatgaagttttgaaatatgtacccattgtggaatgggtccattgagttcattaacatatgcattacctcacataattaccatttatttgtggtgagaacacttaagatctactctttgaaaaaaattgtttttaagagttggggtcttgatgtgttgcccaggctggtctcgagctcctgagctcaagtgatccgcccaccttggcctcataaagtgctaggattacaggcaagagccactgcacccagcaagatctactcttccagagattcttgagaatacatcattagttatagtcaccgagctgtgcaagccactgactgaacttgttcctcctgtctctctcactttgtctcttttgaccaatgacttcccatctcagccccttcccagcccctggtatccaccattctactctctgcttctatgagttcaacttttttagatttcccatgtaagtgaggtcaggcggtatttgtctatctctacctggcttatttctctctctctctctctcttttttttttttttttttgagacacagcaaggcggaggttgcagtgagccaagatggcgccatgccctccagcctggatgatggagtgaaactctgtccattgccccgcccccccaaaaagaacatagagtatagtaaatagataaaccagggacatagtcatttattatcattaccaagtattaggtgccgtaggtaacgtatgtgttagactgttacacgcctggcagcgtaacaggagggatgcattgtcctgtggttacaatggccatggcgtcactaggggataggagtttttaagatcattataatcttacaggagcaacactgtatatgtcatccattgttgactgaagcatcattttgaggctcatgactgtagatacacacccacacacacactttttttatttttattttttcaagacaggatcttgctctgtcatccaggctggagtgcagtggtgcgatcacagctcactgcagccttgacctcctggcgtcaagtgatcctcccacctccgcctcccgagtagctgggactcagtgcatgcaccaccaaggctggctaattttttatgtttttttgtagagaccaggtcttactttgttgcccaggttagtctcaaactcctgggttcaagcagtcctcctgcctcggcctcccaaagtgctggaatataaacgtgagccactgctcccacccccctcacacacactttatataacacacacacactagtttggatactaatgtgaatctcggtatatacatatactttgtactctacatataaagtgtgtaaagtacatatgtatatgtgtatatatatatataatacatgtgtatatattaacgtgtatgtatataagtatgtgtatatttaatgtgtatatattaacgtgtgtatgtatataagtatgtgtatatataaatatatgtgtgtatatattaacgtgtatatgtgtataagtatgtatatattaacgtgtgtatgtctataagtatgtgtatatattaatgtgtgtatgtgtataagtatgtatatatcaatctatgtgtgtatatatgtatgtgtgtgtgtatatattactatgtatgcatgtgagtatatacagacacacacatcctttagtatccaaattagaattttatctgatggataaaatttattttattctcttattcacagcactcttatttattcttattcacaacattgctgaagggaaaactcaacagctattgtttgttgcctgacttagctatagatcaaaaatacctgttttgcaataagaaaagaaaaagttgtcaaaacaactggatgggaaaacaatagaaaaaattcacattactgtttccttttgaagatatggtcgtggacgtattcctctttaaggataagaaatttgaaactacagtaatgctaactgatagacgcgttaaattcagatgtactggcttctgtttcatggaacctacgtttatttcttctgctgtcccacatttaattgataacgacatcactacaagtataagaaaaggaagcagagtgaggtttacggatgagcacttgggagggatttcagaggtcgtgatggccacagtgtgagccagcgatgcctggtgctacccttgagcatgaagcaggccgacttgaacgcaccttgttaattgccaggccgtgcaatgtcgttcctaaggtctcttaaactggacatccttggtttgagttcccagtcttgttatttacttgctgggtcctacggagcaaattaacatcattccttgaaccctagtttctatgtctgtaaaatactgagtaagtttgccaagatgaaaacaggagacaaactgagaaactactggctgtccaattttatgtcgagagatggaatcgtatttacctttttcgtctttggtccggaatgcaaatgcattgcacaggagcagaatgactggatttgtttctgcggcaaaaaagggcaaacaaaacactaacagctttgcttgcaggttttcctggcagctcaccctccaggcacagttctccaaaatgcagcaaacttggtctgtttgtttcaatactaaaataatgtagagattctttggggtatttttctttcctgccctgtcaaaattctgtacgctgacgacatgtgttgtttcttttgaagaacggggcgaatgatgtgaagcatcatcggtggttccgctccgtggactgggaagctgttccgcagagaaaactgaaggtacaacacatatcagtgggtgactcagtatgcccgagctcttccattagcagggactgcctctgaatcctgggacttctttattgatggctgacatgtgattaatttatataatacaactatttgtctaaaactgttcataagccaagttccccactctttgagtgtcttagtgctaaccatctacctagctcccacaaaggcaggagccaccacacccagtcatataccacatgttctttgtccattcatccctggatggacacttatcccagattttgaagcagattttaggagacctggcctgattcctgactagctctgtgactgctaaaccctactccctcctctttagtggaaagcggtcaacaggattacagagataagcaagcgtctagcaccatggtcatcattcagtgatggtggtgtattacatggagaatattctttggaacgtttctggccaaactgcctatttttaaacatctggctttttggctgggtgctgtggctcacgcctataattccagtactttgagaggccaactcaggcagatcactggaacccacgagtttgagactagcctgggcaatatggtgaaatcccgcctctacagaaaataccaaaattagccaggcgtggtggcatatgcttgtggtaccagctacttgggaggctgaggcacaagaattgcttgataccaggaggcggaggttgcagtgagccaagattatgccactgcactccagcctgggcgacagagccagaccctgtctcaaaaaaaaaaaaaaaaaaaaaaaaatctggcatttttttcaatgtataatacttgtccattttataaatgaggagactgtgctcagagaagttaagcaatgtgtggaaggttacacagctgctaagcagtgtaactatcacaggtacatatttatgggggtacatgttatattttgacacacgcatagaatgtgtaatgatcaactgagggtaaccagggtatccatcagctcaaacatttatcatttttatgggttgggaatattgcaaatctagctattctgaaatatacaatatattgttaactctgcccacccaactatgctgtcaaacactggaacttattccttttatctaacattatgtttatgcaatatttcttcatctccccttcatcccctagctatacacacttcccaccctctggtaactatcattctactctcaaccttcatgacatccatttttttagctcccacatatgagtgggaacacgctgtgtttctcattctgcgtctggcttagtttattatttattatttattttttgagacagcgtcttgctctgttgcccaggctggagtgcagtggcacgatcttgctcactgcagcctccacctcctggcttcaagcagttctcatgcctcagccccctgagtagctgggattacagacgcccagctaatttttgtatttttactagagacggggtttcaccatgttggccaggctggtctcaatctcctaacctcaagtgatccaccagcctcagtctcccaaagaagtgctgggattacaggcatgagccgctgcacccggcctggcttagtttacttaacatgatggtctcccattccattcgtggtgctataaatgacaggatttcattccattttatggccggatagtttttcattgtgtgtatggaccacactttctttatcctttcatccattggtggacacttaggttgattccatatcttggcttttgtgaacactctgaactgcatatgttactgatgggagtggtcaatggtagtgttttcacctttgcacttcagagttaaaagaatggagaatgcttagaaatgcttattcctagtcctcagctcagaccagagtttctggggctggagcctgggatgatacgcttcttttttttttttttttttttttttttgagatggagtctcactttgtcgctcaggctcggggtgtagtgcagtggagtgatctcaactcactgcaacctccacctcttggattcaagtgattcttctgcctcagcctcccaagtagctgggattacaggtgtgcgccaccacatccagctaatttttttgtgtgtttttagaagagatggggtttcactatgttggccaggctggtttcgaactcatgacctcaaatgatccactctcctcggcctcccaaagtgctgggattacaggtgtcagccactgggcctgggctgatgcatcattttgttcaaagttttaccttttcaaatactttattgtattaaattgcattaaaaaaacaatttgaatacgttttatctatccacattggtcaaaaaccaagtcaatattaaaacagatatattgccaagtctccctcttaccccctccaagccacctgtaggtaatcaccttttattgtttttctgtgtatccttctagagtttctttgtgctaataaaaacccacatggatacatgcattcttatttttgccactcatttatacaaatctagagtagcgtagtatgtacattattatagtcttgctttttgcacttgactatataatctggagacctgtctacatacctggctagcttcctcatttttttttttttttttttttttttttttttttttttgagacgaagtcttgctccgttgcccaggctggagttcagtggtgcgatctcggctcactgcaacctccgcctcccaggttcaagcgattctcctgcctcagcctcccaagtagctgggattacaggcacccaccactatgcccggctaatttttgtcttttcggtagagacagggtttctccatgggccaggctgttctcgaactcctgacctcagatgatcctcccaccttggcctcccaaagtgctgggattacaggcatgagccactgcgcctagccagcttcctcattttaaaaaatactgcattgtattccatcacatgactgtaccatagcttacttaatactatatatatatattttgagacaggatctcactcagtcattcaggctggaatgcagtggtgcaatcatggctcacttggagtatcgacctcctgggctcaagcagttctcccacctcagcctactgagtagctgagactgcaggcacacagcaccacacccggctagttgtattttttgtagagacaggggactccctgtgttccccaggctggtctcaaacttctgaggctcaagcaaccctcccgcctcaccttcttaaagtgttgggattacaggtgtgagtccccacacgcagcctcattcacaatattttaattcaaagattgccgctttcataaatgaagggaagacagctttagtgttttgcaaatcattttcatttttaggtacagtgacagaaataaagcggtgtgtgcagcatccaagtgtcccgtccctttctaaccatgcctttgtgcttcggccatgtctcacagcctcccatcgtgcccaagatagctggtgacggcgacacttccaacttcgaaacttaccctgagaatgactgggacacagccgcgcccgtgccgcagaaggatttagaaatcttcaagaatttctgaggacaggagctcacatctggaaggtatatctttatatttagtaattcccaaaaaatgagactgactcgaccccacatccaggtgaggctgcgtttactgagtggggcttaacctcatgcacacagaggtcagcagtgaagcagagcaaaggggattgattgcaagggtcagcgaaataaacacagccatgcctgtgactccaggtcagcatgtgaccgtcagaggcatcagcatgacagtccagaatccatgttctgcatcagaacctgcatgtctaaataagaccgctaggtggtttgtgtgtgcctgaatatttgagaagcccagctcctctggtccctgttccagaaaccctgagtgacaggcgagcttccttagaataattaacaagtattttcaaaagtctctttaggtctcctttggttaaaaaataagaagaagaaatatgccctcataggaaatttgctaagcttaattgaagatgactggaaaaggattttgagtctattacttctttgagcctttgaaggtctattattagtttttaaataataataatattttttagaatccctcatgaaatttgctaagctttaatttaagatgactgaaaaagggttttgactgtgttatttccttgagcctttgaaaatctattattagtttttaagtatggattaaaaagagctttcagttactcctcaattctaaattgctcggttatatggcttcaattagatctttcttcctgtaacacacgagcaagaaacataccagtgaagcaaaatattgtcagtgatgtgtctattcattgacatagcttgtttttcccattttgatttccattcccgtaattttcctgtagtcttcccagttatgtgaagtggaaagccaattggctaaccaacaccattcgaaacagacaccaaatgtcacaattgctgactggggagaggaaccaacctgctgaaagacgtggtgaatgagagccctccatcctgggcaggtgtttacatggatgtaccaagaggaaagctggatacaaattgaaataatagacaacaaaatgatagaggaataggtggctatgacctcgagaagataacctgtctccatggcatggcttcacctctcagtgtgtgatgaacgctttcacagtggtgactggtttgtattaacatgagagcgtgtaactttaccaacttcataaacgctcatgaaatccagttgcgggttttaaaaatcataagatgttcctgaatgtgtttacttctttttgtttctctgctctactctggggcttacattttagctgactcgcccataacatcttacaaattgtgtctctccaggaaatctttaaaatgatgtaaagacttggtttgctttagtatgaaggacccctagttgataagccacaaaaatagaacctttctctaatagagacccctcaattgtaaaatttacttaaagaacaaaaaagcttccatttgatggatttttgtcatataatcagtgaacaatttcattacatcctgtccccagctgcccctactttccctgaaaaagattccacacgtaggaataacctttctccatctggtatgcattgttgagaaagtatgtgtaagtaagtattatttttgctaagtggaatcatttttaatatagtttggctagtggttggggctctgtttaatgaatttttttttctttttgagacagagtctcgctcggttgcccaggctggattgcagtggtgcgatctcagctcactgcaacctccgcctcctgggttcaagtgattctcctgcctcagcctcccgagtagctgggattacaggtgcctgccaccacaccaggctaattgttttgtatttttagtagagatgggttttgccatgttggccaggctggtcttgaactcctgaactcaggcaatctgcccacctcggcctcccaaagtgctgggattacaggcatgagccactgtgcctggcccagatgcaatattttaatccgtcttagtaattttatcaagtaatttgcacaccaaacacatccctggcattttcagcaacgagcgattagttgcaggaattttatgcaggaagatatttcttcatgaagccaaatcttctcctgtaaataagacaccagttcagatgaatcactgcacttgagggcagcttagaaactatgctgtagccgttcatctttgtttgaatcaccctgtatgcctttctgaatgtggaggaggaatttaagagaactgactcactatgtcttttattttactttgtaataaaatattttctgtcttgctgtaaggttctctgaggaagcatgttgaattggggatcccatttttcttgtgcagttcatcatctattggtggatacatttatctatttatggataagcgtatgatagaacattcttcaggctggatgtggtggctcctacctgtaatcccggcactttgggaggccgagttgggaggctcacttgaggtcaggagtttgagatcaagcctgggcaacatagtgagaccccatctctacaaaaaataaaaaagttagccaggcgtagtgatacatacctattgtcacagctattctagaggctgaggtgagaggctcgcttgggcctggaaagttgaggctgcagtgagccgtgattgtgcctgtactccggcctggatggcagagttagacctcatctcaaaaatgaaaacagggctgggcgaggtggctcatgcctgtaatcccagcaccttgggaggccgaggcgcatggatcatctgaggtcaggagttcgagaccagcctggcaaacatggtgaaatcccatctctaccaaaaatacaaaaattacccaggcgtggtggcgggcacctgtaaccccagctactcaggaggctgaggtaggagaatcacttgaacatggaggcggaggttgcagtgagctgagatcacaccactgtactccagcctgggcaacaagagcaagactccgtctcaaacaaacaaaccaaaaaaaccccttacctttaaaacattcttcatttcctttttattggcctctccttttagaattcaggcttatggatccttgcaaaaagaattacaaagagaggttttctttgttatcacttagggaaaggaaacctttgtattatcattgagatgatgattacaaaattcatccagttactgagcaactcacagaatcttttgtcctatttcatgctagaaacaggaagattggaatctgcctggaacaaagaactgcacctaagcagaccagaagcaaaatgtcttcttcacggcataaggacatctccacttttctctgtacctgtgtgtatagaaatagattagagcacagttgaaattcatggaactggcattatttaagcaactggaattccacactgtaggaaggttttgaaaattgtttggttgtagattttatcttatcctttagtgttgtgttcctactgtgatgtcttggtttttgtcatagacttaagtttataagtttgaactggacttgttcgattataaccacaaattgtgtgtgtgtgtgtgtgtgtgtgtgtgtgtgtgtgtgtgtgtgtatgcctgtgtgtatatatagaagtcattatggcagatgcacagaaattgtgcagtgatgtaaatgttcatactttacagagcctataatttttatttttcaatttgttttttcaaaaatctcttctcggggacaacatctgaagggtatgttgcatgcattaaaaaaaatcatctcacatgcattttatagttttggggaagaaaatatcatggggaggtctaccttcagtatctttagtgcttcttacctggtaacttgagactttaaaagaagaaacaaagaggggaagatatgggagcgaatttattccaagaatctacaatgacattgaagttgttggaggaatgtactgtatttaaaaaaaccttctgtgacacattcaaaaatttcatctgagctggatgcagtggcttgttcctatagtcccagcactttgggaggctgaggtgggtggattgcttgagcccaggagttggagaccagtctgggaaacgtggtgagacctcatctctacaaaatacaaaaaaattagccgggcatggtggcacgtgagtgtagtctcagctactcaggaggctgagatgagaggatcacttgagcctggggaggtccaggccgcagtgatccgagatcacaccactgcattccagcctgggtgacagagtgagaccctgtccaaaaaaaaaaaaaaaaaaaagaaggcaatggctttgtgcttttgaagatggattgaagagaacgtccaccttaaggctttaaaagacagtgaagctgggtgcggtggtgcactcctgtaaccctgggactttgggaagctgaggcaggaagattgagcctaggagttcgagaccgacctgggcagcatagcgagaccccatctctatataaaaaaaaagatgttaaaacagtgaaattacagaaacagaacatagccaccctttttcatcagtgaccttttcttcacgtggaggtcaactcagtaggtgagaataattagtaggttcagcagaataaactctttacaattaataactcagtggaaaatgatgttcagatggtgaaatgtggaaatgttttagacaactctattttcagcctgtgcttctcactcaccatcctgttgggattaacagttgagggccatcgctgcctaaacatttagcgtgcggtttcccatcagttttaccgtgaatgtgaaaaggtgaaactggtgctgacttcggcagcaggtatactaaaattggaatgacacagaggagattagcatggccccctgcgcgaggaagatctgcagattcatgcagcattccatatttttttaagaaaaggttacactgtgcaccgacagtggagctagaaggaaaagcatgaagtctcatgtttgctgactataaaaataaatcatagtaataatattattgaacattctactttaaaaattattaataaaaccataaatgaaacacttgagcacactttaaaaagtacataaacccatgagtccatatgcctatttttaggttgtctgttttattatccaggatttcatactcagatgagaattagcatcaggaaagcctgaaatgccttaattgtgaactgatatgcaggaaaatgaaatatgcaagcacattggtgaccttgttctttacagacgtcgtgatcagcctccagccatacagaacaaatgagaaattagaagcgattccaagaacgtgtgatggtgtgaaacccactttggaccatcacacacatttcagcatttgaagtgacacaagctacctggtaactgcccatggcggggtcatagtttaaatggcccaatgtcatgtagaggttaatttaatcaaaatgagctataaacatggagcaatcactgtataattttaaaatagtttacctggccaggcatggtggctcacgcctgtaatcccagcactttgggaggccgaggcaggtggatcacctgaggtcaggagttcgagaccagcctggccaacatggcaaaacccccgtctctactaaaatacaaaaattaggtgtggtggcgggcacctgtaatcctggctactcgggaggctgaggcaggagaatcgcttgaacccgggaggcagaggctgcagtgagccgagatcgtgccactgcactccagcctgggccacagagcaagactccgtctcaaaacataaaaataaaaaaaatacaaatagctgacccgggtgggcattccaaaatgtccgcatggacgatcacgaaacaatcacggtgcgaaatgtccgcatggatgatcacgaaacaatcacggtgcggaatgtccgtatggatgatcatgacaaacaatcactgcgcaaaatgtggaggaaaattcattaccataatcacaacatttgtatcagaaaaacattacaaatttactttgcttcatgtaattttacgagttggcaatattttcttaaattggaatactctaagagaataggacatggatatgttacaagaagaagtgtattggggcaagtcttgtttttctgaagggaaatgccaccggcctgctttcataggcattgataaagccaggaaggaaataaagtcacaaccaaatagtatacactgtctctactgaattcttctaattccttcgcaacagaagtctaaatcctgcttagcctaaacatatctatagccagcgatgggcaaattatatttgctgtcagcatgatagaataagaagcagaaaccccccagcagtggggtaagattgcgcgcttcatcccctcaaaatgcagttcagccccactccctctccatgcccatcaaacaactgcacaatcacttgttactgaatttcccattcagcgttttgtttctttctgtccatacttaaagaccaaatcatttgtttgctttgaagaaaaagcaaaaacaagaacaaaaacaccaaatcatttgaaatcactgtccattaaaaaaaatcaccagtggaactaaacagttgagtggtttgggatgtgttcgccatttctgtgtttgacctacatggcctctaattctttggaccattgtaactgtgaaactatggcttaatactgttaaagaccccaaggctccactctgtagccaggtgcacctcaggctgcacaaataccccaccagaatgtcacaatcattcattgctccagctactgagtgaacagggtgcaagacagcactggcttgggttgtatttttgcagccagttaactttgcatcaggtctacacagtccttgcagcctttgatttctccagttgtagagatttgaaatggggtgcccgggttcctctcgtttttccttcaatctacctagcatgcattttacacacattggaggagtcgtatgcactgtttttctgttgctgatggaggcaagcaggccttctaattagtctaacttaaacggatgggattcacttaacaaaagcaagaagaaaagcacacgaacaggtgtcttaatgcatttggatagtttctttgcggggtgtgtggtgtgtgtgtgtgtgtgtgtgtgtgtgtgtgtgtgtgtcttggtgaaggtgaggggctgtattttcaccaagccttttcataatcaagtttgctttgcaaaccttatggccttgcaccccgcagaacagtcccttcctaatagcagggatgctctgtcatggttttctgtaaattatcgtgtgttgggaagttctgttgaggcttagtttgatcttccatggtggacacgtctgttctgtatgtaaaaggcattacaattgtgttttagcagatgagacttgaagcctttccacagtccttgtgctctgagatggctgttgagctctgctcaactgtcgtagctgaattctttctttgcgctgaacactgggcagcctcaccatgttgccaacgtgcttctggggcccctgtcactgccgccggatgccgcgcacacaggcagagtgccttggcaggtttgtgcaccccttggcgagccagaactgggaaccccgcggggtgaccccttctcatggggggtcggggaggggagtgcctatttttaatcctgtctgtttgttgcacaatggaaatcactgtgatttgtacatatgccctaggaaaattttactgctgtctaatttatgtaataatactgttgattccaggtttgtttaataaaactttgtatcttttcagaagtctgagtttcatctgcttctgtctccaaacaagctgtggcttttctcctttggtctaatcgagggatgggcaattatctgtaggggccacatggcagatattttctgcattgtgggacacacagtctctgttgcacagagtgcaaaaaagctgctataattaggcacggaggtgcacgcttgtaattccagtgctttgggagaccaaggcaggaggatcgcttgagcccaggagtttgagaccagcctgcaacgtagcaagacccgatctctacaaaaattagaaaaatctgtcagtagtggtagcacgagcctgggattgctcaggaggctgaggtgggagggtcacttgagcccaggagtttgagcctgctttgagctgtaattgtgccaatgccctccagcctgggtgacagaacaagaacctgactcttaaaaaaacaaaaatcaaaaagccccatagacaatacgtaaacaagtgggcatggctgtgctccagtgaggttttattgacaaaaataatcagagggccggatttagtccaagggccagcatttgctgattcctgttgtagtgtgatgttgactttgcagattggcttcacaggttgttaaaaatgtgctgccctcatcatcatgaatgaataaaatattttattgcttactcttattactcacatatttgacacccaggtttctgagtgacattcgcagcttgctaaaaacatcctgacttcgtacattgtaaaatcaattgatttgtaatttttgacactcacatagcacttgctattagcagaggctgaaatattacacccagctaagggtcaaacacaggcctgtttacttatgaccaagctgtccctggtcccatcttggaattccctggggaagggagtcttcccgtgggctggtatggctgttcagggtctggttcagggaccactcgggagtttctgtagcgtaggttcttggtgagtgacagtctgatttgggaaaggatacggagtgtgtgtgtgttggaaggctaggggaggggtcttgaaccccttcagcagaacaaacatgctttgtactttggggtaagatcgctagagattgtccagggttgtgtcagttatgtgtcatagatatgtattaatatttagccacaccctgttggagctctctgactttcctaggagtcaggctcatcttgtatacttattgaaaggatcagataaccttcttccgagggtatgaaggaaaatcatagttaggtggaccccctcatcttaacaagaggctgtctcgggtatcgctttgcagagatggacaggaattgctggagttttttgttctgttttgttttgctttgttttgcggcagagtctccctctgttgcccaggctggagtaccctggtgcaatcgcagctcactgcagcctcgaagtccttctctcaagcgatcctcccacctcagcctcctgagtagctgggactacaggtgtgcgccaccacacccaattaatttattttttatttttattttgtagagatgaggtctccgtatgttgcccgggctgatctcaaactcctggcctcaagcaatcctcccaccttggccctgcaaagcgctgggactgcaggtgtgaggaactgcagtatggggagcacccgttttctgtgggcagtgacatgcacactgttacatgtgtgtgcaacaaagttatccttcaatccttcaaatactgcaacgcgtgggacacctgcccactctaaccactgctaaaagacaaagctgttgacacgagaactcagcagaaaacaaaatcacagagctaaggtttccattccatctgctcctgctcacaccaaggcgctaaacaacacttcaataataaatatgtgttacataagcataacagaataaatatatgactataatatgtaaatagattaatgtatatttattacatattaatgtaataaatacattaatataatttatgtaatatat

SEQ ID NO: 12454 - DNA, 39715 bp, Human
  misc_feature (1)...(39715): n = A,T,C or G
aaaattattacattggaatcaggcgtggtagctcacagctgtaatctgtaatccctgcatttgggaggctgaggcaggaggattacttgtgcccaggaatttaaggttacagtagtgagctatggtttcgtcattgcattccagcctgggcaacagagtgagaccatatctctaaatacatatatatatgattactttggatttgagagtagagtcagagaatttagaggaaactaggctgtggttttcacacgatatttttctttgttgcttttgcctttatgcaaagttttcctttgtctttggagagtagaaaaactgtggatttttttttttttgagacagagtctcactctgttgtccaggctggagtgcaatggtgcgatcttggctcactgaaacctctgcctcccgggttcaagcgattctcctgcctcagcctcccgagtagctgggataacaggcatgagccaccacgcccaactaattttgtatttttagtagagacagtgtttctccatattgatcaggctggtctcgaactcccgacctcaggtgatcagcccgcctcggcctcccaaagtgctgggattacaggcgtgagccaccgcacccggctgcaaaagacatactttataaaggtccaaggataatggaaatagaagacattaatgtaatatgttcttgggaactaattggatacaccaagtattatctttgactagtttctggacctctgcttcattctgcaacctgcagccaactaccatggtgtccatctattattaggcgctttaaatagctccttaattcacatttactctcttcaatcgatgtgtcagactgtgggggccacttaattcccattccaaattcttgggaaaggaatttaattgggttgagcttaggtcaggggcttactgaaagagcaatcaactggggcccagggacagggtgcactgtgtgaatgaggctgctttttctgcaaatttgtcaagtagaggcagactggactagctacataatttgcagggccctgggcaacatgaaaatgctgggctccctagttcaaaagtttcattattgtttccaaaagtttgcaattgcagacaatactgcgattaataaacttgtgtatgtgtatttttccattgtcggagacctagcccgagtactattttctgcagcgagcctttgacgttgtttcctttttctgatgagccacagcatttatagtaggaatttgttcatataaaatttgctctttcgctagataccagtaactggacttctctaattgctttgggtatttcattggagttctgtatgactgagctccgggaaactcagtccacccctcattccaattctttttcacagtctttttcacagcgtccctgtcaacactgtttggtaaagggtaaaaccttagataataaggtttttattatcttaacacagacaggcctaacatatgttgtcgtacctttctgtaggatcaatagcatatctttacaaatgagaaataattttcacgagaccgaaacaccctgcaacgccacctacatacagggtaagtacgcgccttggtgaggtcagcggcgctacacacccgagcactaggggacgaccttccctggtttcttgcattagcaggacttgtccggaacctttcctgcggagtctgaggtagcccgcccggacaacgccgctgaacacacaacagggcaagaactagtaggttaactgtatgcctggaatttctacctcacctacatgttcccggagcaaataatcttaaattgtcgcgctatttaaagtccctagtgacgataacattgttgtacctcagcaaagatcataattaattgtttccgagagagtgtatgcttgattttggtcaggcatatatttgggcagcccacctgaaacgaacaaggaaggcgggggaagaaagcggaagccgcggggccttctaaggccgaaagtcttcggagcttgcggcagtctcttcgcggcgtccaccacttagacgcaagttgctgaagccggccggggagaaggtgttgttgccggagctgagaccgggcggccacagtccgcagggatgaacctcgagttgctgggtgagaagggctgtggctgcgttttagagaagcgttgggtactggaaaggagggaacccaggcgggaggggagtcaggctgcaatcttagggacactgttcggctatggatcactgggcacacctgatgtggagcagcagcgggaggaggaagcccaccttctgcccgagtaggttgcattgcccctcccgaggccactttcatatcaattatggagcgatggggacagacagtttgtgacttagctttgattatgaggatcgcaggtgttgaagtacccagagcagccaggaccagagttgttggagatggaatttgaagaagtgaggcttgggatgaagctttgaagacttgtcagggaattgggtgcctgaacaggttaatctttttgtagaaaagagaagtctaaggaggggacttggagatcttctggtagaagcttctcattgaacagatgaataaaggctcagagggtaatggctaggcactaagcaagtaaatggcatagttggcactggaatccaattatcctaactttctgtttaaggtcctttgctagggacggtgtgtaaaacactgaggtgtgaaatacggagggagttgtcttttgtcgccctcactttgagtcattgcctccttacctcctatccagattatttaaaaactgtaggtcctttctcctggacttccattaggtgacatttagcatggtattctaggggtagctgaggttttcaaggacttctgcactacttgctgttcctaatggttaggtttctcttttaaaaaagtcagaagatatgttaattgtcaaaagggctacaaagatacataaaaaatggtctttgcccttaaagagcttttcattaagcagggagtttaaggtgattatgtaaaatagctgtaggatattgcagaatgtaggcaggcctgaaagagtcattaccagttgctaagaatgtttggaacagagagtgaatgtctttggggtaaaggaagaagtcaaccaggaaaaacaaaccccccaaacctgtggaggagttggagttttaagtggacttttttttttttttttaagacagcctcgcgccgtcgcctaggctggagtgcagtggcacagtcttggctcactgcaacctctgtctcctgggttcgagtgattctcgtgcctcagcctcctgagtagctggtactacaggtgcgcactgccatgcctggctaatttttgtatgtttagcagagatggggtttcactgtgttggccaggctggtctcaaactcctggccccaagcaatccactcacctcagcctcccaaagtgtccggccttaagtggatttttaaggttggtaaaatatcaacaggctgaagtatgaaaatatgggagggatgttcagtaggcatcagtgagagaagacctaaagaattttcctgcttggccaggttgtggataaagagaatgccaggggatgggatcggtgccatctattttgtgttggttctcgaatgcctagctcaaaagtttgggctttttagggaaggtagggtagatccattgaaggattttgacttagtaactcaatcagagctatgagtttgtaaggtttgtctgacagcaatgtggagttgagttttggaggagtgtaaaaccagtttggaggggtagattatatgagtgatgaggaaggcctgagctaggaaatagaaaagacattgaggaggtagggatgacaaatttgagaatagattgcatatagtgctgatgagtaagagagtgacgtgaaaaatggtgagagcaaataatgatgctgttgataaagtgtaaggtcattggaaaaagacagctttggagaagctgaatgtggtctaggggtcaggagacaggtttggatttatgggagagatttgtattctttcagatgggctcattgaaaccttgtgaatagaggacatgatctagagaaaaagtgggagggggagaaaagaaaattgccaagcacacaatctgtagttagaggttaagaggaggaataagtggagataataagttagctaacggttataaagtactttctctgagctaggcagattttcaagtgccttccatgtattaatctatgtagaggaagaagagagtacagattggtgtggcgtcttcatagaagccaatcagagcagttgagtctgagggctgagaatgggttgctctgtttagtcctttggcagcttgggactcctcagcagctggaacagaaaccagattacaatgattttagaatggtgtgggagacaagggcaaaaggttgacgcttacttgtaaaaacttaaggatggaagaaaggtgataacgctagtactttgaaagagtagcaggatcttgcaaaaggcttttcttgaatgatacagaaggttcattaggataaaacttaggaaggaatatttatttttatttatcttttgagacggagtcttgctctgttgcccaggctggagtgcagtggcacaatctcggctgacagcaacttgcgcttcccaagttcaaccgattctcctacttcagccctcccgagtagctgggattacaggcacccaacaccacacctggctatattttttgtatttttagtagagactgggtttcaccatgttggccaacctggtcaggaactcctgacctcaagtgatctgcccaccttggcctctgaaagtgctgggattacaggtgtgagccactgtgcccagccaggaaggaatatttagcactggaaggttagacaaattaaagaagcctgggtccgaaagataacaatctctgaaaatgactctgcattttaaagtgagaaagttaatgattatagataaaaggaaaggaacagaagtaatgtgattgtggaagcctactgaaggacatctggccagatgaaggaaatgaatgacaatgtatttttaatgtggttagacaagtggctcataggtagacactagttttacttctgcaaccactttttgagtccctgctgtgtattcaccagtgtgcaccggagatataattaaataagatcatttgtcaaacttatttttaccacaaatcacagtaagaaatatatattctatcacagttcactatatatacctacacgtgtaactaagtttctcagaattatatttaatccttgttatgttcagtgttctctgatagtttcttttcttttcttttcttttcttttttctttagagggagtcttgcttctgtcgcccaggctggagtgcagtggcatgatcttggcgatcttggctcattgcaacctccgcctcctgggtttaagtgattctcatgcttcagcctcccaagtagctgggattacaggcgtgtgccaccatgcccaactaattttttttttatttttagtagagacagggtttcaccatgttggctcagctggtctcaaactcctgacctagtgatctgcccacctcggcctcccaaagtgctgggattacaggcgtgagccgctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtaatctcagcactttgggaagctgaggcaggtggatcccttgaggtcagaagtttgagaccagcctggccaacatggtaaaaccctgtctctactaaaaatacaaaattagccgggcatggtgccacatgcctgtaatcccagctgctgctcaggaggctggggcaggagaagcgcttgaacttgggaagcagatgttgcagtgagccaagattgcaccactgccctccagcctgggagacagaccgagactccgtctcaaacaaacaaacaaacaaaaaaaaccaggccggtcgaaaaacaaaaaaaaacccaaaaaaactaaaacaaagaaataaagagaatttcatgtttaatcaactgctatttgctgttgcaacctaaatgctgttattagtcaggaaggggtgtgatcgctgcttttgttaaaggtttcaaggtttcaaagagtaattgtgataatttgactgatatgaattgactcttgcctttccttgctctttttctttttgttttgagacggagtcttgttctgtcgcccaggttggagtgcagtggcacgatctcagctcactgcaacctccgtctcccaggttcaagtgattctcctgcttcagcctcctgagtagctgggattacaggtgcacaccaccacacctggctaatttttgtatttttagtagtagacggggctttcaccattttggctaggccggtcttgaactcccttgtgatctgccgcaacttggcctcccaaatttctgggattacaggcgtgagccaccgagcccggctccttgctcttaccttagtaaatttggaaataaattgtgaaatgcccaaaaggtgtgatggagaaagactgttgctaacttggatatgtcaacagttctcaaactttttagtatcaggatcctattatacttttaagaagtagagggtccccagagagtttttgtttatgtaggtgatatctacctaccagtgtttaccaatttagaagttaaaactgagataatatttttaaagcatattatatagaaataaccataataaatccattacatgtttatgtgagtagttattttgttttcaaaaacaaagtatttagtgaggaaaatgccactgttgtgacatttttacaaatctcttcaatgtttgcctgaatagaagttgggggacttctcacatctgcttctgccctcactctgtttcaatatcccaggtcatatagtctcaggaaaacgcatctgtatatttccgagataatgagagtaaacaagtcatcttagcaggatcttgaaaatccgtatggcctcatggaatgcctgaaagggcatcatatcccccttttcgttttgtcagccactgctatacactgttcgtgagttgtatgatccttgctatgtggtacatgtgccatcaactctttctttgctttgttgcagagtcctttgggcagaactatccagaggtaagagtatagtattgtggtgattttaggaacatagtaacttctgggtgtttatgttagaacagaaaatactttttgatccttgtgttttgacagagaagcattaagtgtgataatatatcttatgctataataaggagctagtgtacaattttgatcagggaggaaataggcaatgtgggctagaaatcttaccatgatgttgtaatcttacagttcattttcctttaaataaaagaaaaactttcattgaaggatttttcacaaacaccaccatcataggtttgtgcttttctcgttttgatcaatgtttttatgtagtaaagcaaaatgtatgctatagatgtgctttacttttttaattgtaaaactattttataacacttgaatgtttgaggatagacattgtggttattttaaatagcttggtattgatatgaaataatttgacttctctaatgttatgcattgtaggctattccagggtttttcttttttaattatttaaaaaattcttttaaattctttttgtttaaattctttttgttttaaattcttggaataaattcccagaattacaatgactgcatcaatagatatgactttttaaatacttctgttatattttgcccatttgccctccagaaagtttatacaaagttatagtagtgatgtaagggattgatcacatctgtttccagaatccatggttagctttaataaatgttccttcattttggctattttaatagatataagaagacacagagagattatttggtatgcagtgtaatttatattcaataaaagtatcacaagtgataaagaacctttaggaaataatttggatacctggctattgttgcctctattcttgtatttgtttcaatttttaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatggtaagacattttttaattaatatttaaatatgaggagaatgaatgatgactatatatttgcaaatctcattgtagatattttaatacttagatttttaaatattcagccattagtaatacagtttatcatggtttatgtagatcctgagtccatgctgtccttgaagcacctttcttgggagaaattcattgtattatggatctgtatcaggcgctgagaatatctcaatactgaaatgaaatattttcagattgtaattgtagtataattgtgatattgacttttcatttagaataaaaagtctcggttaggacagaagcttggaagtcatcgagtccagttttgtgcagtttactgaattccagtaattttagtggtcacaagtatgactattccttcaatgaaatatagttattaaggctttatagaaaacgtaaaaacagttgaaatctgctgtaacataaattcccattgatttcactcttgctctctgaaactatttgcttcagaaaattttattttggggcagcattttttttaaatgaacttggggccaacaaaaggacctaatcagatcaaggttaagtctatctccttttgtctaaatggtattataaagcactggattgggaggaggcctgaatcacagtaaagtttggccagtaaagtactggtggcctgggccaaaacttttctttcatatccaataatccaggaagcactggcctggatgatctcttaggttccttccaccgcctttctgtttcttttttgttgtattcttgcaataaagattcaaatagggccaggcgcggtggttcacgcctgtaatcccagcactttgggaggctgaggcgggtaggtcacttgaggtcaggagtttgagactggcctggccaacatggtgaaaccccgtctctactaaaaatacaaaaattcgccaggcatgttggcgggtgcctgtaatcccagctacttgggaggctgaggcaggagaatcgcttgaacctggaaggcagaggttgcagtgagctgagattgtgccactgcactctagcctgggcaacagagtgagactctgtttcaaaaaaaaaaaaaaaaatacacatttttatgtgtgtgtgtatgtgtttcacataatataaaatttcgagtgtacaattcacaagtttttatatattcagagttgtgcaaccatcatcacaatataattttagaactcctggcgagatgcgttggctcatgcctataatcccagcgctttgggaggctgagatgagaggattccttgagcccaggagaccaacatagtgagacctcatctctacaaaaagtaaaaaaattagctgggtgtatggtgcacatctgtagtcctggctacttaggaagctgaagtgggagaatcacttgaacacaggagttctaggctgtaatgagccatgattgtgccactgcactccagtgcctgggtgacaataaaccttgtctcttaaaaaaaaaaagaactcttacctattaaaaatatgtgtgtttttattatatactaatatatacttattctagaaaatcatggaaaataaaacaaaatagaaataactagtattttctgtagtcctcctaaccagatactactactttgtacgtatagatttttgttgttgttgctgagacagggtcttgctctgtggcccaggctggagtgcagtggctagtcacaggcacgatcacagttcactgcaaccttgaaatcccaggctcaagtgatcctcccgcgtagctaggtctacagatgtgcgccaccatgcctggctaattttaaaaaattttttatagagacagggtcttgctgtgttgctcaggcttgtcttgaactcctggcttcaatcgatcctcctgcctcagcctcccaaagtgctgggattacaggtgtgagccaccatgtctgcccagtttctagatatgattttttaaagcatagtttgtaattgtgctatattctgtattttgcttttccctcctaatactgtctcgacatttttctgcttgagtagcctttaacaactttttaaatgactgtatattgtctgataaaccataatttacttaaccattttctgttttttttcctcaactacatagtgtttagtgaatgtctttgtgccatagtttttcttatatattcattcattcatttattcagcaggtgttgaccatgagttatgtaccaggtgctatgttaggctctggggacacaaaaacaaatgagaaattctagatgattagtgggaggtggatttgcatacaggtacatatactaaagctttatatgtcctatacaagaactatatttaagatttagtggagatgaaagcacaaagaaggaagttatcaattgtagtgaaggggaataacggtcagaaaagccgtcatagatgagataatttataactgtattttattttaatttttttgagacagagtcttgctctgttgcccaggctggaatgcagtggtgcgatctcggctcactgcaacctccacctcccgggttcaggcaattctcctgcctcaacctcctgagtagctggaattacaggtgcacaccaccatgaccggctgatttttgtatttttagtagagacagtgttttgccatgttggccaggctggtcttgaactactgacctcaggtaatctgcttgccttggcctcccaaactgttaggattgcaggtgtgagcctccatgcccagccagataatttataactttaaatttgtaagataagtagatgttgccagatatattccaagcagagggcactgcacaggccaaggcatatcagcttgaaacaagtatggtacaatggggaactacaggtatcaggatagctggattgtggtatgggacatacgatatgacaagagccaaggtaaaccaaggtcctcatggagaacctcgtctgccatactcaggaatttgattcctagctcatatgtactctgaagtcattaaaagattttggcaggaaagtcacatgatgagcttttattttagaaagatcttcaaagcaacaagtagaaaagagattgaaggggcaacagtaagtgaacataggagaactgctgtggtctaggctggagataatgagtgttgcagtaagaaaggagccaagttagacagatgtgagaaatggtagaaataagaggacttagtcattaatttgattggggtgtgagtgaaatggagaagttaagataattcttaggtttctggcttggttgaagatactcattaatggaagatttgagggggaagtggtgagtttgagattatggttgcatgtctcctattattttcatgttagtttattgcaaatatttgtgttagagtatcttccctgtaagatcttaagtgctgtttgagtacaaaccttgtgtgccatttcactgctatgttctcagcttctagcgttgtacctgatatacagtagccattcagatacttgtcggatgaatgggaaatgtcccaataagcatctgagatgcccaaagggcatttggtctatgagttctcattacagtagacttccagaagtgttattagtcagtcaaaggatataaagtaagagatttttcaacccctccctccaacatttttaatattttaaaatcacaaaacctatacttgattatttaaaagttttttgttttttttaaattttttcgagacagagtcttgctctgtcacccaggctggagtgcagtggcacgatctcggctcactgcaacctccgcctcccagattcaagtgattctcctgcctcagcctcctgagtagctgggattacagaagcaggccaccacgcccggctaagttttgtatttttagtagaggtggggtttcaccatgttggccaggccagtcttgacctcccgacctcaggtgatctgcctgccttggcctcccaaagtgccaagattacagtagtgagccaccgtgcttggccatttaaaaatattttaaacacctaaaaaagaatatataaatatgcaaagtaaaaaatgaaagccctttgtctacttcttagggtaaccactgttaaagagtgtggaatatattctatctataagatatctatatctttttatgtgggaaataattaatacatatatccacataatatgtttttaaacaaaaataaatatattttgttctgtagcttgcttttccacttagcatatagtggatatttctctgtgtctccttattttatatagttgtgtctatagagtattgcacagtatacatgcatcatagatttaactgttccttatttgagcatattagggaacaaattttaccaagggaagttttaggtaggcatgatagctgacttcaactattagtaaagttgatgtatgaaagagagaaaaaatggcccaggatgtagaagcagaactggtaggtactggctgggcacggtggctcatgcctgtaatcccagcactttcagaggccgaggctcaccaatcacttgaggtcaggagttcgagaccagcctggacaacatggtgaaactccgtctctactaaaaatacaaaaattagctgggtgcggtgacatgcgcctgtaatcccagctactcgggaggctgaggcaggagaatcgcttgaaccggcatatggaggttgcggtgagccgggatctgcctgggcgacagagcgagaccctgtctcggaaaaaaaaaacccaaaaaacaaaacagaactagtaggtagtgaacagaagttagctatagggaaacaaagttaactccaagtagagaggagctcccaagcagaggtgctgtgggtgggattgactgcccaggagagagctatctgagagctgttcctgcctgagcttgccaccccccttgttaggatgctgcagaagaaattcaagcactggatgggggccataggtagactttagcacattggaatcagtaaagacccatctgtttttgggaaagaagctgtgaaaaagtataattcctaattcttgaggttatggaatttggaattgaagaataaatttttttttagtttttacttttgtttataacttaatttttagttagatttccctccattatgacagaaatacaagcttgctgtgaaagaaaacaaaaattatagtgcagtagcagtaggttttttttcttttttttttaccccacccaccccctagtacagaagagtttagagggaaaatagaatcatagctaacattttgttctatagtcaaattgtgctaacaggcctacaagaatagcaacgaaacctgttccttttttctcctcactctcagtcttgtgccattcccagtagacttctatttttgggggctatttcttctgctgtttagcttcatatttctgatataatgtgtattgctttttcttggtttgttaatttcagaaattgggtttcctgttacagtgtatttgaattttaacttaccctttaccctcccatcatccacccttttaccctcctatcatcatcatcatccagctattggcttttttattgtgcacctttgcattttaacacctttaggcctctttagagttgacattctctagaaggactcactgattgcctgactacaggtattctagacccggtagaagagacacacagagtccttttgtgtgcaggctttaacttaatccctctatatttataaccttagcttacccctgtcttcctctgttcctagagtcctgagtctggcagtatatttattttgtctctgatataaataattttttgagcacttattatgtaccaggcattgagcacttattatgtatcaggcattgagtacttattatgtgccaagccaagaattctgtatgtattaaattctttcaacagccttctgcaggtcgataccgtttttattcctgtgttatagatgaggaaattgaagcccataaagcttaagtaacgtgctaagatcacacagctaggaggtagtaatgtctaggcttgagtagaagtctgacttttgagccatattcttaaccatggagattatattgcctgctgagtttctcaatagcacctcctcttgatttcaaaacctgggtaaagtatcggttttgggttacttttttacttgttccatttgttttttgtttttgtttcctgccttcctgtgggctacttggacaagtttttagaattccattttgctttatctgtagtgttttttgagtgtatacccttgtgtagctttagtggttactaggttttacatcatacatttataacttaccacagtctactggtgataagttgtattggtgaacattttaccagttcaagtgaagtgtagaaaccttaccttcctgttgtccccttgtcctttcttgtgtgtaatataattgtcttaaatatttgctctacatacattgacacccacataagacagtgttaaaatgtgtgtttcaaacatcaaaactcaagaagagaaaaagtaattttttttttttttgagacggattcatgctctgtcacccaggctggagtgcaatgctgcgatatctgctcactgcaacctccgcctcccaagttcaagtgattctccagcctcagcctcccgagtagctgggactacaggcgtgcactaccacacccagctaatttttgtatttttagtagagaccgggtttcaccatgttgaccaggatggtctcgatctcttgacctcatgatccgcccgccttgacctcctaaagtgctgggattacaggcgtgagccacagcgcctgcctttttttttttttttttgagacaatttttgctcttgttacccaggctggagtgcaatagcgcgatctcggctcactgcaacctctgcctcctggtttcaagcgattctttagcctcaggctcccaagtagctgggattataggcatgtgctaccatgcctggctaatttttgtatttttagtagagacgggttttcagcatgttggccaggctggtctccaactgccaacctcaggtgatccacctaccttggcctcccaaagtactgggattataggcgtgagccaccgcacctggcttagaaaaagtaattttatctacccatatatttatactcttttcattgttcattcttccttcctgatgttctaaacccttcctttaatcttttccgaacattatgtagccattctttagagtatgtctgctagcaacaagtgtctcagtttacccgtttattcctggaatgacagttcttttctttcagtgcttgaaaaatgtgccacttccttctggccttcatggtttctgatgagaaatcccttttcattcatattgttgttcccctatagataaggcatcatttttctcttgcagctttcaagattttttcattgtctttagttttcagaagtttgtatttctcggagtggatttctttgggctcatcctagttgatgttcttgaatctgtaggttttgtatctcttgccagatttaggaaattttcagccattatttcttcaaataaccttaacatcccagtctgtattctctccttccaggattctgatgacatgaatattacatcttttgttatagttctacaggtctctgaggctctgtgtgtatnnnnnnnnnnnnnnnnnnnnnnnnnnnnnnnnnnnnnnnnnnnnnnnnnnnnnnnnnnnnnnnnnnnnnnnnnnnnnnnnacatatatacacacagacacatatatatatatgtctatggtaatttttattccatcttccagtttgctaattctttccctttttttcctccattggctgctgaattcatctattgagtttatttctgttactatatttttcagttctaaaattcccatttggttcttctctgtatcttctgtttctttgctaagattttctgggcttttttccccatctgtttcaggcatgttcataattgttgaagcatttttatgatggctgcattataatccttgtcagataattctaacatttatgtcatttctgtattagtgtctattgattgtcttttcttattcgagttgagattttctttgttcttgagttgacaagtgattttcagttgaaacctgggcattttgggtattatgagactgtagatcttatttattttttactttttcttgagacagagtctcactctgttgcctaggctggagcccagtggcgccatcttgggtcactgcaacttctgcctcccaggttcaagtgattctcctgcctcaagcctcccgagtagctgggactacaggtgcacaccaccatgcccggctaattttttgtatttttagtagacaacggagtttcaccatgtcggccaggctggtctcaaactctgggcctcaagtgatttgcctgccttggcctcccaaagtgctgggattacaggtgtgagccattgcgcccgtcctatagatgttatttaaatcttttagtttagcaggcctcctctgatactgcacagggaaatggagtgtaccatcttgttattgccagaggtgggtgaaagtccaggtttcttcttacttggcctcattactgctgggtgggattggaagtttaggctctccactaggtctctgctgataacatcctgtctgggaaggataggaattccttgttccttctctctatgtgtccttctctgacaccatggtggtgcgacctcattactgctggtggtaatgcaaatctgattctctactgatccttctctgacaccaccccagtgaggtggggagggtgccttgttatagctggataaaggtgaagtctaggctatctgcttcaacctggctaagagggggatttgcatttcttttctgtgatgtttggctggcgtaggttggttattgtcttaaagttttctgtcttgctgggctgtccttttctggtcccttagctcttcttggggctttttatgcgtgcccactggcattaccaggttgttggcttctccttcacccagaacggggaacatgaggcagaaaattcagggatttcactactgtgtcatccttaagattctacagtctctggcttgcctgtcctttgtctacctttcagaaccttttttgtctgttttatatattatgtccagtgtgtttatctgtacttaccaggaggaattaattctttctcagttcttttaaaattattttaaataacagatacttatcatttttttgttttgtttataccatgatggtgctacttctgagatgacttcagaaagttcaaatatatcaactcttaaagcgcagctgattttttagactcttctaagatgttttaatctcttatttcactgagtcactttatagttttatcttgaaatattatgagcttccattactagatagtaaaatgtcatgaaaaccttcttattaattgcctagttggaaaagcttatggatttgagtatacgtggaacaaaaccaaaaacattgttgacctgtgcagttgcagcaatgtgtgtgacttacacagtttattcatgagagtggtatgatatacttagaatatgtgctaaattaccccttttttttcctcagctggagccgagatggtcataaactcgtgagtgcttccactgataacatagtgtcacagtgggatgttctttcaggcgactgtgaccagaggtttcgattcccttcacccatcttaaaagtccaatatcatccacgagatcagtatgtttaagctatttctctcctggggtggggtctaattctatatggattagctctgggctcatgataattttagtttatggttttagaaggcaaatacacatctcttcaaaccttctacataaaataatctttccgtctaggttggctctactgaatacatttctttctttctttctttcttttttttgagacagagtcctgctctgtcacccaggctggagtgcagtggcgccatcttggctcacacaacctctgcctcctgggttcaagattctcctgcctcagcctctcgagtagctgggactgcaggtgcgtgccaccatgcctggctaatttttgtatttttagcagagacagagtatccccatgttggccaggttggtctcgaactcctgacctcgtgatctgtccacctcagcctcccaaagtgctggaattacaggcatgagccactgcgcctggccctgaatgcgttttttttaatttaaattttaatttttttgagatggagtctcgctgcgacgctctagctggagtgcaatggcacagtctcagcttactgcaccctcctcctcctgttttcaagcgattctcttgcctcggcctcccaagtagctgggattacaggtgcaggcaccacatccggctaagtttttgtatttttagtagagatggggtttcaccatgttggccaggctggtctcgaactcctgacctcaagtgatctgcccgcctcagcctccccaaagtgctgggattacaggcgtgagccactgcacctggcctcttacttttttttaatgatcatgttttattttgtcaagactaattttactcagaattttccctgttattagacctgtggattttatgctttttcactgtttcaaatttgcttgggtgggagaattgatgagggtatggacagggatcagggaaaaggacagggaatcagcttgctgataccaaagcaacagccaatgtactgttcgtatttttaaacaggaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaaggtaagcctaaaagctggcaaatcaggcatcttgtacactggctcatttaatgtttacttgttttgtttcttttgaaaattgtttttattcttggactaagcacagctcctttctgcagcaaatgtagtctaattttcttccatctcttaataataatttttgttctttggatttagagtgatagagattatttgacctagaaaagcatgggaggacctttactggatgctagtaatgaagggccattatgaaattataaaatttcaatgtcatgttatcagctggaacactgctgatcaaaatttctcaatatctggttttataaaagattgtataattcaggccagcttaacttacagtactgagacttattcttctttttccttcaaacttctgactttgccttttggaatgtgtaggcccttttctctggaatacattgtagaaggtgtttcttctgtggaataagaagtcaggttaggtgaccttttaaagattcttttcatgcttaggatagttccactgggcatcttgatttatttttatttttattttttgactgtggcacatgggttagtataatttcatggctattttagaaaggcaatttttcctttttttttttttttttttgagatggagtctcactctgttgcctaggctaaagggcagtgcatgatctcggctcactgcaacctccatctcctgggttcaagcgaatctcctgcctcagcctcttgagtagctggaattactcctgacctcaagtgatccgcccacctcagcctcctaaagtgccgtgattataggtgtgagccactgcacccggccttagaaaggcaatttttttttttttttttgagatggagtttcgctcttgttgttgcccaggctggagtgcaatggcaccatctcagttcaccgcaacctctccctcccgggttccagcgattctcctgcctcagcctcccgagtagctgggattacaggcattcatcaccacacctggctaattttgtatttttagtagagacggggtctctccatgttgatcaggctggtcttgaactcccaacctcaggtgatccacttgcttcagcctcctaaagtgctgggattataggtgtgaaccaccgcgcctggcctagaaagttgatttttaagaaattgtgataaaatacacacagcataaattttaccatttcagccatatttaactgtacagttcagtggtaattaatgtacattcactctattgtgcaatgatcaccatccatctttagaaatcttttcttcttgtaaaactggaattctgtacctattgaatcataatttcccattccctgctctccgccagcccctagaaacaccctttgaccttctctctttatgaatttgactactccaggtacctcatataaggggaatcatatagtatttgcccttttgtgactggcttatttcacttagtttcatgtcctcaagcttcacccatgtgtgtagcatgtgtcagaatctttctccttcttctcaaggctcaataatactccattttatgtttataccacttttgtttatatggcttatctgtggatacttgggttgcttctatattttggttattgtgaataatgctaaacatcatattttaagaatagattggccaggcgtggtggtgaatgcctgtaatcccagcactttgggaggccgaggtgggcggatcacctgaggttgggagtttgagaccagcctgaccaacatgaagaaaccctgtctctactaaaaatacaaaattagccaggcgtcgtggcgcatgcgtgtaatcccagctactcaggaggctgaggcaggagaattgcttgaacccaggaggcagaggttgcagtgagccgagattgcaccattgcactccagcctgggcaacaagagcgaaactccgtttcaaaaaaaaaaaaaaaaaaagactagattaagaccttgtcttacttaaggaagcaaaacagcaataccagttaatcaggtcaaatatatgggaatagagacatttgcatttttacccagtctttacgcagtattagaaacaagccaaatcaattattgttagttattggaacacttacttttttcccccctcctttaaactttagattttggtcctaaaaacagattctcaggatcttgttgcttccttcagagtgacaactggaacaagcaataccacagccattaagtcaattgagtttgcccggaaggggaggtgagtgagatcttaccttttaagggacagttttaagagtgaatagaatgcaaaaatacatggagatttgcagttttcatgtatattatacttaagcattttttaaaaatgtacttaaggtttttagaaacttacaatatctggttttcgagttcataacatttcctgccgtagttacatcttccttatctggaggttatcaggcggttactttacagaaaaataagtaagtggtcagtgcttaaaaccaaaatgcctggcatatagtaagcactgggtatatattaacttattatcatcaggactgatgtcatcaaattcacattgtaactgaatactgcctatttacccttttaattttggatgttattctggtaggtttggttacctagttagaagtcgtagaatatatcaacagaaataggaaatacgttgtcagtaagaggtaatagtcctcctattttgtttaggaacacccatacatgacttagagcaggggtccccaacccccaggccacagaccagtattggcctgttaggaaccctgccacacagctggaggtgagcattaccacctgagctctgcctcctgtcagatcagcagcagcattagattctcataggagcacggaccctattttgaactgcacatgtgagggatctaggttgtacactccttatgagaatctaatgcctgatgatctgaggtggaacagtatcatcctgaaaccataatcctcccaccagcctgggccgtggaaaaattgtcttccacaaaaccagtccctggtgccaaaaatgttggggacagctgacttagaggatattaatgttcaaaattctcttgaattaagaaaaggttatagtcagtgaagtctgcaagaaagtgatgaaataactaatatttcatacagatttctaagattttcaatgtcattacagtaaaaatgacattttaaaatgacatatttagtttattacctcatttaaaaaatatatattatgtgtaaaacaggccagagagatgaagtatttatatccatttcactgtaaacttgggaatttaggaagctggtttcagtagagaggtcttggaacttagttaatgctgacaatttgtatattttgggttcagggatacacaggaagtataaaacatattcccacttaaaattgtattttggtttgggagatgacaagtagatatataaatattctagtctattactttgatttttcctcaattcttccctagtttattagtcgttttgtagtactaaggaacagatttctgacctctggtgttgatatttttatccttcccgtagttgctttttaattaacacggcagatcgaataatcagagtttatgatggcagagaaatcttaacatgtggaagagatggagagcctgaacctatgcagaaattgcaggatttggtgaataggtatgtatcacaacctagaagaatatgtgatcattcatgacctgggcttgagttccagctctccttggtactttccttgtcctttaggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagctgtgagtacattaggacattgcttttgttagtcacataatccaaaaaatctaaaatctgttcttaacaacctgtttttctttccttcactaaaatttagtggcatcctgttcgacccatcatagcatccatttccagtggagtggtatctatctgggcacagaatcaagtagtaagtattctattttacttgcttcgaaactagttaccccttctttttatcaaagaaccttatacataggaagctaaaaattacatttttattttcttttgcatatgattctcgcaacctaaattacataggttcagtgcatctagttgcactttattttggtgggaaggtcttggtcccaagttggttttctggctcttttcagggagaaactctattgaactttctgttgcatttttctattatttatttgagataacatttttcttttgcttttcttactttcagctcagtttctgttttacatcttaattttactttgaacacctttaaattatgtttgtaatcagtgtacttacaagaaaatttaacattttacctctaaattcctaaaatgaccaaagaaggcagtgattcaaaagagctacagttaataacttagcttatcttaatgtttaagatagaaaatacctaagctagtaaaacttacagatacccatttttttcttgtctgccaaatttaatctaagaattgtgaattcctttcatgctcacatctttcattttatcattaatgtgtagattacagattattgctttcacatatggttaagtagtatatcttgttgtataggaaaactggagtgcatttgcaccagacttcaaagaattggatgaaaatgtagaatacgaagaaagggaatcagagtttgatattgaagatgaagataagagtgagcctgagcagacaggtactatttctaaattgcagacaggatttcctaaagggaaaatgattgctttacttaatattcttcatttgtgttgtaaatttatttcagcacttcatctaaaatgcccccctccaccccacacttttttttttttttttttttgagatggaatttcgctcttgtcacccaggctggatgcaatgatgtgattttggctcactgcaacctctgccccctgggttcaagtgattctcctgcctcagcctcccgagtagctgggattacaggtgcctgccaccactcccagcgaattttttgtatttttagtagagatggggtttccccatgttggccaggctggtctggaactcctgacctcaggtgatccacccactttggcctcccaaagtgctgccattacagacatgagccactgtgcctggcctatgaaccactgtgcctggccttcttttttctttaagcttacacaatttccacagtatttggagagccttaatttataaggtgtttactaagggcttatatgggtattaccagggctcaagcagctctcttaacatatcattgtgtatttcctgattaattgcagatgactaagtgaggacatacatgcagcacctagcaaagaactcaccatgctaagagtgctcagcttttcccatgtattctgtcactcctttgtcagtaagagaagggtcaagaacctgggctctgaagtcagactgccttgggcaaaatactgcttaaactgaatttcctcatctgtaaaatagggacagtaatagtacctgctttttagggttgtggggagtaagtgaaataattcatgtaaagcatttaatatatgcctaggccataataagcactaagatattaatttccattatgattatgactgtgattttatctcttctgaatttctagataggagctccttgagaataaagatttgactttttaatccccgtggtgtctaacacagggctttataacatagtaaggtttgtgcgggtgaatgcttaggatgcccagttggcactgtcagtgagtaattaatgccacagattattgacccccgagatacttgatggtgccaggaatcaggattgggaatgaggttgattctgtttagtgtcaaagtgctggtcctcacttttgtgatattagataacttgcatgcctaatgtgttttaggaggacctccagggaagtagaatgttctagattatagggttatgttctgtcaaaccttcccagatttccacataaattgttcctccttcccatatcctgagcaagttacacataccattactgtattaaattgaaactgtctctctgtctccccagttagactataaaccttttactgaagagctgttcccaactttttctgggtcattgcactattttcagtgcctaggatagggtggaaattcagcacatatttgttaaatgattaagtgaagtgaactgtttggttttcctcctttgtttctctggaatttcaacttatgaaaaccttgaagctgcaaataaaaagcagtttttcacttcttctcaaacatctcctgtgtttctgtcctgcaggggctgatgctgcagaagatgaggaagtggatgtcaccagcgtggaccctattgctgccttctgtagcaggtgagccggcccggaaggctgggcaccttggctactgctgctcctggcctctgggggagtactctgcagtttccctggctatcccttcattcccgtctgcttattagctaaaagagataactcgtttggtgtacaagaaatccaatgtagcctttcttctctagtcctatgttcctttcacttctccctgatagagaattttaaggaaccaaaataattcatttatcctgtttatttttatcaccaattttatcaattacattgtttgattcccttttattcttcttggctttcttaaagttctagatccatacctgttgcttatgcttaatataggtgatagaggaagggctcatggtttaagcaactatctcctcttttttccaatcccttgtctgatcctgctccaaatagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatggtaagagctacatcttctccctctggcctggcagacgccactttctactcactccccagcgcaacctggtaatttcctgtttgagcgatttcaccttagaggaattttcccatgagtctgttttatagtgttttacaactttataatgattgcgtctgtgttcacttctctcttaaaatggagaaattctgcccttcagtactttgcctaagatgctgcactttaattcttctgacagccggctcagagtttattataccattcttcttttaaatgtttccccgtagagtggttttattagatgtaaaatactagttagacttggacaatcatttcatccttcctgccaccttttagagtctgacttgggaagcctttattatcatgtcttgggataagtagggatggatgggggtgtgtgtttaccattgagcatccttcttcctcttctcttttatttttatttattttattttattttatttttttgagacagggtctcgctctgttgcccaggctgcagtgcagtggcatgatcttggttcactgcaacctccgcctcccgggttcaatcaattctcctgcctcagcctcccgagtagctgggactacaggcatgcaccaccacgcctggctaattttcatatttttagtagaggtggggttttgccgtgttggccaggctggtctcgaactccagacctcaagtgatccgcctgcctcggcctccctaagtgctgggattacaggcgtgaaccactgcgcccggcccttcctcttctcttttagctaactgcagatcacattttgcaactacttattttcctgatgctatcgatttctgtgtctactctgtttcagacactgtttggtatatgtaccattgctgacttttacatcaaccctgcaagttgttttacctgctttttaaaggagaaaatttaggctgaggttatgtgtaagaggttctgtaaacttgcctaaagtctcacagaagtggtggggtcaggattctcattctagtctctctagttccaaagtccattctctttctgctctcacatgcctctctgtgtatgtgtgtgtgcatctgtgtgtgttccttcttctggcttggtttgatagtattagtgcatctttcagctacttgttcagtttagagttactgtggcttggcatgaacatataagccaggggtgtccaatctttgacttccctgggccacattggaagaataattgtcttgggccacatataaaatacactaacagtaatgatagctgatgagatttttaaaaattgcaaaaaaactcataatgttttaagaaaatttatgaatttgtgttgggccacattcaaagctgtcctgggccgcatgtagcctgtgggccacagattggacaagcttaatataagccatgtgtgccttttggccaaggaactatctctcatttaatgaccactgttttatacttatagaaataagacaaacttttctctttataattattaattgatctgggacacaaagcaacattctttgctcaacaaagttgtggttggggtgatgagactggtgtcatgtggattcctttccatgcctgtctgtcctacagaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacaggtaaggacacattgggagcattgtctggcttgcttcgtggccttgctttgtgtagcccttgacttcatttaactgcaacattttttccccctctcttccctcgtttttcccagcagcagataatttctgaattttaagctgctgctaagggcaggctaaaccagatttggcttaattcagtggctcttaaccttgggtctgtaaatagttttcaataaatctacattcccctgatgttatatgcaaaatattatgtgaatatttttctggggaagatgtccatagctttcctcagattcctgtaggaattcatgacccaaagaagggtaagaacctctggtttaattcatttcttcatccatatttgctcttaggttttttgtttgttttgtctcaaagagccagacaagtagccagaagtacaagcttgttttatatagtccttgactggttcactgtggcatcttttctctccctcttcaaattgttcaaatcccacaggtagtgctttctctctcttagtattccagaagcaataatgaaattgttagtaccatcgtgttaaggaagaagatggggtttgttttggtttttgatttttttccaatatctgaaaacaggaggagatgatcaaaaagacagaaactacagtatctgtgtagtttcttaacacctaagccttttgatacataatatttgagttttctcacttttatattactgagggatttttattgggggacagaaaacaatttctgtttcttaccaaatacttgtgagcctaggctaattggtctcttgtttagaaaatgttaatcaaattagaatccatttctgtgtaaacattgggctttggaaattgtttttttgctttatatagaagcactgctttagttaatacagtattctcaatttttttgtggctagtttggtagactcaaaggtaggattgataacgtatcaatggttgtattcaggctcccccgactttaaaattttaatctaaatgtgtggactagagtgcaaaacagaattctttgtttaatttataacttacatcatttaatcattgtctgtaaacatgaattctcttacagagaagctgaaatagacagttattcatcattttgagtattccatctcgagtttactagatttagactttagtttttgatagcccaacaccataccactgagtaccaatatttttttcccgacaacatttatggtggtgcactgatggttaccacgtccacattcaacccacctaaggctgtgtttgtgtatatatacatataatgctgtgtgtgtgtgtgtgtgtgtgtgtgtgtgtgtgtgtatatatatatatatatatatatatatatatatacatatatatatatatatatattttttttttttttttttttttgaaacggagtttcactcttgtccccaggctgaattgcagtggtgcgatctcagctcactgcaacctctgcctcctggttcaagtgattctcttgcctagcttcctgagtagctgggattacaggcgtgcaccaccatgcttggctaattttgtgtttttttagtagagacggggtttcactatgttggtcaggctgatcttgaactcctgacctcaagtgatccatccacctcagcttcccagagtactgggattacaggtgtgagctatcacgcccggcatgtttgtatatattgtaaagtagcctggagcagtcgtgggcattgccaacaaagattgcagaatgactagatgtaaataagagcaatccttccaaacccacttcttgcacacactgatgccactacagaagaaacgcaatttaaagtttaaatagatttccctggcctggagagctaaaatattttaagggtgatttaaaatgtggccaaacataattaattaaaacactttaggacataatctcctagcttcttaaaacgtgtctatccctaatcatgtgcttttcaaaaggaaattatggtaaataaggctcacgcctgtaattctagcactttgggaggttgaggcagaaggatttcttgagcccaggagttcaagaccagcctgggcaacatggtgagaccccatctatgtaaaagccaatcaaacaaacaagaaaaaaccttgagctgggtgcagtggctcatgcctataatcccagcactttgagaggccaagacaggaggattgcttgagcccaggagtttgagaccagcctgggaaacaaaataatcaaaaaattagccaggcgtggtggtgcacatctgtggtccacctggtaacataggaagctgaggcaggaggatcgcttgagcccaggagtttgatattgcagtgagctatgatcacgccgttgcactccagcctgggcaacagagtgagaccctgtctcaaacaaaaataaaaccagccaggtgcaatggctcacacctgtaatcccagcacttggggaggctgaggcggtcagattgcttgagcccaggaattcgagacaagcctgggcaacatagtgagaccctgtctctacaaaagaaaaaaataattaaaaaacaacccaaaaacctcaaaggggcattgaggtatagttccaagacttccacagaaggattacatctggctttattgaccagctgcagagtggtttggatctttgtgaaggttgaaaattttggggagagtgatgaaattggatatcacagataattccatcaaaagtctgttttagggcaacctatcatgtttttatatgggattgtttgggtgagggtagggctttatccagtaacgtggtcgtcttggagggctctgagcaagctaagtcagactggtacctgctgctgatttgcatatggcccatcaagaccactcagggaaactctggcatttggatctcatattcttccacaccttggagattttcagtaaaagccaatatatagttattgtagattttccaccaggtattaagaaaggaaacctgatgcaaaacttctgaggccaaaccatcttcaaaaatcactccggtctgagggttgtatgtgtagattcaaggttttggccccctgccccatggacaacttcagcatttgagtcaaatcatttgaaggtaggattatagttgtaggctgtgttactacccaagttagatgaatgacaactgtttgttaatatctgtagttgaccagttactgtagaaactgttccataaactgattagccctaacaaaactaccatagtctgttgtctgttgcaacaggagagtatgcatttcaagggaaaattggcagagagaccactatagagataatctggccatctggaatctggggctatagaaaattgtttcctgtcaaacagcttgtcagtgttggctagcactagagggcccacattcatgtggacatttttctatgtgaatgaggacccaaagtgaagcttggtgagggtaaccctgagcttgggacttttgggaaggaccaggctaacatagtctgcgctatctatcaaatgcttcttagttactttaaatactctccagaggacagtcctgagaccagaaacttgagatgtgagcagaatcaccagtcctagttgtctgtgattgctcaaggattgcccaagagctagggctccttggcagtaaaaacatcagtaataaagtgggacaaaggtgtggtcggttacatacacgttctaaaggcctcatgggatggtagacatgaaggggttggtgcacacctgggtctgttggagatggcaagggccaaagtgagcagaagcgacatttctgggagtggacaggcaccatgcagatttccctgtcttgggctgcgctacaccactgccctggtgccagcccatcaccctaaggctctgaaccacctccaagtcacttactgaatctgtgatttttttttttttaatgcttggtagttttgttttctttttttctctctttgtttttctctcccctccctccctcctttccttcttttccttcctttccttgtgaagactaatttatgaattcctgctagaatcaaggtagtctttctcactctgtgggatgttattaactaactaaggtagggtttgaaatcatgattcagtgttctcttaggccaacctagattgggctgctactggaaagtaccaataatagctggtcattttgagctgaattttcctacctgttacattactggagatttcctttatgttgtagctaaataatatgtttccttgggggcagttgctgcgtcaggtctttaaattggctggagtcttctatattgctagttctgtgtatcttatcttgctcatagtactgcttgctctggttttgatttgttgcctgatgcctcaacaagcttttgttttgtttgacttttatttatttattttgtctattcagaaaaacaaggacggtatagaaacatgagctgccctccagtataaggtagctcattagtcatcttgagtgcctattactaatgctgttgattagtgatcaagccactttctcctattatgatttaggtttaaaatggcaatgttgtattcatttttagatgattaccactaaattggtcagggtacctgtgggaatagttggtgaaaattgccttaaagtggtaaggcatgatattgagtcttgtggagtggatttttctatcacaggaagttttttaaaaatcaatgcagctgggcacagtggctcacgcttgtaatcccagcactttgggagtccgaggcgggtggatcactcgaggacaggagttcaagcccagtctggccaacatggtgaaaccccgtctctattaaaaatacaaaacaattagccaggcatggtggtgggcgcctataatcccagctacttaggaggttgaggcaggagaatcgtttgaacccaggaggcggaggttgcagtgagctgagatcacgccattgcaatccagcctgggcaacaagagtgaaactctgtctaaaaaaataaaaataaataaaataaataaaaaatcaatgcaaggaattcattgtgatttatgttgagagagatctgaaaaaccattgctaagtaagcttttaatctgactgaactatggaaaagtttaaatttgatttttaacagcataacattcagtagaaagtttgtatctcattgtaactttagtctgttctcaggcacatgtgaatatatttttattgccagttttcatttgtgcaggaacttcaaaaatcaaagttatataaatgggtacttttctttcatagtttgggcgattattttttaaccattataccttcaagtggcatgctctctgccattccaaatgacacctgggaggattttcttcaccttcttctctttttacacttcctagttaatatttcacagcagctcatttaacgatgtctctcagaggttgagcagcttctatggaataatcagggaagtgttcatttcattgtactattcaggatattatttatcgatcattgttggtgtatagcaatgtagacagtagctctcacgaacatttcaccatatttgggattctaaggtgataagtatgtcacttaaggaactgtggtgctgggaaaagggtttcttgctcacttgttaatcatttagtgactaatcaatctttaaaatatatgaagggttgaaaggtgtggtaccctaaaatttcttctcctctcctcattgcactttttggaatgttaaacattatttgttagcaccttagagcatggttagcagcttagaaaaaatagaactctgatcattttgcttttcccccaaccctttgggacagtactgaggaaagtattggggtggggggtttggatttggattgttttttgttcaataaagagtaattgggagttggagttggttatgtattttcttaaaaaggggaatttcttggtccacgtgtgcttgtaatgcatcatccagcattcagtatttctgttcttacaagtaactggtctaaattgaagctaaaagaaatctttttgtgtctaatctctttagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttatataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtggtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaaatgatatcagttggtggatgctcctacaggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatgggacttagagggtttctgccatctttccatgtgtgaagtagcttggtttcctctgcctgtgcatttggatgtttgtgctatgtccacctcctaaactggctactgagaaaatcatcttcagccctgtcagattgtctctggcagtagctcctaataattatttatgtttttggaatttttttttcaacttttaaaaaaccttctatccatttcaatttgaattatttgatttgtacaatatatgtatattctcttcttcctttttgtcatccctgccctgccacccccaaaattttgtttttaaaaatattctgggctgggcatggtggctcacacctgtaatcccagcacttggggaggccgaggctggtggatcatctgaggtcaggtgtttgagaccagcctggtcaacatggtgaaaccccgtctctactaaaaatacaaaaattagctgggcgtggtggcgggcacctgtaatcctagctactcgggaggctgaggcaggagaattgcttgaatccaggaggcagaggttgcagtgagctgagattgcgccactgcactccagcctgggtgacagagcaagactccatctcaaaaaaaaaaaaaaaaaaatctgtagttttgtacaagatgagacttagccttgggtacttcttgctgaagctttaatgctttgtaaataaaatcggatgtttattaaagaacaggtgtagatgtttatttgtaaacactgctcacttctggaactctctggccactttgctttagtacaaaggaaagtgtgatttcctgtgttgatactagatctttcggtgtggaaagatagatctggaaggggtagggagtggacaggtagtctagatttctgcctctagatgagattgtaaataaatgatgcaagtggaaaagttgttgatcaaaaagatcatctaggaatgatctgtcttccaattatttaactcaatatagttttgcaattactctgaagaggccgtagggctaggcattctggaggttacaaaaatgcatgctaggaagttcctgtcttccaaggacctttcttcaagtctaagtaagtacggttgaattcttattagcctttttttttttttttgaatgaagcagctttaaaatttattaaatgctcgttgtctcctaaagataagatgtttcacaaagtctatgtaagtctttgattttaatgtcaaatttgagggtctacttattaatcttatgtgattgagaactccatctttgacatcatagctgtttcatagcaaccttgacctacgtgaataatgagctctattctgtaggataaagggagtaggccaagagtcagggagcatcatgcatcctctcactcaaaatatatcttcagtatccttgggaaggaagagtgcctaaaagggggagaggagctgcctttaacacaaccttaaacattctgatttgaaaaggtcatcttggcccttgtctttatgaatttccatttctatttaaaattccttacacattgaacagtgtttcacactttacaaagtgttctcacatacagtatatcattcagtgctctaagtgaccttcctcagataggcaaggaggtcttaagttacaaaggaggaaacagaaattcaggaagggtaagttacttgcctcctagtccagagttcttaatcctttttataggaagtttaggaacattaaaataattcaagttaatcttcctttttttagactttagtatttgttttatttggtgacatttaactggggcttttgaaacccttaatttagatcctagtttatagaggggaaggggaagggtgaggaagagtgtaacttcactatgcatttgaggtaatctggaaatttacttcagtttctgaagtcttttcttctttgtcttcccaagaggtggatttaaagtcattaagagaacacgaaaacggccagcgcggtggctcatgcctgtaatcccagcactttggggggctgaggtgggtgaattgcttgaacccaggagttggagacaagcctcgacaacatggtgaaaccccgtatctacaaaaaatagaaaaattagccaggtgtgatagcctgcacctgtagtcccagctacctaggaggctgaggtggcaggatcacttgagcctaggaggttgaggctgcagtgagctgtgatcatgttactgcactccagcctgggttgacagtgaggccctgcctcaaaaaaaaaaaaaaaaaaaaaaagcgtgaagactagtaggtaaggtggttattttattaacaacgatagttagtaaagcaacaccattgtgatttttttcctgccttgtggcctcacctgtttataaggactggacttttatttattaagttgtgttgttttattgacaatacatgcatcatatcttttgactttgaaggatatctcatgtcaaaggaatcaagttatgatttatagaggattcagctggaataccttgtgggtgctggctgagggtggcaaaacgcctaccgagacatgaaggttttagccactagttttgtccttgggagcctggggttggccttc

SEQ ID NO: 12455 - DNA, 69813 bp, Human
atattaaccgttggattttatggatttttattgaataaatggaatagattttgttaatttgtttattttcctccatgaagatgtttgaaatgtatctgaaaatataaaatattttcatcatataagttggaaaactagggaaagtttagggttaatttaatcccatgtaattcttttcaagtgcttagccttaaatattacctcttacttcagttaagataatagttttttaaccccttttttcaatatgttaaaacattttgaagcaaatcttccagacatagtgaaaaaacctgctctagatggttacttagtgtcacaattcatggagggaactatatagaattcccctatatggtgattttctgtggcactacctccagcttttatgccctctggctatatatgaaaaaatagacatttaatatagtaatgtttttagccacaaagaagagtgaaggcaattttgacgtgggagaagaataagttctctcccttagtgtttgatacggtgactatattgggctaagataatggttaggagagagagaagagaaaaggggagagagattgggttctaaatgcacgagaagaaagaaatgagggcagttcagaacaataacctgtgaattttttcaccacttacataccaagcaaattgcatttccttctacactgtctggttctattccaatgtgttttatttaaaagttttatctttcccaatgaaagtttaagttccttggaatctgggtccaagtatcttccacagaaacatacttctctcgctagtttatactctctgtaggcacgtacttggctttcttgctcactgctgaatgctggtgcgtagcaccatgactggcacagagtagatgttcaataagtatttgttgtatctgtgagagaatgtgttaaaataacaaaactcaaacataatagtgcagcgactatgccttgatgtgtgtgtgtttgggattcagcacatttgtagaggtaaagcagttggttttttaaaaaattagtgccattcaggatcacttgttaaatggatattgtttaaaggacttaattaattaatgctggggatactgttaagaaatcattctagaaactagaataaatattgccaaagtgaaacactttggttttgatacaaattattgccttagtttcaagatgtaaaacaaacaaaatctttgatgggattagtagaatttatttgagtttaattcaactttttgttttacatataaaaatgtgtgcctgtatgttatacatctgtacatatatttccacatatatctatacctattacgtatagctacatatagatacccatttatatgtttaatctcctaagtcttacatcttagtttgcaatcgtgggattattttccagatcatagaattgtttgttatttttactaggttgttttcatgattaaaattccgtgtctccccaggtttccatgtatcagcagtgccccagaaagtgtttcccttcctgagactctagggaagccttggaatgcaaataacttgaaaagagagcctggccaaaaaaagatttttgagccttggtagggttagtgaagcaggtttttagtacaaacacaactcaaagtatgtgtgttattaaaagtagctattttcatggaagtcttttggtactatttgttttggctagagaagtgaaaagctttcttttaaccatgtgaccattattttgcaagatcataacaaacaattctaatatctttaatctcactaaagagtcactaaagttatttgatgtaccttttgaaatagaaaaccaacaactaaatcttctctaacaccatgattttctaatctgtattaaagcgttccaggtatttttgtaatgcaatggatttcaattatgttgttcattttcagcacttacttcaaaagaatgatgctttacaattttgtagttaatttaacatatttttttgtttgcttgaaagggtagaagtaagacatatcaagatttaaaacataaatagcttggaacaccctgaagagcaacatgggagaaactgagaaaagaattgaaacccatagaataagatgtctttccaagttgaaggtatggaatttttgtatgtggatatatgtgcatgtacactagtttttaaaatacgacagtcctggtaaaattgctcctatctgcatgaagtgatctaatattaatgccatattgcctgttctattgataatttcttgctttaaagaagttggttttataactgagggtgtgtctacacaggattattgattcaggcaagttagtcctaaatggctttgagagacttaaatggaagacaggatcctaaaaatttccaggcacacatactgtggcaggatttatttttctggatcaaaggccatgctcactcttgcagggtttctaacccagagaaatgtgggagtcactctccgaaaatggctcattgcacagaaatgctttgttgatttgtatgcaattacccagcaaaacaaatgttttctttaagctttggcaacataacaataatttcctgtaagaaaaatggccattttgtcagctgttctgatttttttttctatttcagagaaaattctgttttctagcttcaaagtcatttatattcaaacaaatttgaatttatgataaaccaagggatctggacatttgtcctgattctatagctagtgcctgcaagtggtttcaaaactaagacactgtcactcattttctccctatcagaagtttgttttccatttatatgtgtgttggggaaatttaaacatgtatacaaaattggagaattatgatataaatctaaaaaaaatagacttgcctgaaatggtatgttaattaagaaaaactttttgtgcttcagttttctcatctgaaaagggtaatagcaacattcccaccttataggattcttttatgtttgaaacaatgactggaatattgtaaactttcaataaatattagctattaatattaaaagcatttgtggagaaaagtcaagtggtatttataaacaagaggtctttaatttttgattgctttggagtttagcaaggttagatattaatgtggatgttaagacaaaatgctgtaagcacaagtttatcaggtaaaagtgagaggcaattgcttaatagcaagttaggtttctctgtttctctgaacttagaaatatactcattaagcaaaattcattaggaagcatgaaagaactatttttaacaaatttgctttaaactttgttgttgaaataagttgaaagggcattattgctagaagctagtaggaccagctttataaatacagagattatttagcactagacatgagtcagaatagccactgatttctttcactctgcgaataaaaccaaactagttaggcaacccatgtgttttaggggaaaagcaatgaggtcatgatccatctaatttcttttcttaacatgtaaagtagaataaattatttttccaaatttgatttgtacttgatttagtaggacttgcttttaaatataaaatctgatttataaaactaggtgaaaatagtttgctcttaagaatacactctgagaaggtttatagtgggaagagagaatatccacaaatggtattcaatataaaaaatagctagagatatggccatactatgctgtagtcaatcagttttgattcatattaagaatgctattcaaatttctaggtccttttcacataaatttctatttaggtctcacaaaaataattgataaattttggcttagatgtattgtgtggtgtgaatgtgtcccatccaaattcccatgttgaaatcctaatttctaaggtgatggcagtaggaagtggggccttcgagaggtgattaggtcacaaaggtaaagcctttatgaatgggttcagtggctttataatagaggactaagagagattcactgcattttctgccatgtgaagacacagtgagaaagatggtagtttatgaatcagtatatacagcctctaagccacaaataaaattcaaccctcccaccccctgctcccagcactgaatggacctcctcttggtcaagagccttccaaagttagtctaaaaaacaagtttaggctgttatgggaaggaggtgttggacatgcctctttataccctcctctcttttggaattcaggaataaccaaccatcattaacatcaacacagaccttaagtctgataagaaacatttatatccattctctatgaagcctgcgtatctagaggctttatctgcatgataaaaccttggtctccacaagccctgattgtaaacaggaaataattttttattattgataataactcttccaaccaattgccaatcagaacattttaaaatctacctgtgacctgcaagttcctgctttgagttatcttgaccttcccaattgaaccaatgtaaatcttacatgtattgattgatgcattatgtcttcctaaaatatataagagcaagctgtactccaccttgaacacatgtttttaggacttctctgaggctatactgtaggcatgccttaactttggcaaaataaactttctaaattgattgagacctgtctcagatacttttgggttcacaaattagcagccatgaaaggattctgagtggaggtgcccctgacctttgatgaatctcctgtgggtacttggtaccagcctgagctatccttatggctcaaactgataggacaatttgctgaggcctgggagcccccacccactccagagaatccccaatcccctaaatttggttaagatctaaaatttatttttctctacaactcctattttttagttttacttgtgtccaacaaagaaggcaagttttcctgcttccatgacaatggagcgtgggcaactcctttctggagtttcagctaatttccaacagggaaggcaagtttgagctttttttttcctgcctgtaagatggtaaacagcagtcttgagccagggtctcattcctagataagtagctgagttgggtttttttttttatctcagcgattctccttaatgactaaaaattagaattgacagccggctagtcttaatttctccttagcattagagtgctcagtaatcatattgttggggttttttgttgttctggtgtttctcccatcagatttgaccaactgtacccaacttggccaaattcaaatgagaattccaaattatgagcagccagacctctgaagctgctaaaattcctcataactgaaaaaaagaaaacaaacaaattatgcgcttggtttctgttgcagcttcctgtcttaaaaacacaattgttctttcattttcttttcttccacactatttctccttcccccttcactgtctggtaccaaaaaaaatctagagaagccatcaaatgacttgaaccccttaaaacactcagaacaaaggcatcactcaccctttctttctctgtggagtttcaagagtcatgggcagattcttcttaaggtctaaagtgttcttattcaaaggtaaattatttttgtctaattcagaggttatttaaggattatatataaaatgaggtaaaaaggaccaggaaataagagatgtaaagaaagttataaagaggtatttttggtaagaaagcttaaaagaaaagtaattttatatgagaaagaatcttgcatgatgaatttttgtcctaagataaaatgactcgttcaagaaagagaaatatttatgtcaaaccagaaagtccaagcatgttgtaaatggtctgtgtaagttgtaataaggttagtaaaacaggaatttgttaaaatgttatgtgattcagttggctacaattaaaggaaattataatagtttttctaaaaattgaactttgatattaaaagtacactcatgcaacactaaagaactggttagaacaagatttattaaaaatgttgagttactcttaatgcaaggactttaaaatttttgaattctataatctttttctttttaaaattatttagattgatatctcagaacctgtgccctactgcttcagtttttttctcttttgagaaggcctggaatggtaactctctccttcaactttgtttggctcctgtaactttttacttttattttattttttttgaggcagggcctcactctgtcacccaggctggagtgcagtggcacaatctcagttcactgcaccctcaacctcccaggctcaagaaatcctcccctcagccttctgagtagctggaactacaagtgtgcaccacaaagccaagcttttttatttatttatttatttattttgtattatttatagagatggagtgtcacatgttgcccaggctggtctcgaacacctagactaaaatgatctgtctgccttagtctcccaaagtgctaggattacaggcatgagccatggtgtctggcctttttaagttaatagttgaaactaagaaacagaatttttgaaaataggcaaatgaaaaatattttggatctgcttttgtctgtatgtctgttatagctatatgtttatatgtgtcatgtagaagtaatatttcactaccaaattatattaaagacctctaatcacttggctaaaagaaaaataagtgcttttcagactgaaggaagctaccaaagatgccttttaattcatatgaccttagtagttttgggtaagactaatctggtaaatttaatctcaaaattacctccagtagtttaacatcttaaagtcatgttatgttaaattaaataactcctatttttttcaatgggaatctgggttactaagagttaaaatagtaggagagtaaatagtgtttttggtaaaatttataaaaatacaatgatgtagcttttgctaaagaatttttttttctaagagttattttaagtaaagataaaaatattatatagataaaactaaatggataaagagagaaattaaaagatgagtgaggagaaaccttgactccagggtggccatgtggttacctatggtagggagatgcagctgagctacattcaattacaaaagataaaattcattagaatttagagatggattatgctcccgaggagttagctctctaaatgcataaggagatgcaaactaataaaaaaaaaaaaagcaaaaatattcaatcccttggttattgttatctgtaattgctaaatgaatgtacaagaatgctgggttgatccttaaggctggatcaggcccagaggtgggtctgtcccagctcaagccactagactccaagctacccacagaaagaaaaattaaaccagagcaacaaaagttacctctgagagctgtggttaccaagaagatagtcaatatgtgggaagggcaaaaccaagtaactattaaaaccagagggtataatgcaaagtaattgttccattttgtagatcaatataatcagcttcttgagaaaccttaactactttaaggaaagaatcctttattttgaaggctacaaaatgaaagagcttgtttgggttgatgcaggattcacaaatcactattaaattgctgatgagtatatgtgatccaaatgtatacgaggttattcataagagaacaacctgcctaactgactggataattgctactgtaaggtctgtttactctggaaatgggacttcccaaccatccctataaaatgccaagtggagcaccccagataatgtagttgatatgcttcatatgcaagccatgtgaaactgtctttataactgggatattctcccattgaatatgactagtatccagttcagtgccctgtaacctctcccctcccctttgctcactgtcctggagtggcactggcctctgaagtaattcttttttggtcttgggactagttcaggggaaactgggtgggggaaatccctcctgccctaagtgcagttggactgtacagaatactccaaaggccaatggtagttcagcacagaaagagggaaggcctccaagtcagaaagagctccagagacctcatggtattgtagggcagggtggtgggccaaggttaggacactgcataaaacaggcaatcccaccacctctacctgctcacgccaggagaatccataactgcctagaggcctgagacccctacaagtagtaaggtgaataggcatctatccagcctagcagtaggattgatgtctgtccagcctggaagaggggcactaggtgactccctccccttctgttgtaaatactataattatcagataatttaagttattctcatttgtaactgcatttctggttcaggccagagtcatttggtatttaaaaaaaagactgagtcctttccccatttctcttctctttcccatagattcctccacctttcaaactgttttgtatctatttcaaaggaagatatccctgagactgggtaatttataaagaaaaaggggtttaatggactcacagttccacatggttggggaggcctcacaattacgacggaaggtaaaggaggagcaaaggcatatcttacacggtggcaggcaagagagcatgtgcaggggaactgccttttataaaaccattagagcttgtgagacttattcactatcatgagaaaaacacagaaaaactcacccccatgtttcaattacctcccacaagttccctcccatgacacatggggattatgggagctacaattaaagatgagattttggtggggacacagcccaaccatataattctgcccatggctgctgccaaatctcatgtccgcacatttcaaaaccaatcatgccttcgcaacagtcccccaaagtcttaactcatttcagtattaacccaaaagtcctaacttaggagccatcaaaaaaaatcaaaagcaagttagttacttcctagatacaatggggatacaggcattgagtaaataaacccattccaaatgtgaaaaattaaccaaaatgaagaagatggaggccccatgcaagtttgaaatccagtgagcagtcaaaccttaaagctccaaaatgatctcctttgactgcgtgtctcacatccaggtcacactgatgcaagaggtgggttcccatggacttgggaagatccacccctgggactttgcagggtacagtgcccctctcctggctgctttcatgggatggtgttgagtgttctgtggcttttccaagtgcatggttcaagttgttgatggatctaccattctgggatctggaggatggtggccctcttctcacagctccaccaggcagttccccagtggagactctgtgtgggggcttcaaccctacatttcccttccacactgccctagcagaggttctccatgagggtcctgcctctgcagcatacctctgcctggacatccaggtgtttccatacatcctctgaaatctaggcagaggttcccaaacctcaattctttacttttatgcacctgcaggcccaaccaaagcttgagacttgcaccctctgaagcagtggcctgagtgtacattggctccttctgggtcccatggctgggacccagagcaccaagtccaaagactggacaagaaaaccattttttttcctcctaggcctctgggcctgtgatgggaggggctactgtggagacttctgacatgtccgggagacattttccccattgtctgggtgattaacatttggcttctcattacttacgcaagtttctgcagccatcttgaatttctcctcagaaaatgggtttttccttttttatcacatcatcagtctccaaattttcctaactttcatgctttgcttcccttttaaacataagttccaatttcaaaccatatctttgtgaattaataaaactgaatgctcttaagagcacccaagtcacttcttgaaagctttagtttgaaatttcttccaccagataccttaaattatgtctcttaagttcaaagttccactgatctctagtgcaggggcaaaatgctgccagtctttttactaaagcatagcaagaatcacctttgctccagttcccaataagttcctcatctccatctgagaacacctcagtctggactttattgtccatatcattatcagcattttggtcaaagccattcaacaagtctctaggaagtttcaaactttcccacatcttcctgtcttccgagcccttcaagcctgtaggaagctccaaactttcctacattttcctattttcttctgagccctccacactgttctaacctctgcctgttacccagttccaaagtcatttccacatttttgggtatctttacagcagcactccactctctgtaccaatttactgcattagtccatttcatactgctgtgaaaaaatacctgagactgggtaatttataaagaaaaagaggtttaatgaactcacagttccacatggctggggaagcctcacagtcatgatggaagatgcaggaggagcaaaggcatgtcttacatggtggcaagagagcatgtgccagggaactgccctttataaaaccatcagatcttgtgagacttattcactatcacagaacagcatgggaaaacccacccctatgatccaattacttcccagtgggtccctctcacagcatgtggggattatgggagctactattcaagatgagattttggtggggacacagccaaaccatatcacatggtaaatttggaggttaagtgctacatgggcactccaggtgacattactaccacagaatcacagactgatcaaatttgctgtcctcatgggtcttacagatgcttaataaaacactggggtaattaacaaagaataatgagaaaggcaaaagggagtcagaggactcaccccagagggtgattaaaatatttggacgttttataagaaatgaaataaataaaatgaaaattgatggggttgaaacaaaggtctttacaacactatcaagggttgagtggaccaaagggaacccctactgatcctccaacattaaagggccccatatcagttttctgcatttgccccagattggggaaattgaagaaacagcaaaaggcaaaggttataatgagggagctgaaattgcctggggcaaatctgaggcaaattaagatgaagattgaaaaaagagcccaagtcccttggctcaatcccttgctgggaactcaaatcatttttcaccagaaaaagtaaaatggtctgggggtagaaaagaaaagttcctcaaaccagaacataaaaatgtacaggttgataggattatgaaatttgagatgtctaaacagcctttatgtaaggtaattttaacttcttcacctaaatatcttgtgaaaattggtattgtatctgattgggggatgtttctcctatcaagtactatgaaactgaagtcatgtaaatgtgccctttgaggaatgttaattggacacactaaatggaaactagtaagattgcctgagcctacacaatgtagggtagaagctgaagggctagtagggacaaattctccacttcatatccatttgtggagcatttattagggcttatggtaaaagactgggagcacttcccaatgacaaatactagactagagaatttccagttgagggacatttactgccttgttatggaatgttaactgaagctacccctttgctaaaggaaataatggtaccccaaagagttccataataaagtaaaaattgtttgcataggatcttgctacctgaggatgcagaggagatacttatgagcagagagcattctttttcccctagggctgactctgactctgtaaggagctgctagattctacagtgcctggtaaacagctctcatataacaagaactgcttagcatgtgaatggcaattcaaggtgaacaaaggacatgttgtttggaaggctgatgctctggttaaagagtcaagagaatctttttcttttaaattatttattctttagagcaattgggtgaagtatgtttttatgagcaaatttacctttctctccaagttctcccaaatttggaaaccgtgagtattctggttttatgacaatatagttatttgcataagtttagtaagagtcttttgttttataacaggacaattggagacactgattattttaccaagtctttgactagaataacatatttgcaggtaaatttccagcaaagccaacttaaaaagagcctatatggtcagtcaatttcttgctgcactttatgcaaataatcaggccaagtataataagcctaaaacttatttttacacacaaactggtcttactataatttctctttaatagaaaaggagggctagagagagagaaaaattgtttcaaaggaaaaatttaacacttgttactggatttcagccctgacttttgtttttgaatgcagattgaatcatgaattatttcttggctataataatcctctaaagagatagcggattatagtttttctttacatttttagttgaatccctaatgagatagcttccattttccattctgacacacaaatactcttttgattgtcaaaatattaatgttatttatctctccttggtttacttccaaggaaactggaatgatggtattctcaagactagagatgcaaatctctctcatttgtcatcccactgagcccgatctgtttttcactgcaaatgcccttctgttaagactatacaagcaccctccctctaggcctaaggactgttgtggaagaggtgggtgtgtgagattgtaagggctaggtttgaggaagtgaattagttcagatcattcaaaccaaggatgggtacacgatgcctaaacagctggtaaaacaaagttttttgccctctgagctattatgaggcatcttttcatccagcccaaccatgaagaatgtcatgctatttgtagaattaaaagaaaataactactgagaggataaagataccttgtgacaaagccttctggatataagactcccagttatgagctgtgcagatagatagatatgtatttttaaagtttattttcatttatttatttctttttttgagactcactcagggtcttactctgtcacccaggctggagtgtagtggtgccatcaaggcttactgcagccttgaccttctgggctcaggtgatcttcacacctcagcctcccaggtagctggcactacaggcatgcaccaccatacctggctagctttttgtctttttgtatttttttagagacagggttttgccatattgcccaggctggtctcaaactcctgggctcaagccatgaacacaccttggccttccaaaatcctgggaatatagatgtgagccacggtgcctggtcagtatatattaaaaaattatttttcagagcaatgcttatgttttgtgtagctaattgctataagtccataactaaaaccaagattatagtagctcaatgcatagaagttaaagataagtcagttttgtaacctggcctttggctttctgtttgttgactttttactgaaaaaaatttaaggggtaatgaatacttgtccatgtccattcctatctggcctagaacatttaatttgctataagtcttttgactctaagtaccttggccatagggggtcccactgagggacagggtggatctcaagcaggcagccatgccacccccacaatggtatgagacaaaataaaaatttggtagacattgctgttgcctctggcaaatcttaggtggaagagggagaatgtaaagcaaaaataaaattctgaggaccccaaccatctgaatggacccttcctctcagccaaaggcattccaaaattaacctgaaaagcaagtttaggccatgatgggaaggaggggtgggccagacatgcctcattgtaccctcttcccttttggaattcaggaaaaaaccaaccagaactaacatcaacacagactttaagtctgacaagaaacatttacatctgttgtttctgaagcctgctacctagaggctttatccgcatgatagaaccttggtccccacaagcccttattataacccagatattattttctattgataataactcttccaaccaattgccaatcagcacattttaaaactttaaaactacctatgactgggaaccccctgcttcgggttgtcctgcccttccagattaaaccaatgtaaatcttacatgtactgactgacgtattatgtctctctaaaatgtataaaagcaagctgtgccctgaccatcttgggcacatgttgtcaggacctcctgaggctgtgttatggccacatccttaaccctggcaaaataaactttctaaattgattgagaactgtctcagatacttttgggttcacaggcatcagccaacccaaatttgttagtgccttgctcttggactttccagtctttggaactatgagaattacatttctgttgtttataagccactcggcttagggtattttgttgtagcagcccagatggatgaaaacagtatatttaatcttatttgattttattttactttcagctctgatttcttcaagatgtttttgatacttattctgtcattaattcagtaaacttgtattgggtgcctgctatttgtcaggcacttagtaggcaccagggccacaggggtaaataacatatggctcctgtatctgacttgctctcagaataatgagagaggaacttatagacatctaaatccataaataaagtacactgtaatagaggttgtaatcaagttaggcacacagtagggtgggaagataaagaatgaatgaatggttagggcttacctggggagcacagaggcaaaagaggcctcacaatggaagtaataaaatacctgagtcttgagaatgaattatatattgaccaggtgaacaaagggaagaaaggcattaaaactggaggaatattatacaaaagcactgacctataaaatggcagggttaattaacacagctacatgtagaacactgtgtctaaggacaagcaacaggagatgatactgaaatacagatgaggctttgtttaccatcttaaaaatcagagatttttgtttatgggaattactgaaaagttttaagaagtaaaatttgctaactatgtattttattaatttatttgacaaaaaattatgatccaaattagtggaggtggcgtgtgaaagagaggttggaggtagacaaggctagaggagagtaaacaggatttcaattgtctgagctaaactgttcatacatatgagaggtttcatcatacgtgtggtagttaaaagcatggatgagcatgaacttcctaaagacagcatgcatagcaaaagggtagggagtacaagacagaggcctgaaagggttgaccaaagaagagagaaagaatcgagcagttagtcagagatataggtatgcatgggggagggaatttcaggaagaaaagagagatcaatagtatcaaatgactgagagtcacgaagtaagatggtaattcagacatagcttgtggatttgggatatttgggaatcaggaagttgtttatgaccttttatggaggtagtttcaagaaacaccagcctgtagcagactatagggtggatggaaggttaaacagtctagagtctagaccattcttctaaacagctttgtggtagctagagtagctaaccatcaaggctgagggaaggtgttttgttttgtttcattttgtttttttctcaaaaggcaagaaatgccttggatatattaataagctagtggggaaacaagcaataaagggtgtgaggttgaaaatagagagaaaagcctgggcatggtggctcatgcttttaattccagtactttgggaggccaaggtgggcggatcacctgaggtcaggagttcgagaccagcctggccaacatggtgaaaccccgtctgtactaaaaatacaaaagctaaccggtcatggtggtacacacttgtagccccagctacttgggagcctgaggtgggaaaattgcttgaacccaggaggtggaggttgcagtgagccaagattatgccactgcactccagcctgggtgacagagtaagactctgtctcaaacaaaacaaaacaacacaaaacaaaacaaaaaagagagagagagaaaagagcaataacggatgaattagaatctcgaaaatgggaagaatggattcaagagcaagattggagggattttatgtacaggaaagggacaccaatctttctaaagacataggcaaattagagaaggtagggatagaggtaagtttgcaggtgaagttgctgatatcatttgctgatcatgaagagagagaatgtggctgggttggagactgagaaacagaaaaggttgtgagttaacttgaaaggaatatgtgaggtagaaaataagttgtgtgattggctcaagactggaggtgtggaaggtggaaggtgtgagaattttaagaatttgagtgtgctaggtaaatagtaggtcaaatggtctcccaggttgcaagtgtcatcagaaactgtcttcaataggaccaagcaaaaatctctatggcatgtgactgaagaccaccattcaagttgatgtaaatctatctataatttgttcattttgaagcagtaattaatctacctaactatactattaccagtatacagtgctcctgttttaaaacctcttactaaaagctatctttttaaatttaattttaaaatatgaattttaacttttcatattttcagtaaaaccatagtagctcctggtgatcacagtggttctatctgtgaactcatccctgatgttgttatggattgcatcaacctcactgtttcctggaactataccaataataggaagtatgattgataaaacctatggaaatttatagtatatatattaggcaagcagtaaggataaacagaagccaatggtccaggtgagctgattctccaaggttcaggaaagcttcccaaaataaatggagtctcatttttgtgtggtcctccatttacactgcagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaaggtaatctggggacctattgtcctgcagagagaacttaagtatatttgctaccgaaataatgtctttgtataattctgcattctttcttttcattacagtacatgtatgaattcttttgtactttagatatcattgtagctctgaagacatgtttaagttatcagctatgtattacttagaatgactgtttgtttctatgtatgtaccagtatgttatacaatattgaggctgcaactgcctacaaaattagtctcactttgagttttcagagagaaatcacagtatgacagacaaaaggagcagactacactttacagtttcttgcaaattcaaaggttacttaagttggagacaatcagtcttatggtggaaggcattttgtcaacagacggcaagtatacaatttaaaaataattttttctacgttttcttatatttttttcctagatgtttctgttggcaataacatgtgcatttgtatccaaaacactgtctggatcttatatgaattccatgctcacacaaatagagagacaattcaacatcccaacatctctagttggattcattaatggaagctttgagattggtaatgaattatttttgcatttcttctttttgtattttgtcttatctgtggagctagtctgaattttattctccttatttgctgttttaggtcatttaatctgaccgagttataagttttctaaaactaactgattagctaagcttagaatatgcttggaaataattcatttaaatattacctcatattaacacctaaatattgccacatatcctaccattgttctttttattctaatagtttcttagttatgtagcatgagtagcagagtatttacagtatttatatttaaatatcatttgataaccctaagggatactaagggttccatctttgtatttagaagatacaaaggtagaagaccgccgggcgaggtggctcatgcctgtactcccagcactttgggaggcggagatgggtggatcacgaggtcaggagatcgagaccatcctggctaacatggtgaaaccccgtctctgctagaaatacaaacaaattggccgggtatggtggcgggcgcctgtagtcccagctacttgggaggctgaagcaggagaatggtgtgaacccgagaggcggagcttgcagtgagctgagattgccactgcactccagcctgggtgagagtgagactccatctcaaaaaaaaaaaagaaaaggtagaagacctagaagatgtagaagatattgttggagatcaaggaaattgccttacaaatgaaaatgcaaatatttttctgctatttggtctgggaggttgacaatttttttttctaagtacagagagaagaaaagactgcttttatagctctctgaattcatttcagaggcagcctctagagaaaaataaagtctactcatagattctgatttttgtggatgactgggaatatgtgaccatagagagggagaatgggggaaaggaagatttcttccatgaaaaaagttatatagaaatataagtgtcactcctttctagttttataatagcttccactttcttcaaggtgataatttcctttaatataaatgtatttaaaaaatcaggattgaggagaagcaaaactgaaacaagtgattcttgatcttgtctactagtgttcaactcctttagatcttagcctgtatcacctgtgtgctgatcccagtgagagagttagaactaactccatgtatagcccacgaattgactcagctcataatctaacggaaggtagagatgcagataataatagtattaattgaatgaagtaagtttggtagcatagatatatacaaggtcttacagggacagaagaaacacagactcatttagggaagccagactctcggaggatagctaaaattttctaggagaagaaatgaggttaagcaagtgtgaagaaaattccagtagaaaaagcctaagaaggatgcagtgcaatagcctatgtgagaagcaacattcagcttgataatattggctagccaagataaagttggaaaggattaggaatgtgagcctgcagaaatgggcaggggtgagaaatgggttaatgagagctttgtgtgcctgctatggcatttactttttaattttctaggtgagggagtgtcactgaggattggaagggattattaacctttctgtgcccaggacccttttagcattctaacaccatatgatcccggagtaataattttaattgcataaaaaaaactatatgggtgcaaaggaagccaattatattgaagtagaattatcaaaatattaaaacaaatttttatatagtaatatttgtacttttaatcaacccattaaattaaaaagttactaattttaaagtaattattgtgtcaatgttttgaattgtttgcaacagccatattgtcatctgaacatatctgtaacttctattggtgacaattggtgacaaagttatatgttcacattgcagtcatgtgagtctgaagcactggggaactatctgggctggagctattgattagcaagtaagtaggcgtttgctaaaactagagagagaatttatgaggttattcagggagaggatatagggtgataattacaatggacaaagaatagatcttgagctgcacaaacatttaaggcacaggtagaagaaaaggagtctatgttaagagaaggaatggtcagagaaacaagagggggaactaggagaaaatggtattatgaaaaacaaaggagtagaaatttgaaaaaaaaaaaaagtatcagcagtgtgaaaagcattagaaatatccagttagacaaggatgaagaactattccctgggtttcataatatggagataactgatgatctttgccagggcactaacaaatttagacgctaggaagcagtgaaggtaggagcgacgataggggattagggaggggggaaaagcggaatctatgaatatggatgaatgttctgggaagtttggagagaaactagagaatatgtgtaggctaaagtctagttgagagagagaggcttaaaatacatatgagagattttaattactagagtaagtggctgaagaaaatggcagtgccctggtgatgtgtttagtgttgggtggtcagatgggcaccacaacttctcaaactgaaggaacgtggtaaggccatcaggtggaaaactcaaatgccttcatgtttgattgccccaaatttcttgataaagtagaatatattaacaatttctaccactagtgggtggtgataggtagcttgaggagaatgatgattagaaatagtgtgaaatttacaaaaggcaataaacatatcacttagcttatatttccccagtcagttttacaggcaacattctccatacctttgaaaaaaattacttaccttttcccatgctttctcattgcaattatttcctgacagagcaaggcagtttaaaacatgaactcactcttacgtgaagaaggaaagttcttcctttcttctcctttcaaaaaacagatatggatttcaaacaatggcctctggagacactacctgtaacacggatgggcttggtgatgagattttagaaaactagagaggtcaatgtggctgatatagttattgcggtggggcgctctccatataaaataatggacaaatggacatatcttctacacacaaggcagactagagaaaaatacaggtggaaagaaaacttttcaaaatatacaccacttagaaaattattaactccttgaggaaaaaaaattttgaaatttttataatcttgagtcattgcagaggcattctttatatatagtgggggcaaggtagatattatttactgaattaaaaatgtatggtttgcaaaaaacttactcgtatatttgtttttttcaaatctttattccacactcttcaaggatctgtccatcagatgggccttcccccattagtttctttattctaaagcttcgtcctaagacatgcggatacatttttcattgccatttttattcctcaaatccagactcactgaagactgagtagaagtgggggtctactaatttttacttcactgcattgtctgatctagggaaagaagtagaaaaaaaatagatccctgtcttggtcatgttgaccaaaatgaagatatttttaaacaatgagttacaaaacattcagctacctaaatttgacttttgcttctctttctgggcataggaaaacatgataatgttctgtggagtaggcattgagagagaggccagaggtcacatgcaggctgacaccttcttttgaacctcatttcccaagtctagatagtcacaaatagagccttccaaatttcccagaaccattctttagtccctttcaccggcttctcttcttctcccctctgtaaatgttggtgtttcagagatatctgtttctgtatctgtctacattgcaaaacagaacccttcttcggggcagggattgtgttatattcatttattatttaatgcaaccctagcacaaatccaagtatttaagatagttgttatgcagtaaatgctagaatgtaaatgattgggtgaggctcttaattaagactttgttcatactttttaaaatgattattctcaattttttcctaggaaatcttttgttgattatatttgtgagttattttggaaccaaactgcatagacctataatgattggcattggatgtgtggttatgggcttaggctgtttcttaaaatcactacctcatttcctcatgaaccagtaagtactccagtctgataattttgggtggtcaaatttcacttgcaggaaatgaagttgcactttcctctctaggagcaatgctttccaacagcatagggcactgtaatgggaaggggaagatgcacattctgttccatctgtctatttggtgctcttggctgcctcacttccacttaagcagtcagttttgtcaatttacacaatggggatttgggaccttttcttgtggagttgagtctggtgaaaagattctcaggaccagcccaaacttgggattattcccttctcaggaccatgtaaatacttctaattaataatgagattctgcttaattgcagatcaccaagagacagagcagtctgaaggctgatttttcttttaatttttaccaaagtaactatgtacaaagtcataaaaataaaaactattacaaaaaagcttacattgacaaaaaggtctcccttgtcacttattactgctttccagaggcaagtgcttataacttttagctctttcttgtatttgccaccaatttctttcttttttttctgtttttttttttttattatttattattatttttttgagacagtcttgctctgtcacctaggctggagtgcagtggtgtgatctcgggtcactgcaacctccacctcccaggttcaagcaactctcctgtctcaagcctcctgagtagctgggactacaggtaccatgcctggctaattttttgcatttttagtagagacggggtttcactgtgttagccaggatggtctcgatctcctaacctcgtgacccgcccgcctcggcctctgtttttatttttgttgagacagtctcactcactctgtcgcccaggctggagtgcagtggcgccatctcccggttcactgaaacctctgcctcctgggtcaagtgattctcctgcctcagcctcccgagtagctgggattataggtgcatgccactacactcagttaatttttgtatttttagtagagatggggtttccccaagttggccaggctggtctggaacccctgggttcaagcaatccgcccacctcggcctctcaaagtgcgggattacaggcatgagccacctggccaagccttgcctctgtatttctaactaaatgttattctattagttttgaatcctggcataccctgctttactgcatttcactttattgcactttgcagatattacatttctcacaaattgaaggtttattgcaaccctacgttgaagattagaatcatttttccaacagcatgtgctcactttgtgtctgggtcatatttgataattattgcaatatttcaaacttttgcattatttttgtatctgttatggcgatctgtgattagtgatcattgatattactaatgtaattgttttgatgtgccactaacttatgcccatttaagatggtgatttatttatttatgtatttctttttagagatacagtgacgcccaaggtggggtgtagtggtgcgatctcactcactgtagctttgacctccacaggctcaggtgatcctctcacttcagcctctccagtggctgaaactacaggcatgtgccactatgcctggctaatttttgtatatatatatatttttttggtagagacaggatttcaccatattgccctggctggtcctgaactcctgggttcaagcaatgcgcctgcctcagactctcaaaatgttgggattacaggtgtgagccaccgtgctggtcttaagatggtgaatgtaatcaacaaatgttgtgtgtgttctgactgctccactgaccagccattgccccattttttgccctttccttgggcccccttattcccctagatacaaaaatattgaaattaggccaattattataataaccctattgtggccttcaggtgttgaagtgaaagaaagagttgcacatttctcactttaaatcaaaagctagaaatcattaagctcagcgaggagggcaagttgaaattcagaataggcccaaagctaagccacttgcaccaaatagccaagctgtgaacacaaggaaaaagtgctatttcaaggaagacacaaatgattagaaagtgaaacagtgttattgctgagatggagaaagtttgagtagtctgaacagaagattaagccagccacaacattcccttgagccagaagagcaagactctctcttctattctacgaaagttaagagagattaggaagctgcagaaggaaatttttaagccaagagaggtgggttcatgaggtttaaggaaagaagctgtctttataacataaaagtgcaaggtgaagcagcaagtgctgatggagaagctgcagcaagttatccagaagatctagctaagttaattgatgaaggtggctacactaaataacagattttcaatgtggatgaaacagccttcttcttcttctccttcctcctcctcctcttcttcttcctcttcttcttctcctcctcttcttcttcctcttcttcttctcctcctccctcctcctcttcttctcctcctcctcctcttcctcctcctcctccttcttcttctccttctcattctccctctccttcttctttcttctttttgagatggagtctcatgctgttgctcaggctcgagtgcagtggcgtgatctcagctcactgcaacctttgactcctgggttgaagcaattctcctgcctcagcctcccaagtagctgggatcacaggcacctaccaccacgcccagttaatttttgtattttttgtagtgacggagtttcaccatgttggtcaggctggtctcaaacttcagacctcaggtgatctgtctgcctcggcctcccgaagtggaaacagccttcttttgaaagaagatgccatctcggactttcagagatagggaggagaagtcttttcaaaatattactgctaattgacaatgcatctagttgcccaggagctctgatggagatgtacatggagatgaatgttgttttcatgcctgctaacacaacatccattgtgtggccacaaatcaggagtaacttggactttcaagtcttattatgtaagacacacagtttgtaaggatattgctgttataaatagtgattcttctgatggatctaagtaacataaattgaaaaccttctcgaaagaattcactattctacattccactaggaaaaggagaggagggcaaaatctcaacattaacaggaattttgaaaagttgactcaaatcctcttagataaccctgaggggttcaagatttcagtgaacaaagtcacaagactttagtggaggaagtcactgcagatgtggaaagagaaagagaactagaatttaagatggaacctgaagatgtgacttaattgctgcaatctcataataaaacttgaataaatgaagactttctgtttatggacaagcaaataatgtggcttcctgtgatggaatctactactgatgaagagcctgtgaaaactgttgaaatgacaactaatgttttagaacattacacaaagttaggtgataaggcagcagtagggcttgcaaggattgactccaattttggaagaagttctactgtgggtaaaatgctatcaaacagcattatgtgcggctgggcgcggtggctcacgcctataatcctagcactttgaaaggccaaggcgggcggatcacgaggtcaggagatcaagaccatcctggctaacacggtgaaaccccgtctctactaaaaacacaaaaaaatgagccaggcgtggtggttggcacctgtagtcccagctactcaggaggctgaggcaggagaatggcgtgaacccgggaggcagagcttgcagtgcgccgagatcgtgccacttgcactccagcctgggcgacatagcgagactccgtctcaaaaacaaacaacaacaacacaacagcattatgtgctacagaaaaaacttttgtgaaaggaagagtcaattgccacaggaaacttcatcactgtcttattttaagaaatttccacagcccccacaaccttcagcagccgctaccctgatcagccagcagccatcagcgtggaggctaaagcctctaccagcagaagatgatgactcgctgaaggctcagatgattgttagcatcttttagcaataaaacattttcaattactgtgtgtacattgtgtttcagacataatgctattgcacacttaataggctacaatatagtgcaaacataacttttatatgcattagaaaattaaaaaaattcatgtgagttgctttattgtgttattcactttattgtggcaatctggaaccaaacgtgcaatgtctctgagatatgtctatacattagtgttacacaatatgtattgaattcctactataaaatcatttttactatttacatttgtataattatgtaaatcttttttaccactgaaccatgcgcttatcattctttacttatataactttttattttccctagatttaataattacctcgttatatcatatggttagctttctttgtattgttcacgaattcatcaccaaattctccactggtagggcaaatgtctcctcaatattcttatccatatcacagtgtattatttttgtcttggagattcctcacatatcactttcaattctccatctgcaatctgaacttggaattctctaggcctgctgcattgctatttccttggaattttctctcattattatccttgagaatttgctttttacctgtttcatacattcagttattcattttctgggatgtcatgtctcctgctttcctctttcctcttcacttgtttttgtgaaggaaataatctagtagctttccaagaaagtatacaagagaaatataaaatgtaagactttgtatatctgaaaatactcctattttactcccatatttgattgttactttggcttggataaaattctagattggaaatattttccctagggattttgaagacatttcccccaatgttttctagctctatctaacacttgtaatcaagtgttattattcagaatcctatgccgttctaatctctgtgatcagttttctttcagtggaaactattggaattttcttttaagctccaagtccaaaattcatgataattgtcttggtataaatctgtctcctccattgtgccaggagccttcaatctggacatttggaaaagttacttttgttatttctttgataatatctcccctataccttctttcataacactgttttctctttctagatctctattacttgaatattggacatcctgtattaaccttatgtttttctcatcttttatccctacttttttgtcctcttgtcttcttgttactttctgggagatttaactttattttccatgcctttgaatggctttctagcttatgctaccacatttttaattttcaagggctcttattctttgaatgtccctttttaaggaacatactattctttcaagaatgcattatctcttcccatctaaattttgttcatctttcttcttggtctctggctcctccaagtgtaccgtttttttatttgtttgtaactgtctttactgttacagacttctctcatatatctggtggttgtttgttatctattcacatttaagagggaggaataacaacaacaagaagccagctggaagttctgtaaatatgtgtaggacttggttaaaggaggacttctttgtagagtcattacgcagggactggctgtttcgcacatggctcagaattgcagataacctgttatcctagacaggaattcttcaatctgttccttgggaggtagaagcttagctaccagccaaatggaagttggaatctcactgtttaatatgtagatatgtagatttttttaacttaatacccccaatttttttgtattgcctttctatgctcagtgtgcctctccagactctggagtcaatgaacattttcagctggagtggcaggggatgtctctgggagttgaatgtttcttaaacaaactttaaaccaaaatgtttgcactcttattgttttggatcatactcacttttgcatttaagtatcttgcctgaatgttcctgggctttgcagcattgcttccttgcaggcacttagagttgcacttctcatatcttttatttcagtgaccactcagttacctgcttttccattttgaaaatcttgttgagctctcttttattgtaaaattccctattttttttatccttgtggaatcatgcctttccccattctgtttgaaaatctatttaccgtcattttgctgatgctttgggaatgaatagactttgagttactggatttttagtggataaattaacaaaacatattttctcttttaaagtatttttgaagggatcagagtttctaagcagagtctttccttttcttttatttcctagcctatccaaaacaatgtcaagtaatattcagccactgtatacatttctttctaccacctgccaaaggtgttatttccttgaggttgtcatgtctcataggattgtgagtatggagacagaagcctttgtctatagttcacagccaaactctttgggcatcaatgagcaattgttctaaggggaaggtattttgagcctttttattatatcctatagcacagaaattaagactatcagtggcatccaagcataacactctagcttttgtagaactcagaagggcaagttttcttctgactaccttatttaatagaaatacagaaaacaatccagcattatttctaacaaacagagacttcactgaacatactttgaacatactttttttcccatcttacggcatgtaatttactttctgaggaaaagcatgtggatcttgtggtaatttgcttaaattaaatggtcatagtttattaatccatttgttcttatgagaagagaaaaagtcattacattatgtgtcatggtgattgagattctcttaaggcctctcattatgatggacaaatattttggtttttttaggggtttatgaaacgcatggaggagttattgtacggtttctcagaaactggaggtttcgcttcttttgagcaaactttagagaatgccaagttgaaggcttgttttgttgttattccttccaaagcatttatcttcttaattatgcattattgaatgtcacattttttaaagtttgtgttccttatctcataataattatatccaggaaatgataacctaaaaatcaaagaaagttgatatttgataatctaaaggtagatcatccacaggcagattattgaaagctaagtataaaaagattgttcatttacagaaagtggcaagttttttgatgatattaacttatgataacttggatgccaaggatgaaaagccatttttactggatttggatattgtgttgtatgggaagcagaaggtaacaatctgcacattgcccacattgtcctcattactttcttaaaataaactcattttccctgtgtttatacagatatgaatatgaatctacagtttcagtttcaggcaacttgtcctcaaacagtttcttgtgtatggaaaatggaacccagattttaagaccaacgcaggatccatcaggttgtctacttcattgtattgatttttgttcagcgaacttataactaaacactttctgctgaggggcttgaatgagatattgattgagttagataaataaacaaagatatgttctctctccaggaacttccaaaggagttacaatgggcaataagaatagctaataataaagaatgttatttttcttatatttgaatgtatttattgagagttccttgtttatttattaacatgttatctaaaaatgagtcaaagggccgggtgcagtggctcacgcctgtaatcccagcactttgggaggctgagacggatggatcacctgaggtcaggagttcgagaccagcctggccaacatggtgaaaccccacctctattaaaaaatacaaaaattagccaagcatggtagcgggcacctgtaatcccagctactcaggaggccgaggctggaggatcgcttaaacccaggtggcagaggttgcagtgatccaagattgcgccattgcactccagcctgggcaacagagtgagactctgtctcaaaaaaaaaaagagtcaaagacatctatccaaggaccactgttaagttcatcccacagaggaaaacatcttataaggatggatttatgctgatgatttggtgtatatgattatgtaaataggaactagagacagaaacaaagttcaagagatttgtgttctatcactgatctttaatagcggggaaaacaggcaagtacgctatagttctgaattactctattccctttctattgacttaggaacttgtctttctgctctttttttttccccctctactggagatagtgctttaaaattctacacaatagcagtgcttctttcagcttctggtagccctaggcaccaatgtactggcttctgccccttctgtcccttctgctaagagacttgtataatcttctggttatacttggtctggagatgactctgatgactcaacatttttatggggacatttttattctggattcatgttcgtggaaattgcagtagtccacaagggtgggaatttcatgaccatcattgagtcaggaaaccaaaacagtttcaaaaatttgaaaaatgtctgtctcagaagaagccaaagaacccccatgggggaaacaaaggaaaacaatgacattaatagtggcctgtgttctcttcctgagcgggctattgccaaagactgacccaggtgctagtcggcttcattgtggatatagcaaaaccttcccattctggcacatctccaggaaggtggattgatgctttcaattttgccctagaataggcctagagtttgcctgtgatctctagacacaaatcactttgtgcatcacacaaacaaatctgaatacctagaaatagagactattattttccgactggaaataatggagagatagcactcacaagaaattcctggacccagctgtggtcaggacctcacagtctcacctggcaaatttataggaggtgagagtgcattgtccttcagatccctgaaaacgggactccacagagcttcctcacagcttaccagctattttggcttagaacatagatggcaaagagatttacagaatccttcagagatctccctatctttctcagtttctattccctttggtctagtctttgttactctactaagcagctgcggctccaaggattggagtggatttctgtattgaaagttatttggtggttacagtatacaacatgctctatagagaacctatgatgattacccaattaaatatttttagtttctatgaaataattagagctgtagagaattcacactttagcgaacttttgtttaaatcttataaatatagtaccaattctagagaaatatatttttgtctccccaaagttgggtaggaatggggaagcacttgtagcagctgaatgagtccaggagttgtggagaaactgaatctctttgatttttaatgtttgccaatttctgtggtgtaacactgctatgaaactaccaatgaggtgtcactgaacactgagttgggaggaggtgtgtatactcatctctcccaactcagtagggactggctccagcatatcacttacacttgtccatactcaagtccactgtcagaaaatgcactaggggtgccctgagaagtcactgctggaatagtaatataaatcattgacaaggggccatggtcatataactgtgaaatgcctacagaaaacatagaattaatattactgacactttatcgtcaaagcactaatgtcatgtcttttttttttaatgcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattggtaagtatggaaatctaccttagcttcttttcagggcaatatgttccttgaggttagaaattagttatatttttgtagtcttagtgatttccacaatgatgagtagagtatcttggcacagttggccttccataaaagtttgttgaatggagatgagatatgctaaatgacaatgagctacttggttaataaatctactttctactattggaaataccacaagtctagtgcccctggaggtgaccctttcatctgcttggcactacactacatccaatctgttaagagatttgcaaatgttttctctaaaatgttctgtgcattcaaaacctttctcgctattttcactacctctgtttttgttgaggttctcattactttgtctgtagtttctctttattattttctcttcagaattttattttctcagtttttaagaaacattcttgcaatataatttttctcaagcattgttttaatcatgtcttctctactatatttatgacacatataagctcctcatttattaaatctgatctgtccacttattactcatggctctgcatgacattcacttacttagtttctatacagtttctcttcttaatgatctctccatatagtcaggcttcttcatatttttcacaaatacgtcttcatctttttgtttatgtttcttgaaattaccattttaaaatccatgtaggtcacctggaacaatagccaacttaagacccaccttcttgtgctgccttccaatctctgaaatattcttaatttattatgcacgacttgcttatattttttgttattctatcaatagttggtcataaactcataacgtttagtatagggacattttgccattaatgtatgtaggcatatcttttaaaaactaaaaaagtcaaagagggtgagagaagatggaaatgattacacataatccagatggatgaaaatattgagggatcattaacccaagtgacttttcacacattttggcaactcattaattttgcaataatctttttcagtgattttctattcagtccttttaacttccttcacaaacttatattaaaagaatgcaaacactctcctacaataaattaacaaacaccttgctatgacatctgtttctttattcaacaaatactatggtgtattatatgtaaatgtagctgtgataatctctatacatattaaaatgaggatgatgtggtccatacaaggttagtaaataaagaactacataattattagtactatatatatgtagtgtgtatatatatgtatatacatatatagtgtgtgttcatgtgtgtatccataaccaaataactataaatcaaatagctctacaccaagaaaacagttccatatggctctggagtttagaagagaatataaaagctaggttaaaagttggaaaattgaccaggtgtggtggctcatgcctgtaatcccagcactttgggaggctgaggcggacaaatcatctgcagtcaggagttcgagaccagcctgatcaatatgatgaaaccccgtctctactaaaaacacaaaaattagccgagtgtggtggtatgcgcctgtaatcccagctactcaggaggctgaggcaggcagatcatctgagttcaggagttcgagaccagcctgtccaatatgataaaaccccatctctactaaaagtacaaaaattggccaggtgtggtggcatgtgcctataatcccagctactcagtaggctgagacaggagaatcacttgaacccgggaggtggatcacttgaacccgggaggtggaggttgcagtgagcactccagcctgagcaataagagtgaaactccatctcaaaaaaaaaaaaatggagaggtaataaatgaaatcaagagggagaaataaggttgctgtggaagaacatatatatactgagagatattaggataaaatactgggaaagacttttacttagtaaatagaataggagaaaggaaaatcaaagaaggaatagtcataagaacacaatgaaacaatacatgtatagtttaatgaaactctcaggaagaaatgtaaaaagaggagttggccagcaatgtcaaataacctagaaagctaggaagatgaagaccaaaaaaagacactaaattagtgacaaagagatcactggggctacctgagagtatttggaggagaatgtaaaaggatttgagtaaagtgagtgagaggtgaggaagtagaggcagagagtatagtgaaaggagagaaagcagggtggatttgagattttgtagaatcattggctacggggaaattgaacgcgcacaagagagggagtatttggtagagcaaaaccttagagaagatagaaggggttggaaccaagaagttaggtgtgtatagggcgggttctccaagaaccatggagaaggcagagataataggcaaagccaaattttgaagtgaacaggaagaaagttgaagaagctcgtgtctggattttcagagatcagggagggttcagcataggttctgaattgtagacaagtgatgagacagctgatgatgaaattttaatggataagaattcaagtgaagacagataggactgatggacatggaaaataaaactgtggaagtaaaggaaggagaacatgataaaatcaaagacttgtatcatataataataatgaggacatagccagaaggaagtttcaagttgcagatctgagagtgaaacttttttgaggaatgtgccatgagaaatccactataagatggtattgctttagaattcctcccaaaacatgcctgtgggatgaattaacaggaccttggttatatcacgacctagtcaatggcatgatcccagctgggactgcctgtgctgttacagcaaatctctacctgtgacccagcatgaaagggaatttggaggccagggaaagtggctttaaattatgaggcttctttttcaacatttacagaaacaaccatcatttatatgtacatcaagcttaacttcatataaattgtgtatctagtcaaaagtatccaaggcaaaaatattcaatcttcaggcttttcatagacctagaactctttatgtgggcatataactgtactataaccttatacttttatttatttttagggcttgtagaaacaggagctattattggtcctttgattggacttttgttggcatcattctgtgcaaatgtttatgttgacactggatttgtgaacacaggtaattcaataaaatctatttgtacagtgtctagactatacaaagcatctcaggtatgttatcatatataatcatggccttacttgaccttcaatttgataaatgatctctactttaaaagtgagaaactctagtggaggaatttaaataacttttaaaatattccaaaccagaaagcagtagtgcaaaataaaatgctaatctgacacagaatcacatgctatttctagtgcacttcaactatatttcttggttttacaaaatttaagcatgtaggtttgaatttatttcaattaagcaatcatttgttgatgatgaaatagaactttaagcaatcatttgttgatgatgaaatagaacttgtagctgtttagttaatacctgcttttaaatcccttacatgatagacagataaccagcctaatttattactagacaatattacaacaccacatattattagaaaaattttatcagtgtctgaattataagccaattttatagttggttgggacccgataattctaattttaataattttctatagttcatacagaaaatactgacttaagctaataacagtgtgtgtatttttttacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaaggcaaatatacatattctaaatactatgaaattgaccttttatttcatatagatatgtctgtattttagtctaacactatgatatgctatgctgtgttgagacaatttgtcatcaacagtcaccagtcaagaatacctaactagtccgattcttcctatggtactacttgaaaataaatattataatttggaagctgaaatatttcagatcagcatttgtgtaaacttttatgtcagtcttggcactctcctctctctctctctttcatatatatatacacacacatatatatgtacacacacatatatatatacacacatatatacacatatatatgtacacacacatatatctacacacatatatacacatatatatgtacacacacacatatatatatgagagagaggagagagagggtcatgtatatatatacacacacgtatatatatatatacacgtatatatatatacacacacgtatatatatatacacgtatatatatacacatatatgtgtgtgtatatgtgtgtgtgtatatatatacgtgtgtgtgtatatatatatatatatatacacacgtatatatatggtcccatttgctcaaaaaaccgattttacagagaacataggttgaattgaaacaaaatgaacaagcaaatttaaactaagaacaaaagtaggaaaaagtatactctaatcttaataggtagtatagttttgtaaccagtgtgttagtttaacgaagagcttcctggaagttaaatcagaaagaaaaaaaaaaacatgatcggtgacccacctctctatacttggtagagggaagaataataatttttaaacagaagcagttctccaaggaagaaattgtaaaaaaatttaaaaatgatcataagatacatgatacaggtaatattgagccacatagtggttttccagcaaatgaaagggtaaattgcatgtaacattttttttggtacagaacctcaataaaagctcaaagtataatttacagaaggtttttctgtgggaaactaaactaagatagcctaagtatttagtactcaagagcactgatgctcaaacttggctgcacattggaatcacctaggaaattttaaaaatgattgatgcctgaaagttctgtagtattcccaaaaggtcagatttaattagtgtggatgtgcagcctggctattggaacttaaaaatgtttatttgacggatggtgagggtctcagttttctgtcaaatggggataataatagtacttactatagaattgttgtgtgaaggtaaaagacattctagcacacattattattaatactgatactagtgttagtacttttatgttgtcattgttgtttctatcatcacccataagttacaatgtcaatttgcatagaatttttcttaacaattgtaaattctcttaaatcataattgagcataatttaatacatctttggtcattaggagccaactcagaatcttgcaaattctcagaatcattctgatgatattaaaaactcttcttaaaggattgttatggactgatagacctcttgcagtctgcaagatcagttccattttcaaaattaggaaagagcttagcttgttgcaagacatagaaaagaaacttgtgctactgaaactcatctattaggacagggatgtcaacaaacatgggtgacttaaaaatcttcagataactctctctcctgtcaggtaccctattcataaatataaattttacaattataactcatttacttgcattaatctgtgtgtcctcctcttctaaattgtttatttattgaaattttgttccagaatgaattgtgagcagtttattaagcaaaccaagattgtgcataagaaagtcaagacagagaacatgtggacaggaaaagtgaaaggaaattaaaagtgagaacttgagcctgaatggtagcagtgtgaccaagaacatttactagaagcaggccacacattactagaggcaggccacacattactagaagcaggccaaacattactagaggcaggccacacatttggctctgtgctttttctaacaggaatcatttttgattaaatcatttacatagtccttagaatgtaccaaatgaatcagcatctctgagggtgggacctggatgttggtattttaaaaaatatctccaggtagatcttgctgagaaccaatggcagaaccactgaaactgttgttctgaagaagcaaaaaaaaattccggatacttgagaacattcatatctcattaattcccacacatctttatttcaaatgttcagggagtgataaaataaatatttgtgtgaaatcttctttatcaactcgattttcctccagactttacagaacagaacaagcatctttcattctaatgagctgtagaaaaaagaatatattaatagaagaacaaaaggttagtaataaaatgctgtggacgtagacaatattttggtcactttgtagttttgcttactgatctttaagactcaacagtgacttattgagggcaaaactgttgtgttctgatccctacccagtcagctacatcactgacttccagaagccaccaaaacattgctatgacttcagctttcaaggggaaaaaagaattagcaaacaatacatattacaaaatagtaaaaaacataatttgttgaggaggtggatgtttcaggaaaagccagtcacaaaatgcaaagccaagttcgtttgacacagttgtcattctttcatttcagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatgtttgtttttctctgccttactagcacactttcccccccacgaacagtgtgatggcgggtgtagcaaactcctaagttgaagtgttttaggatattttttgactctggtggatttcttccttctaatctcaagaaagaaagaaagaaagagaaagaaagaaagaaagaaggaaggaaagaaggaaggaaagaaggaaagaaagaaagggtagggaagggaagaggtcagaaataccttgattttcttctctctgaagtcagaatgtgaattcataatatgaatgcaaatatttgggagtgcaaaaattacatattttcagataggattgtgcattttactaccaaattttactctttttggttccagttcaaggattctatgttcctcctaatttaattttttggtccccctagtggttttaggtgtctctgcagccacacacattcggcttttcctgcaaccacactaacctcagtggttttagcctaacttgggtttttcctgggatctttccactgtttttaaaagtcaatatcccaggctacttgtatccacactacctaaagtgcttgtgaaagcttcaaatacctggggttccccctcagacacactgaatcagactctagggcgtggggctctggaatggatttttaacaagctctctcaataatatgattcggggagccagatgctcacattgtatagatggaacctagggctatcttctcctttttctattcttttttttcacttattgggaagggttcagagaggaagagccagtagcagcaagacatgaaatgtaaatacacttgacagcaacaggctcagcaaagtgactctctaaagtaccttgaactgggtgtggtggctcatgcctttaattccagcactttgggatgctgaggagtgaggatcacttgaggccaggagttcaagaccagcctggacaacatagcaagactttgtctctgcaatttttgtttttaaattagccaggtgtggtgttgtgcacctgtagtcccagctacttagagggctgaggtgggagcatctcttaagcccaggaagctgaggctccagtcagctatgatcatatcactgcactccagcctgggcaataaagcaagattctgtctctaaaaaaagaaaagaaaaagcactttgagaggagtctaattcttcacaaccaaagtgaggataggtaactgaaaaattgtatatatatattctcactacacagaatagagggtaataaatgaataaattactggccaattttgacttgccacttctacctggatcctaagaaaagagatttttatcatgatctctgcctataagaaattcacaagctactgcaatgagttaaatgaatgataatataataacaagagtctcccaaaatatacttccccattatgggggcatttcaaaatctccctgtgggtaatgtgtaactaagtggggataaaattaaatcattcttcttcactatgagttggacctaaatagttacttatataaggcatattacataaaagtgataacatatttgttcctttggtaagtcattttgtaaataatattttatttgcatttataggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaagggtatgttgttttctaatgaatgtgagaatctttcaacaaatggttaatatgatattttttacaatggcaatgcacgatcagatcattttcttattggagttaatgatagtaatccatgcttttcctgtatctttcctccatctgtcaatcaagccaatctatccaagctctaggcttattaatgaggttgggaacatatcacagggtgagtgaatttatgattgtatgtgcatgtgggtgtgtgtgcatgattgtctttgtgatatccgagtagacattatcctatgaaagaaactacctacagtttcaggttgtattaaaatatgttatccatatatcttatactcccataactgagtaaaactaagagttgattatacagtcaaaatggcctttatatgtttccccaatgggcttaagtttggcataactaaatcataatacatgataaattaattaatacataattcatatatttcatttatattgctatgtctaaaatattgaatcatttcatattttgtattttaaaggttatctgggttttactgaaatgttttccatagtgatgtacattaaaagaattcacctgtagggcgtattttgacaatcaagctatcagttaaaatgaaataaagaacatcctaaaatgttttttcaaaattatcaaggtttattagattgaaataatttcaaatgtaaaatagtaatataattttacatatgctatttgatttgagactcatgagcttcatctaagataagcattattatctccactttacagattaaattgagattcagagaaatttaatgataaaagcagttcatttcaaatctcttcaactacatcaatatagaaatggattttaaaattggaataaattttaaagattgcctccatctccaatgatgctgattcccagacagaatgtgtagaaagtcgcactgtgatctagtctgaatgcagtctctaaactgctatgcaagtgctctttcaatcatattacaagcactggtcactttttatattagtagaatgcacttctttaattcaaatacctatgtttctggagctaaatgtattatctatattacaaatggaactttcagatttttatcttcatgctagtcctgtcttgctatttgctacctaatggatgaatcacagagattagttcatcttcatctttcgagatctaatagtatgtgaaaacatgactccacatggtaggtgctcaattaatgcttgtttattgcctatatattcttctgagataaatcattgaaggagtggctatgtggtcatcaaagcaggtctcttttataccaaagctatagtaaacaggtcacacattgatgactggaaaatttctctttctattcatgggaggagaggaaatctaactggggattgagatgaaaagaagaaaaaaaggattgaatcctcttttaatatctatggcattattttaaatcacttcagaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtaagacatcctatttgacagaacttttttgagttgcattggtacttcccaactatgaactgggcctatatttaataaaagtaaaattagtgtttcctcaaaaccatattactttttttgtatgtggaaaaataactctatgatggtcacttgattaccttttatttcccagatcttatgtgaaacctccatagcatctgaccagtgatctgaaatttccaagaagtttatattattactcaaataatttgggttgtaaatactctggactaaaaaaattttatcattgaaataaagttggtggttttgatttcaattgtccagctaattgctttgctatatatatatacatatatatatacacacatatatatatttctgtgtatatgtatggatgtgctttctgtgtttttcacattctgacagttctttgagaatttagaattaggaatgttctcttgcctctaagatatcacaatataatataacatcaattgtaatattaatataacgttggttggtgatcaaagtaaactataaattttgattcttattaagacctggaaacatgtaacaattcaaaaaaggttgacaattctttttttgaaagaaactatttcttttcttttcttttttttgagatggagtctcactctgtcgcctaagctggagtgcagtggcatgatctcggctcactgcaacctccacctcccaggtataaacgattctcctgcctcagcctcctgagtagctaggatgacaggcacatgccaccatgcccgggtaatttttgtatttttagtagagacgggatttcaccatgttggtcaggctggtctcgaactcctgaccttgtgatccgcctgccttggccccccaaagtgctgggattacaggcgtaagccactgcgccctgctgaaataaactattcctttgaagcaaagctttatttgtaagcatctaaatatttcagttgagcactctgaaacagattttgtttgtccaatgtagtgttgtatcaaaacactgttttaaaaagtgtattagctgggcgcggtgtctcacacctaggaatcccagcactttggaaggcagagaccggtggatcatctgaggtcaggagttcgagaccagttggccaacatggtgaaatccatctctgctaaaaatacaaaatgtagctgggaatggtggcaggcgcctgtagtcccagctaccccagaggctagggcaggagaatcacttgaacctgggaggcagaggttgtagtgagccgagatcgcaccactgcactccagcctgggcgacagggtgagtctctgtttcaaaaaaataaataaataaataaaataataaaaaagtgtgtctttagggtaacttattagttattacaaatttactattcatatttagaaaaatataccgtttttctgaaatcacccttccagttttgttatatggtgtaatcttgagagacatcataatggagatggagtaaagggaacaagcagtctccatcttgatccaactggctgtgtagaaaatgtttaaaatttgtgttcaagatttttacttcttagtataatatgttattttttggcaggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtacaaaattattttctttatttatatttttttggggtcatttattaaggtagcttgttctaagaaagtcactcaggactcagtatctaagaactcagtgctctaatgtaccatttattaagggttttgtattaagcattgttggatttcacaaaattttaaagttagcaatgcacatgttcatctgctggcatttcactcctattcctcgctacttttcttccttatttcttagagttaaatgagtggacctctcattttgtgacaaaagagacacatttatatcttagggtaggccgtataaaatggccattttgataggtaaagagtgggtgcctagcagccatttcctagggttcaacctataggacagcagtgcaaagctgtcagaagcccccatctcgctaaggtcacttgatctttctgagctccatttttctttaataataatgggcataataataaatacttggctctcttacaaggctactgtgagacatcaatgctgaaagactttctaaaactaggaaattgcagagccagttttcaaatttaggtatattaaataaatcttctttcaactacaccagtctttgtgcctagtaaacaatcctgaacataatttgcattttttctctctttttcttcttcttttggagctctaaagtagagttcagttaatcacaatgctcaagtcataacacattatcatcataggccagtgcaaggattctctcttattttacttcatttatttatttatttctattcaattccctacttccagtcaccatagctgctcacttaagtatgacagatagatgtcttaaatatgtatttcctttgtaaaatattagaattttttgtgtgcatctgtttttatattcacaacaatggtggtgtggtgttaagtcttgttccgattcataaggtagatgcatagataaattcaccagtcctatttagagtaatttttatatcatcactgcatgagagttagaattatctaactttgtgatgttgactaatccaatgggtgtaaaatactaatgatagctcattgatgtgtcaatatgtgatgtcctgatacactgagcttaagcatctcttcaaataactttgtagctaaaagttattcatgatgcttattcaatttattttacccactttactcattatatttcctgcatcctatgtttttcttgatgaatttgatgattactatgtaaattacagatattaatgtaatactgtttatatgatacaattatcttcacttagtctgtcttctttcttttaacttttacagtgccatttatgaaatgaaatcctaaattttgttgtactaaaatctaacaagtttcttaccttagtgtttgtgtatttggaagagaagtcacatttttaaaattgcttccacatttctaacttataaaaatattcccttaaattttattcccccctggctttcccgctttaccttttgcatagttttttaagccatctcaaatctatttttatatgtggtttaagggacatagatatccagtgttatttttctccgaataataaagttgttttccaaaatcatagtgtatataatacgtcctttttcctttgatttgtggtgccaccatctcaagtttttataattagtgagtctatttttcatccttattctgctccacagatttatttgcctgttcccataccagcgtcaccttgatttaattactttggccttgcaaatgttaatatctcatatggtaactttgcctcacccacctgccatcttcacttttcctttattctttctttctcaaacttattttgctgtctgtggatctttatatcttcataagaattttgactgagtttgtgtagattccatagattacttggagaaaatctgacatcaaatatttttgaacatgtaatatcctgtcatttgcttaaatattcctttgtatccttaaagttcttaaaaatttttcataaaggtgatgtgccattagattgcttcttaagtactatatataaatatataaattatatatgcacatatatacatatatatgtctctatatgcacacacacatatgtacatacagccacacagatacatacacacacgcatacatacacacacacacactgagaaaaacaaacggtttctctattcaaacagaacacttctgatagccagatgtgtgtattattttcctacactgttcaattctgcaacaccaactgggtgttctactgttccatgcaattctagtgctatctgcatagactttgcatcagatggcaaaagttaaacggttcagtcctacaagactgcccccactttagatgtcaatcacaaaatcacaagtccagacaccctgggctgcttttttttttttttaccctgggcttctgactgacaaacgatgcattaaggttgatgcctccattttctagaatggttcacagaactcagggaagaaacacttttcttacatttactggtttattatgaaggttattataaaagacacaaatggaaaccagggtggagttggggtgtgccactctcctggcatgtggatatgtttaccaactcagaagctcatcaaatctcctagttcaagagcttttagggagcttgatcttcagcacacacatcccactccattctcctggaggtctgagtgtggggctgagaattccaatcttctaataacttggtctttctggtgaccagtcccaacatcagtctgggaggccaccctgtcgtctcattactatagactcaggtgtgatcaaaacaatctccttaagaatgacaaaatacattcctatcactcaggatgttccaagggaattctaagaactccaaggacacgtgtcagaagctagggacaaagaccaaatatatttctagtgatgccatacacacacacacacacacacacacacacacacacacacacagaatggtaccattaccatcacaaatgtacaatatacatatatatccatctacatgtaaatatttgtgattgcaaatatatagagatatgaatatgtatatgattttaaactgatttatatttgtattgattttaaatatatttaaatttatatttgtattgcttgtaaataattgtgattatcaatgtgattgtacatggtattttgtatgtatatgtatatatgtgtatcatttccccatatacaaatataaattttatatctagattataattacatagcatataattaaaattatacataaaataaatcagaagtaaaaattagatttaaaaaattaatcatatataaatatagtttttttaattttaaatttttatgggtatatagtaggtgtatatatttatgggttatgtgagatattctgatacaggcatgcagtgtgtaataaccatattagggtagatggggtatccattccctcaagcatttatcctttgtgttacaagcaattcatttatactcttttagttattttaaaatgtacgagtaaattattttccactatagtcactctaatacactatcaaatagtaggtttaattcattctttccattttttcgtacctattaactatctctacttccccaccacacccaggctaccctttccagcctctggtaacaacccttctgctctctatctccatgagttcaattgctttcattttttcttttttttctcagatggagtctcattctgttgtccaggctggagtgcagtggcacaatcttggctcactgcaacctccgcctccctggctcaagcgatcctcctgcttcagcctcctgagtagcggggactacaggcatgcaccaccacacccactaatttttgtatttttagtagaaacagtgttttattatgttggcccggctggtcttgaagtcctgatctcagatgatccatctgctttggcctcccaaagtgctgggattacaggcatgagctatcgtgcccagcctgttctcatttttagctcccacaagtaagtgaggacatgcaaagtttgtcttttggtgcctgccctactttacttaacgttatgacctccagttccattcatgttgttgcaaatgaaagggtctcattctttttttttttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttgaacatttgggttggttccaagtctttgctattgtgaatagagccgcaataaacatacgtgtgcatgtgtctttatagcagcatgatttatagtcgtttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcaatttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacacctatgtcctgaatggtaatgcctaggttttcttctagggtttttatggttttaagtctaatgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtaccgtgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctcctcaaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcatctgcaaacagggacaatttgacttcctcttttcctaattgaataccttttatttccttctcctgcctgattgccctggccagaacttccgacactatattgaataggagtggtgagagagggcatccctgtcttgtgccagttttcaaagggaatgcttccagtttttgcccattcagtatgatattggctgtgggtctgtcatagacagctcttattattttgaaatacgtcccatcaatacctaatttattgagagtttttagcatgaaggattggtgcattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaaactattgattattgccacaatttcagctcctgttattggtctattcagagattcaacttcttccttgtttagtcttgggagagtgtatgtgtcaaggaatgtatccatttcttctagattttctagttttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattaattttttgaagggttttttatgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagttttacttcccagtatgtggtcaattttggaataggtgtggtgtggtgctgaaaaaaatgtatattctgttgatttggggtggagggttctgtagatgtctattaggttcgcttggtgcagagctgagttcaattcctgggtatccttgttaactttctgtctcattgatctgtctaatgttgacagtggggtgttaaagtctcccatcagtattggcctgcgcccactgtctggcactccctagtgagataaacccggtacctcagatggaaatgcagaaatcacccgtcttctgcatcgctcacactgggagctgtggaccggagctgttcctatttggccatcttggctcctccccctcattcttttttttatggctgaatattactccatcctgtatatgtaccacattttctttatccattcatctattgctggacacttaggttgcttccaaatcttgactattgtgaatagtgctgcaataaacatgggagtgcagatatctcttcgatacactgacttcctttcttttgggtatatattaatacctagaagtgggattgctggatcatatggtagctctattttgagttttttgaggaacctccaaactgttctgcatagtagttgtacttatttacattcccaccaacagtgtaggagggttccctttactctacatactcaccagtatttgttattgcctgtttttgtataaaagtcattttagctggggtgagatgatatctcattgcagttttgatttgcattcctctcttgatcattgatgctgagcaccttttcataaaattgccatttgtatttattcttctgagaaatgtctcaaattttgctcatttgttaattggattattagattttttttctatagagttgtttgagctccttacatattctggttattaatcccttgtcagatgggtagcttgcaaataatttctctcattctgtgagttgtctcttcatcttgttgtttcctttgctgtgcagaagcttcttaacttgatgtgatcccatttatccatttttttttcattagttatctgtgcctgtggtgtattactcaagaaatctttgttcagtccaatgtcctggagagtttcctgaatgttttcttgcagtagtttgttagttggaggtcttagatttaagtctttcatcgattttgattgatttttgaatatggcaagaaatatgggtctagtttcactcttctgcttatggaaattccattttccctgcaccatttattgaagagactgtcttttccccaatgtacattcttggcatctttgtcaaaaatgagttcaccatagatgaatggattttttttcagagttctctattctgctccattggtctatgtgtctgtttttatgccagtaccatgctgttttggttactataggtctgtgatataaattgaagtcaagtaatgtgattcctccagttttgttctttttgctttggataactttggctatcctggatcttttgtggttccatattaggattaccttttctatttctgtggggaatgtcattggtttattgatagaaatagcatcaaatctgtagattgcagattcctttgtttggttttagcaatattgtttctttcaatttatgagcatataatatattttcatttatttgtatcctcttcaatttcttgcaccaatgttttacagtttttattgtagagatctttcacttctttagggtaattcttagtgattttattgcatttgtagctattgtaaatagaattacttttttttagactgtttgctgttggcatatacaaacactactgattttttatgttgattttgtatcctgcaactttactgaatttgtttatcattttgaatggctttttggtggagtctttaggcttttcaaaatagaagatcatatcatctatgaacaatgataatttgacttcttaatttcaagtttggatgctctttgtttatatttcttgtctgattgctctagctcagacttctagcagtatcttgaataacaatggtgaaagtgggcatccttgttatgtcccagattacagaataagggctttcagtttttccccactcagtatgatacttactataggtctctcatatatggcctttattatgttgagccatgttccttttatacccagttttttgagagtttttttttttaccataaagcgatgctgaatcttatcaaatgttttttccacattaattgaaatgatcatatggttttattcgtttgttcttttggtatgatgtatcatatagattgatttgcatatgttgaactattcttgcatctctgggataaatcccatttggtcatgatgaatgatcttcttaatgtgttgttgaatttggtttaatagtattttgttgaggatttttgcatcagtattcatcagtgatattagcctttagttttccttttttttttttttcttatgtgtctttttctggttttggtatcaggataatactggcctcatagaatgagtttggaaggcttctctcctcttctgtttttcagaatagtttgagtatattgatattatttcctttttaaatgtttggtagaattaggcagtgaagccattgggtcatttctttgctggagactttattacagcttcaatctcattactttttattgatctgttcaggttttggatttcttcatagtttaatcttgatgggttgtatgtgtctaggatttcatccatttcttctaggttttccaagttattggcatatagttgttcataatagccttgagtttaacatagtttaacaataatgtcttaaaatcctttggatgtctgtggtatcagttgtaatgttttctttttcatatatgattttatttatttgagtcttctctcttttttcctagttattttggctaaagggtcatcagttttgtttttcttttcaaataactatttcttttgttttgttgatcttttgtattgttttcttcatttcaatttcatttatttctactccgatctttattatttcttttcttctactaattttgtgtttggtttgctcttgcttttctaattctttaatatgcattattggttttttttcttttcttttttttttgagacggagtctcactctgtcgctcaagttagagtgcagtggcgcgatcttggctcactgcaacctctgcctcctggttttaagcaattcttctgcctcagcctcctgagaagttgggactacagtctcacaccaccacacccagctaatttttgtatttttagtagagacgggatttcaccatgttggccaagatggtcttgatctcctgaccttgtgatccacccacctcagcctcccaaagtgctgggattacaggtgtgagccaccacgcctggcccattgggttgtttatttgaagtttttcttcttttttgatgtaggcatttatagttataaacttccttcttagtactgctttcactgtatcccatgagttttggtatgttgtgtttctgttattatttgttttaagaaatttttaaattttcttcttaattttctcattgacccactggtcattcaggagcatattgctcaatttccacgtgtttgtatagttttcaaatttcctcttgttattgatttgtagttttatttccttatggtcagagaagatacttgatattatttcaattttttttggatgttttaagacttggtttgtgagctaacatatggtctatccttgagaatgatccatgtgctggattcatatttgtattctgtagccattggataaaatgttctgtaagtatttattaggttcatttggtttataatttggatgaaatccaatgtttctttgtttatttatttatttttttttttggtctggaagatctgtccaatgctgaaagtgaggtgtgaattcttcagctattattgtattaggctctatctctctctttagctataataatatttgctttatatatctgggtgcttcaatgttgggtgaatacatatttataacttttatgtcctcttgcttaattaatccttttatccttatataatgatcttcttcgtctcttcttacagtttttttcttaaaatctattttgtctgatataagtaatgctactcctgctcttttttggtttctattggcatggaatatctttttcatccctttattttctgtgtctgtctttatgagtgacatatgtttctagtagacaacagattattgggtatttttttaaatccattcagctactttatgtcattgtattggagagcttagtctatttacattaaataatcttattcgtaagaaaggtcttactgctgccattttgttatttgttttctggttttctcttcctttttttcttcctttcagtgaaggtgattatctctagtggtatgctttaatttcttgcttttttattttttgtgtatccattgtatgttttttgatttgaggttaccatgaggcttgcaaatgctatcttatagcccatttttttaggtgataatatgttaaaattgcttgcataaagaaactaataagcaaaaagaaaactaaaaaaaaaactctacattttaactttgtcctcctaatttttaacattttgttatttctatttccattttattttactgtctgtgtcttgaaaagttgttaatatttttgattggttcatcttttagtcttcctagttaagagtagtttatacatcacagttacagtgttataatattctgcatttttttgcttacttactatttccagtgatctttgtaccttcagatgaattctcattgctcatcaacatcctttcctttctgattgaagtactccctttagcatttcttatagcatgggctggtattgatgaaatccctcagtgtttgcttgtctgggaaaatctttatttcttctttatgtttggaggatattttcaccagatataaaggtaaaagtttttttccttcagcactttaagtatgtcatgccactctctcttggcctgtaaggtttccaccgaaaagtctgctgccagttgtattggcgctccattgtatgttagtcacttcgtttctcttgctgcttttagaattgtttatttatacatgaccttgcggggtttattgaattccttgaggtaatctttgggttaaatctgcttggtattctataaccttcttgcacttggaatcaatacctttctctaggtttgggaagttctctgctattatccctttgaataatctttctactcttatctctttctctaccttttctttaaggcaaatagctcttagatttgccctttagagactattttgtagatcgtgtaggtgcacttcacttttttttattctttttttcttttgtatcccttactgtgtattttcaaacagcctatcttcaagctcactaaatctctcttctgcttgataaattctgctattaagagattctgaggcattctttagtatgtcattgcatttttttaactgtagaatttctgcttgattctttttatttatgtcaacctctttgtaaaattcatctaatagtgttctgcattttttctctgtattatcttgaatttctttgagtttcctcaaaatagccattttgaattctccatctgaaaagtcacatatctctctttctccaggattggtccctgctgccttgtttagttcctttggtgaggtcatgttttcctgtatgttctttatgcttgtcaatgtttgttgatgtctgggcattgaagagttaggcatttattgtagtcttcacagtctgggtttgtttgtgccatccttcttgagcaggctttccaggtattcaaaaggacttgggcccgcaagcccaataatgctgtggttcatgtagactcacagagttaccactttggaggtcttggataagatccaaaagaattctctggattaccaggcagagattcttgttcttttgccttaatttcttccaaacaagtggagtctctctgtgctaagttgcccagaagtgggggtagggtgatgcacccctgtggccaccaccactgggactgtgctgggttagattggaatccagcacagcactagtctcacccaaggcccactgttacctctacctggctgccacctatgtttgttcaagacccaactctacaatcatccagtggtaatccagccatgtttttgtctttcccttcagagctgtgagttttcccagtccccaggaaggtccagagatgccatccaggagcctgggatgggtaaaaaatcatacaaatctaccttatgctctatgctagtgtggctgaggtggcactcagactatgagaaacacctttttactcttctctcccctttccaaagtcagaggagccccaccccatggccaccaccaccaccacaggcccacagggaatactgccaggccaccactgacgtttacttaaggcacaagagttctttagccagcctgtgtgaatgctgctaggccaggactcacccttcagggcagttagctctcctctggcccaggagggcaggttcagaaatgccatccaagacccaaggcccagaatctggaactgcaaaaacatgcttggtgctctacccctggggtccctacccacactgggccacagaatattaccagaccctggcctggtaggaatctggcctcacagcaggagggagcagcgagcattaccccctgagttctgcctcctgtcagatcagctgtagcattagattctcataggagcgtgaaccctattgtgaactgcacatgtgagggatctaggctgctcactccttatgggaatctaactaatgcctgatgatctgaggtggaatattttcatccaaaatcatccccaactcctgcctggtcagtggaaaaattgtgttccatgaaaccagtccctggtgcaaaatgtttgggaaccgctgctctaccccattgtggctgagctgttacctaagatgcaagacagaattccctttgcttcctgtgcctgtgcttttctcaaacagagagtctctcaccacagctgccacagctctgaatgtgctgagtctcatctcaatacagcacacctgagtctcacctggggcccataacatactacctgcgtatagctgttggttattcaggccccaagggctctttagccagcatgtgatgtatcctgccagtactgagtccttctcttcaagacagcaggttcccttctgatccagggtatgtctagaaatgccagccaggagctagggcctggaatgggcacctcatgacccttaccagtgccctatcctactgtggctgagctggtatcacagatgcaagacaaagtcctctttactcatttctcccctctcctcaagtagaaggaaggaatctcttttggagccacaagctgtgctgcctgggcttgggtgaagggtggcacaagcacttccttagcttccctggctggtgtctcagtagggaagtgactcccaagtccattggctctgagcccagctcagcactagaacttgcctaggagttgtagtccttgcaacctagactgcctttcaagtttatttagggagagcacgtttgcccatggtggcgaggcttgctggaactcaagttctaactgtggggctgggtgattactttctggtgatagctagtctaaatgctccctccatgggtaagaatcagctgagtttagcttggttttgctttccactgtgacagggcagcacaggatttaataaagtctcagaatcactgcattctccctctcccaagtgctcagattccttctccatgccatgtggccactgctgggggatgggagggctggtgttggcaattcaagaccatttttcctgctctcttcagtgcctctttctgtgatatgaagttaaaaccaggtattgtgagtgctcacctgatttttcattcttacaaaggttttttttggtttttttttgtatgtagatagttgttaaatttggtgttccttcaggagggatgattggtggagacttctatttagctccttgctctacccctcccttataaattattgcactattttggacagataggtctgtgtgtgtgtgtgtgtgtgtgtgtgtgtgtgtgtgtccatatttatctctatcatctctacgcataagtagagataggtatatatgtatatgtgtggtactgttctcttatattttctagttggttattgctggtttagaggaatgctgctgtttttaaaaatttactttttatacagcatcctttcttatttgttctcataatttgttgattttgttaggttttctatgtaggtttttcaatgtgcaaatatgacaagttttgtcttttcacttccaaaccttacacatctgagacttctaaaattctcttatagcataaattaaaacctccaagatttatttaactgtagttgtgatagtgagtattcttgttcttttctaatcttagtaagaactatataaaatttatttattgttattcttactgcagatttttagtgtatctagtttctgtgttattaaaaacaattttttttttttgagatggagtgtagctctatcacccaggctggagtgcagtggcgcaatttcagctcattgcaacctctgcctcccaggttcaagtgattctcctgcctcagcctcccaggtagctgggattacaggcacccaccaccacacccagctaattttttgtatttttagtagagacagggtttcaccatgttgaccaggctggtctcgagctcctgacctcaggtgatccgtctgccttggcctcccagtgtgctgggattacaggggtgagccactgcgcctgaccaataaaataggtattaataagaaaaagtgatgagtaaagtgccagtgaccagaaatgggctcctgtgtaggctgccagctggataataaagccctgaataaccaataagtgagcatgaaagtaaaattttgaatgttcattatgtgtgactagcttacaactggccttttcaagacaatatgatagttttaaatctttatttttcttttatttacaaacttatttacttttcaggtgtatgaaatctgaagagaagtcccttggtgtgggattacatacattttgcacaagagtatttggtaaaaatagttattttttcccacatcctatcagaacaatattattattattattttttattacactttaagttttagggtacatgtgcacaacgtgcaggtttgttacatatgtatacatgtgccatgttggtgtgctgcacccattaactcatcatttaacattaggtgaatctcctaatgctatccctccccccttcccccaccccacaacaggccgtggtgtgtgatgttccccttcctgtgtccatgtgcagaacaatattaaatactagataaacaaggtaatattatttcagaaaagcagtctagcaaatgtcccttctgtatgtaaaaagcacattataaatatgagaatgcagcacacaaagagatagagaatctcttttacttgaaaaggccctgtctgaccttaattacactattctttgtttgaagatttgaaaataaaatgaaagaaaatgctctgcccaaataaaatgtacatataactggcccaaaacatttaagaaaatatataaagttcagaatctttaattcaatgttttactctactaataattatgttgcatttgaccataagattacttatcttttaataatttagaaactttacagtaaaagtaactcatcatttctaaaaataaaatttagaccattagatttatgttttgataaactttgccgtacaaataaagaaaattgaaatatttccaaataaatcaagtatcttaattcttgttgatagatttttctttccctgtcaattgtagctggcattcctgcacctatatattttggcgctttaatggattccacatgtttacactggggaactttgaaatgtggtgagtcaggggcatgcaggatatatgattccaccaccttcaggtaaagataataatttgtttaaaattgttttataagcatagactgtgcataacgcagcaccattcacacgtaactttttctttgtcaagtgaaaagaatacttttgtggttatttccagcagagatactgatgttatatctccattccttatttgcatactagaattgtattttcccattatttctcaagtgcttggtaaatataagcatacatggcttccctaaccttggctttcaaagtgttgttcgttaaattcttagcagtcaacacaatattgaaggtaatggttgtacactgatacctatccaatttatattgctctctaaaggctctcattttatcctgcatgatttcatcatctcacgagtctgaagcctcacttcctctcaccaccagtctctggtctccaaaatcatatattttctccctctttacattttgctgaaacaatcttcttcatgtctcctaatgccttctctttggtaaatacaaatctaattttgaataaaactctttgttatttctattttcatgttctttttcattcggaaatttgagttttgtttaaatttgaattaacttctcttgatggggcaataataaagctacttcattcaatataaaacaatttaccattgtttaaagcattctaagatattggtcttgatcagcaaaaggacacatatcaagaagtatggggagagcagacgcaggagattcatctctgcatctattcccctttcccccagagctccccaggagtgatgctgagggaagctcagctacatgctatgtatgcggtggatttctaccacagttgaggaaccccaagggtcactattgagggttggcctcatcctgctacttggattcttgttgatagtctcctgaattaaatggtgcttaagacacattaaacggacttggctccattctctgttagtcagaccaattagactggtcaatgaaatggtgtatccatgagaaaaatctaccagaagccaagatattctagaaataagggtaaatattgttggtagacaattctccatggatccctacatttctgcttttcttgttagcagggacactgagagcattttttctggactatattttcaaggatgttggaacagtaaatgaccttggaagatataaatagtgtctctatttatatctcaaggacagagggcaggtagcttgttgtccatgatgataagaaaatgtctccctttggggcaaagtttgggcagatttttttgaagcccatttaaaagaaagattgggatttcctaaactcaggactttctaactgcagcccaaattcactgtgtgtacaatgtttacctgggttctccctctgtctcaccactttgggacttggagggtaaggaaaatcaacttgaacatgaagcttgtgctgactgctgtgttgtgagtaaaaaaagtcctttgtccctgacctatgagtcttgtatcttctgttagcatccttgaaactgtggcaggctagcctgttagcttacaaatgaagtaaaatcttagactcttttacagttcttgagaacaaacttctgattacctttacattttcctaaaaatgtgaaaatgattaattagatttattccaaccaatagaaggggagaaaatgcagtagtggtaattcataagaaaaaaccccacacaaataagttaaaaaataagcctaagtggttttgcaaattggttaaacttgctggttaaaagatagtaatttttatattggacttttcaaaatttgaactaaatgttgtttgtaagagatagatagatcaaaaatataaaatgattgaagataaggttttgaaaagatctaccagacacatactaaatcaacttctgtagttatattaatgatttcaacaaaatataagtaagttaaagggaaaaaattaatagggttaaccagagatattacttaataataaaaggaaaacactataaaaatatagaaaaattatgaagctatgtaaatctatcaacataacctcaaatatacaaaacaaaaatttataaaattataagaataaatctacagaatggaaaatttcaatatacttgtcccacaaatgaatattaaatacagacaaaaatgagtgataatatagaatatttcaacttcaaattgtacaagagtaattgaatatacagataaatgtatattctgtataaacatatataatctgtatgaatctataatacatctatatctatttctacatgaatacatggataattgttaaccaaaatacgagcacctatgccactaaaaagttaaaaaaaagtattgataccacataaatcctgttttctgttcacaatgcaatggagatgaaagtctataataaaaaattcccaaaccccaaatgtttgaaaagtggaaaagaatgcagtcttaaattactcatggttaaaagaataaattatagtaaacataaataattagaactgtatgtcaatgaaagcactgaataagaaaacttgtgggatgaagctaagccaaccagtaatcaaagggatttttagagctttaaatgtataaatatatatacacatatgtatatatttgcatatgtacaaatatatgtatataaatatgtatataatatatacatataagtacatatatacatatttatttacatatgtatataaatgtatatttacatatgtatagctatattacatatgtaaatatacatatgcaacatatattcacatgtatatacacataggtatatatgtttatatacacataggtatatatgtttatatacacatatgtatataaagatgtatatatttatacatttaaaacataatatgtataaaaatatatacatatatacatttacacataaaaggctgaaaattaatgaactcagaatttagaaaaagaacaatgaaatatgtacaaatgacatagaacgacctgataaatgactcaaaaatttacatattgatatatttcctatctcaaataagaataattgaaacaatatatttttaaaattcaaaagggacttttcttgattaaaagacaatataaatatcatcctaaacatctggtttttcagaaattaaacagaaacataaaggagtaaacaaagctgaattcacaggctctatgtctcaaaatgagcagtggtttctgatatcagcttccaaggaagaataaggtacttctaagtcaagcgactaaattcagattcaatgctttaatccaattaatgaggtaaaacaccttttacaggatttagtgttcctcaaaatgtgatattcactcagaacttcacaatgtgaccttatttgcaaatagagcatttacaagtagagtagttaagttaaatgtggttatactggattaccataggcttaaatccaatcactggtgtccatttttttctgaatcctagtactgtttcataataaaagaaaattttagaagtagaaagataaaaatagatgaagaaattaataaatagactatataccatagagggaataagaaagtaaagagctatgtttttgtaaaggtgcaaagatattactaataacaatactgtggaaaggcaaataaagagaggaggcacaaataaaacatcattaaggatgaaaaagctaatataagtacagatattataacacttacatagggattttagatataacaatttagaaacatattaaatagatatttttctagacaattaattatatattaccagattttattataaatctatagaaacatgaatatttttatagttacttaaaaatgtaaaactttcaaaagtgctcatctcccaaggtaccaagttcagatatttttcaggaaagtctgaaaaaacctacaatgaaccaatgattcatttgtaaattatgcaagttattctcagaaacagaaaaagggaaaattttgtaattcatttcacaaagctagtactatcttaataatcacactggacaagttcagtacaagaaaaaaatttgtaggctaatcttatacatgcaaaaattctacataaaaattgataaattgaatctagtaatgtataaaaattacagtttattttaagcatgcaaggataggtcaatatcagaaaatctattggtgtaatagatgctattaacacaataaaggtagaaaactttgcatattcttccgactacaagcagaaaagttatttggttatattatgcacattcatgattaaaactttgagcaagctcacaatagaaaataacttccttaatctgatcaaggtcatctaaagaaactctcacaagagtatatattataattcatgatgattctttggaagcattcttactaaatactagaataaaactgctatcactaccagtattcattttgaggtgaagatcctactcaatgaaaaactagttagttataacaacaataataaaacattagaaaagatgaaaataaatttggattttctcagtgggaaaattaaaaaaacataaaatattttaacaaatactgaaattaataagagagtttagcaaagttgcttatataagatcagcatgcaaaaccatcagctgctgtttttatcagaataaaatacaaagatatacaaatttagtttgcactaaccacactatgtaatatttaatatgttttaacttttaaaaaaatagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggatagacatggagaagagaaacaagagaacaggtagtgagaagtcgagagtcagtaattttcttacttaatattgtggggatcttacttaatacataaagttaatgaaactagaaatagtggtt

SEQ ID NO: 12456 - DNA, 79835 bp, Human
agatggtggtagggtattaatgttaataattttggtaattatactgggcttataagtaaacatcctaactcttagcatttacacactgaaatatttaagcataagggagtgtaatgtttccagcttgctctcaagtggtttagataaaaatataggtagatagagaaaaagaaagtgatttttataaatggatgaattaattggtgaatttagctaaatgatattaacagaattatttgaatagtcttgcaaataaaaatgtttctaaatttgaataaaagaaagtactgagcccattaacaaaaaaatatgtatatgaaattaagtgttaatttaggactctctgaagaagtaaattgagctgtgtgctgaataacaataatgaaatagtcggtggatgtcagtgataagaatattccagtgcaaaggctcaatgatgggaatgaactcagtatgttcaaagaatagaaaaatggccgatgtagatataatgtagtggacgaagagaagagggtagagagacaggagacagaagttcatgtagagcttttaaagccagcataaagctttgtaatccaatgaatttggatttcattctgagtgatgggtaaccattgaatagttggggcagtaatgtgatctgatttatattgtataaagatcattcttcctgtcatatagagaaagaattttatagggcatggctggaagcagcaagaccagaagtgaaaagtgacaagtttggcccagctttatggcagtgaatatagtagaggacagatgatttgttatattttagaggaagttaagttttctgaacttgttgatagattgaatgttgagagggagaggggtgttttcaaataattgtcaaatctgtcttccttattattcatccattcatttgaatatttaggtgcctactgtgtgctaggcattattctaggtattggagttacatcaatgagtaaagcaaagcccctgccctcatggagattaaattctagtagaagagacaggcagtaaagatgattaataagtaatatatatgtagcctaaaatgtatgtttatgtatatttaggatgttttttaatgttacaaaaaatgaaagcgctaaggagaaagggaaagggtttaaggagatccaggttagtttgaggagggtagtcaaggaggatcctcactgaaaggtgattattttaagaatgcaaagagatgatggatgtaagtgttcagtactgtatgtgacacattgtttctcagtttttgagtactacttcttcttcttcttctttttttttttcttttgagatggagtctcgctctatcgcccaggctgaagtgcagtggcgtgatcttagctcactgcaacctctgcctcctgggttcaagcaattctactgcctcagcctcccaagtggctgggactacaggcgtgcactaccatgcctggctaatttttatatttttaatagagatagggttttaccatatttgccaggctggcctcgaactcctgacctcgtgatccgcccacctcagcctcccaaagtgctaggattacaggcttgagccaccacacccggccctattattattattattttgacacagggtcttaactcttcacccaggctggagtgcagtggtgccatcatggctcactgcagccttgacttcatgggctcaggtagttgtcccacctcagcctcccgaatagctaggactagaggcatttgccaccatacctggctaatttttcttatttttttttttttgtagaggtggggttttgccatgttgcccaggtgggtctcaaactcctgggctaaagcgatcttcccatgttggctgcccaaagtgctgggattacaggcaagagccaccataccagttcctgtctagatattatgatgaagattgaggatggtagtttttgtggagcacaatcctgactgtacctgtgatgttgcattcatcttttggaacataagcagatcaccaggtgaatggctaaagaatctggaataagcttgaaagaaatacaggtcctggcaaggcaatggaaaggtatgtgtgaaacattcatttctaatagaggactaatttaataacagaaatatactcttccctagaaacaatttgctttaaaggccaggcatggtggctcacgcctgtaatcccagcactttgggaggccaaggcgggtggatcacctgaggttgggagttccagaccagcctgaccaacatggagaaaccccgtctctactaaaaatacagaattagccaggcgtggtggcacatgcctgtaatcccagctactcgggtggctgaggcaggagaatggcttgaacccgggaggcagaggttgcagtgagccgagattgtgccattgcactccagcctgggaaacgagtgaaactccatctcaaaaaaacaaacaaacaaaaactcttataaaaagttgttttctttttaagcagggaagcctgacttcattggcattttgagatggaggcttctgggcaaaagaagaatttcatgggggtattttgagatgagtatgatcaatctagtcaagagatggggaaggtctaagctttgtctcttgtaggtggaatggagaagggcaaagggtttgaattttggttgtgtggtgtgaagaatgattggtcttaaaacagatttaaaatgaaaagattaaactgatcaatgttttttatgcttttaaaaaatgtggctgataaagcgtttttgtgcttttaaagggagcctggatgaataggctttggtactgtatgtattgtattaaacatttggagtggcaaaataatttctaaaatatttctagcaacttcattttcattttatctgcaggatgaaaaagtaaatttggggattgttgattaaattagcaaaccatatggttgtttgcgcagactgactgctatgcgaggtagctgtgttatttttctttcaggatatgctgttgtatctgatgccagtgttctgaaacacttattttctagtcaacagtaggtgaagcaattatttctagtcattatggtttttcttgatgccttaattaatgtcacaatttgtgaatgctttaccctgctgtttaaaattagtttaatattttaaaagattaaatcttcacatttatgtaatgcttcccaacctcttttcacatcatagcatacatagaaagtattaagttctgattggctgtcccaggctgaggaaatcattatctcagtaaactgataatcattcttcataactctctggcgttggtccctggcacacagcttgggaagttctgtcttaatagaaaagatatagaaacctttctgtactgtattgcagttagttaagaggaattaggaaagagttatagagtctttcttaatagggttttttttttcctctttcgctagaagcctaaatctcaccaaattatcgggtgttatactaggaactatggttataagagtgaagagctcaaggaactcacagacagacaggcacagaaacaaatcacctgtggcacaatatgacaaatgacatcacagaggtgtttatttttatttttattttttgagacagagtctcagtctgtcgcccaggctggagtgcagtggcgcgatctcagctcactgcaagctccacctcccgggttcacaccactctcctgcctcagcctcccgagtagctgggactacaggcgccagccaccacgcctggctaatttttttttttttaatgtatttttagtagagacggggtttcaccatgttagccaggatggcctcgatctcctgatctcgtgatccgcccaccttggcctcccaaagtgttgggattacaggcgtgagccaccgcgcctggcctaagaggtgtttataagaagctgtaagagtccaaatgtgggaggttttatttctgtcaaggtgcacttgagtctaccagggaggacttggagttagaccttaaagtaggagtttctaaagtgccagagacagggaaagcagggcattgcaggtggagagcacaacctgttttataggctttctgcctccttaatatctagcagaggtctcatcttaatataaaagtagatactggaacttaggagtttgctctgatggcagacatggatacttgccctgccagagtgcccatctaccttccatttatgttgtttggattcagtctccactatactatagccttatatttgcatggtgcttttaattttcaaagctttttatccaaataacagcccctcagggataggaaataaaagccagctggtagtgtttttatttttatagaggagaaaactgagacatcaccatcatatcagcatttcatttcccagataagaaggtctttttttcatctcttgattgcaaagggtgctgcccaacaggaataacctctcccaattttctgggcacagcccagagtgctgactgaggcagccaccaggagggcgccagcaaggcagacagcatggctgctgatcacagagctaacagctcgacatctgcaggctgcagctgtacatttttgctacagcacatccgtatttctgctcacacttgtgaagaatcacagagtttggaagaatatgagttaaaccgttccaagtgtataagtgtgctccatctctgggagttttattctgtactgggtggagtggtctatgagatcttatagctgctacttttctctgtttatttattgccatatttagtccatcttccctgtcctaattttagttcaatgccaaaaaaagatggagcactccataatagatgaattgagagggtgctgattgtgtcactgaaatgtttgccaaagaaattgtttttctagctgattttgttctgcctccatctttcagtctatttggaaaacacagtagagtacctggttatctttcagagtgtcattgttaaataatcatttcagtaagcagtgatggctgttgatcattttagacttgtgcctatactaagtatttatccatttttctaatatacctggatttttaaaaatattgatggataaaaactttctggattgttgattttgaggaggtataccaagaagagaagggtgatcttggtgtggagccaacatctttgaaatcttggcttatttgttcttactccttaaggcaccccattgccactccttaagcccatgtatttgacagtggggctttttgtcagaagcctctctgattgtcatttggggacttaaatgggctcctacataacagcttctatgcttcaattttctaacttgtccagggtgtgcttcagctgtagactgtgtatttacgttcatatatttgtgaagaaagacaggaactatatagtagaatgtgaagtctctctgaactgtaatcaatgtgttttattaaattcttggtcacaatgtgcaaacttcattgagtcctacaataattaattctttttgcattatttattttgctatagtatggtctctggagctcagcagagctgccatttcttagccatatgacttgggacataatttttgacttctctgagccttagcttctggttaaataaagtggtattggagatggtaccttctactgtcttagtgtcatttaaataagaaaatattttagcaccattctttgcgtgtaataaatattttgttatttctaaatgaatatatgaagatggagagtaatggtagctattactattatagttatttcctgacttgtatttatccttcccagcaagaaagtcttgtcctactcaaatcttgggtaaatatgaaacttgcttcattatcagtgtggattgagaaggtgtgtacggtgttcctgggcatctgaagaaaggcttttaaatcagctttcctttgtggtcagttggtcacaaataacatcaaaatatcaattgttaatattcatatttattttttcctttacagctgactactttagtattggtacacctaattaaaatttttccacctctaaaattttttctagggcaatttatatatgattgaattaatttacattgagtattagtttccttggtttttaaaaatagatccccccaaaatggtaaggagttgagaagttaaggctgtgagcaaatagagaatttgggcctaaagtttaatgtggaaatgagaagatgatttcaattgatttgtagaaagaaccataatgaagggaattttcttaagtaaacttatgtttgtacccatttgctactatttttctcttagagcttttagcactttctccctgtcataaggttgtagagttgccatactctgaggtgtcccacaaggctagcacaacagccctctgcttgtggtgcatacagctatcatccaaaggggccaaccacatgacatggcagtgtatttccagatgtcattctctctgtttggatgacttgggagcttaagaagggtattttctcttgaataggagaaaaattgttactttggcataaggcccactctggcaccattcccacatctgttattgattagaagtgaatgctggtcagtcaggatgcaagagtgctggtccgattatcaagctcagccttcaggatgaaatactgcaggaaatctgaaggatggcataaactggctctacacagtctttaaaaagaccctttcataagctattgtacaaagacctggtgtaaagaaatagcctgagtgatgtctacatgttaagaagatgccgtaacatgtacatgtaggatctattcttagaggggagcagtggaatgggtggtggaatccttatgcaatgatttttaaaatatataataaacatgcacagatactaagtgttcaacccaatgagtgcctttttggtttttttgggggtttttttttgtttttttttttttttaaggaaagcgtctccttctgtcgcccaggctggagtgctgtgattacagacataaaccaccatgcctggtctattcatgtttttaatttttaaatttttattcaattttttttaaaatttagcgatggggtctcactgtattgcccaggctggtctcaaacttctgggctcaagcagtcctccagtctcagcctcccaaagcattgggaatacatacgtaagccactgcacccagcctgttcattttcttaatggtgtcttttgatgggcagaaaactttaattttcgtgaagtctaacttagcagtcttaaaaattttatggtttgtgcttttttgcttaccaccaggtcataaggatattctcctattctttttgtagaaattttatggtccggggtattattttacaacccatcacgaatctttttttttttttttttgtatggagtgagagaggattgaggttaatttgtatctatttggacatcgagttccagcaatatttgctaaatagacttttctttccccattgagttgagttgacacctttattgaaactcactttgtgtttggtggttcgtcctccaaccctgtccttcttttttgagattgctttagctctttggtgtcctgaacatattatacagacatcttggtacatcttggtgtctctctctctctctctcttttttttttttttgagacggagtttctctcttgttgcccaggctggagtgcaatggcacggtctcggctcaccgcaacctctgcctcccatgttcaagcaattctcctgcctcagcttcctgcatagctgggattagaggcatgcaccaccatgtctgactaattttgtattttttttagtagagacggggtttctccatgttggtcaggctggtctcgaactcctgaccttaggtgatccatccgcctcggcctcccaaagtgctaggattatgggtgtgagccactgcgcctggcctcttttttctttttttaatctaatgcagagatattcttgaattttaaaaacttttacaaaattgggaatatacattttaggcgtgtaaatttttaaattttaagtcctaactgtattttaacgttggtagcctattattatcaaaacatagtcattctgtgtaacgcagtaagaaatatctaatagttggttttacttaataaactttactaaataaagccagtatgtactatgtactatgttctggccactggacttggcacttggaatatggtggtgatcaagatgaacgtggccccaactctccagaggcttacaacctaagaggccgaaattggcctcttctgaaacaaaaatagacaaatgatgcatttcaggccttgtgatgtgaacagaaatttttttatattcttcattacgcagcagctgatagcagcatcacaatttgataggggccaggcacggtggttcatgcctataattcagcactttgggaggcccaggtgggcagatcacttgggtccagcaattcgagaccagcctgtgcagtgtggcaataccctgtctctacaaaatacacaaaaaattagccaggcgtggtggtatgtgcctgtagtcccaggctacctaggaggccaaggtgggagaatcaccctgagcccaagaggttgagactgcagtgagcagagatcacaccactgtattccagcctgggtaatggaatgagcccctgtcttttatttatttatttatttttaaaaaggcagactccatttgggtaggatgtatgtgcagtatacagataacattgctgtttgtttttgaatgaaaatgtttcctgaagccatagcatgagtattggaatgagtatatatgtctgccctcccttcccctcccttgccctcccctccccgtcctgtccatccatcccgtccctccttctttccttctttctttcctgtcttgagacagagtttcactctgtcacccaggctggagtgcagtggcgtgatctcggtgcactgaaacctccacctcccatgttcaagtgattctcctgcctcagcctcctgctgggattacaggcacacgccaccacacctggctaatttttgtatttttagtagagatggggtttcaccatgttgatcaggtgggtctcaaactcatgatcttgtgatccacctgccttggcctcccaaagtgctggaatgacaggcatgagccaccaggcccagccatgtctgtcattttctttgttaacctaatttctaaagattactcatcttttaaacttctttgaaacaagttgtttcatacctgtgatttgtactgtaactcaaggttttttgttttttgttctttgtgtgtgtgtgtgtgtgtgtctgtgtgtttgtcgtctttgttgttgttttgttttgtttgaatcctggggaaccagaggtgttagcctatgttttaaaactcacatttggcaatggtatcaacagctgtcacactgaataattgtcatgtcattataagggtttctgttgctcactaatctgtaggtataaatctggattttaaccacatgtgattggtaaaaattagttcttgtgagagattctatgctgtgtaggccatctgttccctattctcaaacccagaatgaaaagttagccttagaatttgcaagtcagtgaactaagaggtatgttataataggaagatgggctgactgaagtctctggagctaagctgggacctgtatgtgggcactgctggcagaaacataagtgtgtgtggataaactcttcattagtggaaaggaatcttagttttcggctgattttcagtggtgggcatgaccccaaacagaatctgagatgatgtaataatcatctgtgatttgattgtacttataagattcagctaaatcttcccttttttgtcccagtctacttgagatgtaccttccttgaacccttattgcccagctacatcatgaactccttgaaggttggaatatcagcttcaagtttgtgtcccaaacacttagtacagtgcttgggtcatgttagccttttgatgatgttgatcaaatgaatcagcagccgggcgcggtggctcacgcctgtaatctcagcactttgggaggctgaggtgggtggatcgtctgaggtcaggcgagaccagcctggccaacatggtgagaccccatctctactaaaaatacaaaattagctgggtgtggtggcacattcctgtaatcccagctacttgggaggctgaggcaggataatcacttgaacctgggaggcagaggttgcagtgagccgagaccacgccattgcactccagcctgggcaacaagagcgaaactctatctcaaaaaaaatgaatcagcaaggtaacttcttgcattaggaatgacagcacaggccgggcgcggtggcgtacacctgtaatcccagcactttgggaggctgaggcaggaagatcacttgaggccaggagttcaagaccagcttggccagcatggcaaaaccccatctctactatgccgggtgcggtgactcacacctgtaatcccagcattttgggaagccaaggcaggcggatcacttgaggtcaggaattcgagactagcctggccaacatggcaaaaccccatctctactaaaaatacaaacattagccaggtgtggtagcacgtgcctgtaatcccagctactcaggagcctgaggcaggagaatcacttgaacccaggaggtggatgttgcagtgaacgaagatcgcaccactgcactccagcctggatgacagagcaagacagtctaaaaaaaaaaaaagaggaaagacagcactaccttttattaaacaacttctttctttccccatattcccttctagttttttcttatacatgtgcatactctttccattttattttcgtgagtatacattatatccagctctttccttttacattatatcaagaccttttctgtgttgctatatatttatctgtcattatttcagtggagaagtagacccagaatgtgcattgtttttattaatatcacatgccattgtttccattagattgtgttaccatctaactatcctttgtacaagaacactattgtatcgatttgaaaaatcaactgaaaaatcagttgttttagtagtcattactacaaagttgtaggtacatgataattgaccttttcccagggccaaaggccaagtcccaagccataaccttgcctggatttcattttctttatctgggtagactgagtatatgactttatagtttaaagttctttgactaatcgttaaccttatttggggagatgaaatgatttttatgaaccagtaatttgaatataatgtatgatgaagttttggggctttttttccctttaaattaaataatttagtaaaattttaaaaaattatcttgtttccaaaaacggataattacatataattgaaaatgaattatttgttgaattggatatatttaagttcttaagtcaacttgtttggatttagatggtgacccaagtctaccagcactgcatttagtaaccatttcattagacagatgctgtctacagggtgtgctgttatattatgcattcatcctcagtacttgactgtcctctgggaggccaagtgtctcaaaatcctgtaagcactttcctgtaccccttctcataccaaccatgccacactgtgaacttgctgtgtatttttccttcttgattgcataccttcaccattgtcatttggtttaagtgattttatttatttatttatttatttgtttgtttgtttgtttgtttatttatttatttgagacagaatcttgctttgttccctaggctggagtgcggtggtatgatcttggctcactgagacctctgcctcccaggttcaagtgattctccttcctcagcctcctgagtagctgggactacaggtgcctgccactacactcagctaactttttgtatttttagtagagatgaggttttgccatgttgtccaggctggtcttgaactcctgacctcaggtgatccacttgcctcagcctcccaaagtgctgggattacaggcgtgagccaccatgctggccagattaagtgacttttttttttctttttttttttttgagacagagtctcactctgtcgcccaggctggaatacagtgatgcgatcttggctcactgcaagctccacctcccaggttcacaccattctcctacctcagcctcccaagtaggtgggactacaggcgcctggctaatttttttggtatttttagtagagacggggtttcaccatgtgtttgccaggatggtctcaatctcctgacctcctgaactgcccgtctcggcctcccaaagtgctgagattacaggcgtgagccaccgcgcccggccttaagtgacatttttaagagtttaagatttttccctcagcccatcaggtaagctctagtcagcttctttagctggcttcttagtagaagtaatagcaataataatatagatgatggtggtcatgatggcaattataaccataatatattttgtaaaatggtgtgcagtttagaacaggattactagcatcatttcctgattacagaacaggttggagacagaggcagacttaattgcttattttatagagcttgagccactgttttggtgtgtttaagcatttactatataccaaaacatgatatcctttaaactaccagtgggattttgacagggtaacttagatgccttttatcatattaccaagttgctgagattgtaacccagggcatttggtctaatttgggagcatgtttccattcatctctgcagctcagatggagaagggctggggtttagggcttctgacctcaaaccttgttttttttctgtcatgcttgcagggtattttaaataccctgtcctgttgttccctcaacccaaactacctgttaaaattttggttttgaaaatgaggtccctatagctagatcatgctgcctgtgtgtgaagaaagactaacatgttaggaatgcgtggcattcaagtaggtgtctaataattcttctggagaaaagcaaatttagtcaaaaagcaaatgaaaatattttataagcaatgtttcaaaatgattcaaggaaattggtatttacctcttatccccatcgtgtcatcagttccattgtcatgttctttgaataccgtgagcatgtgtctattttttaataaataattgtaatcatactacatatatataggaaggtccccccatacagcgttgtattatatgcatttcgccaagtgttgaatgaatgatccttcataattacaatttttaatgcctttacagttcacattgacatgctgttccaccgtttaattaaccattctcttgtggtataaattgctttttcccttgagctgttttcttaaggacagatttccaggagtgaggtcacacagtcaaacattatgaacatttttctagcagagaaattattttttaacctcactaattgaatgttggtaccttgaaatacatttatttctgtgctttttgtacctagtacattagtaattggatactggaactaatggaagcgaacaagcatgtagataatctagaaagcattatagtcttaactggaaatacataattattttctctcaaaattcaccatcccattttgttatgctttggcagagcaatctagaactatggcagagtgatggttgaggaaatgtggggaaatttatattaaaaccttagccgtggtaaattgaaagttaacttttgaagcaaagcttaactgtagaagaaaaatagtgattatttctcatgtttgttgctgaattctaggttttattcttctaccttctttgcatatatctgtctctaaaaaggtagctaattaatgtgttatggtaatttacagtatgcaaaaggactgccagtgcagatgtgatctgatcaatattgtgattattatcattattatcactgggttttcttgtttgtttttttgtttgttttgttttttgagacggagtcttcctctgtcacccaggctggagtgcagtggcacgatatcagctcattgcaacctctgcctcccaggttcaagtgattcttgtgcctcagcctcctgagtagctgggactacagggacggggtttcactgtgttgttcaggctggtcttaactcctgacctcatgatccgctcgcctcagcctcccaaagtgctgggattacaggggtgagccaccgcgcccagcctattatcattgttatctcggttatagacataggaaaactgaggttcctgttgatattattgccaaaacaatgctcttgatctcattctatctttctctgaggttttaagcagaacctggttgtatgtgagccatttatattctatagcagatttttgcattggctgtgagttcaaaatagataaaaattttaagattgcttcaaagtcaagagattctatataatcaaaaatacttcttggttaaagcataaagggccaaggtgacgtgtttggaaagtatagatagaaggctctgaattagggaaaagtcctgtaattccacagaggtatgtattttgacccttaatttctcttttccttgaaggttcataattaaagcacagaaattcagaattgtcatagtttggaagctatgaacttgagtgatagctttctcaaaatatattggagagtttcatagaattgtctctacctaactctgaacttcactatttattttattttatcttatttaattttatttttgagttagggtcttactctgtcacccaggctggagtgcaatagtgtgatcacggctcactgcagccacaaccacccaggctccagtgattctgcaacctaaacttcccgagtagctgggactacaggcaccccccaccatgcctggcgaattcgatggcatcttttttagagacgaggtctccctatgttgtccaggctgttctcaaactcctgagctcaggcaatcctcctgccttggcctcccaaagtgctgggattacaggcgtgagccacggcacccaggtttgttttttatttttttgttttgttttgttttgttttgttttgagatggagtcctgctctgtcgccaggctggagtgcagtggcacgatctcggctcactgcaacctgtgcctcctgggttcaagtgattctcctgcctcagcctcccgagtagctgggactacaggcgcctgccacaacgcccggctaatttttcgtgtttttggtagagacaggctttcaccgtgttagccaggatggtcttgatcttctgacctcgtgatccgccccccttggcctcccaaagggctgggattacaggcgtgagccaccgcgtctggccaatttttgtacttttagtagagacagggtttcaccatgttggccaggatggtctcaatctcctgacctcatgatccgcctgcctcagcctcccaaagtgctgggattacaggcatgagccactgcgtccagccccgtacccagttttaattatattttcttaactggacctatgtggaaaagaggttgtatgcttccaagacaaaaattgaattatttcacatgtatttccttttaacttgttatgtctgggctgttttggcatttaaagccattaatctcaactcatgatttctgtcccaaggaaaatgagagtcagatgttcacatctggaccatttgtttcattcaagtagttgaaattgcattagaaaattttgatagtgataaagtcaagaatttagaatgaatcattgaatcctcccattgaaagggaagatcaaaacctccaactttatgtagaactatagactgagagaactattactttttgttgatttttcttaaataacattactgaggtatgattgacatgttaaaaagctgtacatatttaacatatacacctccatgcatttgggaataagtacacccctgtgaagccatcaacacaaaagtttcctcttgacccctttattattattttttgtgtatggtatgtagctattttaaagtattgttagtctttgttttaactttgttgaagtgttaattaaaatgatgaacttgcagaagaaaaagtgaacattttaaactattttttataaatagaatagaaacaggtgcaaatgaagaaatatatatatataaatatatatagatcaacaaatgaataatgaacaaatatatatgttaatgtagcatatattaatataatatatatgttaaccacaaaagtaccatggccattcagctcgtgatatgtatttctttcttttacctttatttttggcctgtttgaaagatttatgctacattatattttcctttattccttagattactttaaagaacaacactataattaagagcagtacaccctaaccaagtaaggttgatcacacaatggcaaggatagttcaacattaagaagctgaaaagggctgggcatggtggctcacgcctgtaatcccagcactttgggaagctgagccaggtgtatcacttgaggtcaagagttcgagaccagcttgaccaacatgatgaaaccccgtctctagtaaaaatgcaaaaattagccaggcatggtggcaagtgcctgtaatgccagttactctctgaggcaggagaatcacttgaatccaggaggcagaggttgcagtgagccatgatcgcgccactgcactccagcctggaggacagagtgagacttcccctcaaaaataaaaataaaaataaaaacaagaagctgaaaggaggaaaaaaaacccatttccataaatacatcccttcccctaaaaaaatgcatttgattaagctgaagacctatttctaataaaaacaagtaaaaagcaagtttgtggtaagtagaaacttcaaggttatacatgcaaaatgtggcttaaactagagctgcaacataaaagtggtgaagaacagcagaggacagttggagctgtgggagatgcacaaatgaatgcctctggcatggagcttcagggttgaaaatcaaacactagaagtccagccaggcacagagagcagccagttgcagaggggacatctccctttgtctttatctgttgtggagatgtttggtagtcccttacccccaatgcattgtaataaagcactccatttgtatatgcatcttaatagtcctcaatgatttaggcccacaaaatgatcagttaagagagttacctttattttgtttactttcaaaaaaataagaataaacccaaactcaattcttaatttctcagcctgaacagtgtgaggtcatagttgtccagatttctctggaaacgagtaaagatgaattcgtttctttgtcatgggtctgtactataggttgttctctttttatttcatttgattgtaaacagcaactctggcagctgggcaatattgaatgattgctgtaaacaaggaaacagactttgaggaggaaatatccccactatcagagagctaacagagcctcaatttcaatcctgatctgtctgaatccagccactgcctcatacccacaccagagctgttcaattgaaatataatgtaagcaacaaatagaggccacatatgtaattttaaatattcttgtaaccttattttttaaaaaagaaacaggtgacattccttttgataatatgtttaatatactaagaaatttcaatatataatcattataaaattattaatgagcttgtttacattcctttccttagtactgtttgaaccttggggtctggcatggtggctcacgcctgtaatctcagtgctttgtgaggccaaggtggcaggatcacttgaggccaggagtttgagaccagctagtgagaccctgtctctaaaaaaaaaaatagaaaaattagctggacatgttggcatgcacctatagttccagctacttgggaggctgaggtgggaggatctcttgaacccaggaggttcaggctgcagtgagcctaggttatgtgactgctcttccagcttggacgatgctgtctcatcttttttacaaaaaaaaaaaaaaaatctgcaatccttttttcctgtgcacaaacagcttccagaaaatagttaaaagaaaccatcaaaccctaaggtaattttttttaagtacctgttggcccaaacagagggcttaattagcggcaactcttagaaaccagattgcgttaaacacatctagctttgtttttttttcttggcccccacaaaggctatgcgcatgccccaggaatatacttcttctttgattgggcacaataagattgttttcttcaaatatttgagagtggtaggaccccagaagaactcttaccaactgatggtgagtgccaagatcttctcatttatctggcagtggcatattccatctctgcagcaaggtaaagccctgggtgctagaagttccttcacagaacctaggtgtcagccagtcatggatattgtcctgtggcttcccataaagaaagctaaatctttgcttcgtgctactcctgagcatgcagttttgatttttgtggttctccatctcaaaacaaaagctgatgggctgactgggcctttctttgcgctgggggaatattaaaaactcggtttttcaaatattaaggtacatggagccaggtggaacccaggctcttttaaagattgatgagggcaggtgcagtggctctcgcttgtaatccgagcactttgggaggccgaggcaggcagatcacttgagaccagaagtttgagaccagcctggccaacatggtgaaaccccatctctactaaaaagaaaataaaaatttgccgggtgtggtggcaggcatctgttaattccagctacttgggaggctgaggcaggagaatcacttgaacccgggaggcagaagttgcagtgagccgagatcacaccattgcactccagcctgggcaacaagagtgaaactccctctcaaaaaaaaaagtactgatgaatagctgggcatggtggctcacacctataattccagtgctttgggagcccaagacaggtggatcacttgaggccggaagttcgagaccagcctggccaacatggtgaaaacccatttctacttaaaatagaaaaaagtagtagtccctgctgtagtcccagctactggggaggctgagacacaagaattgcttgaacccgggaggccgaggttgaagtgagccgagatcccactactgcactccagcctgagcaacagagtaaatctcaaaaaaaaaaaaaaaaaagaaaaaaatgatgaataaatatgtacaaaaagaaaagaaaaatatttgtcacatccaagttaactgaggatggcaatgtaattaaaaagaatggtttgaactcacaattggctttgtggttaccttactacttgaaagacgggactgggcacatataccatttcattggacaaacttatttttacttaatagaatataattaaaatgcaaaagttaatagcacattaaagtttaatagttttctttgagacagagacattctctgctctcttttgctcctcagactggtcttcgtagtcttcaggttgctaaaatctgatactttcccaagtccattctcatgaacaattctacatcccaattgtggcggggtgggaggggggggcctcctgtaagtcatggtcattctgtgttcatgctgtctccatttccaaaaacgctccagaatctctagatatatttaaatcttccccaacacacttggtccaacatgttgcttctgttttcattgtctgtcaccatgcctagggcacagcaaacaagagtagtggattgataacaagtgttagttgatgaacatgaaaaaaacgacataggccgggcccagtggctcatgcctgttatctcagcactttgggaggctgaggtgggcggatcacgtgatatcaggagtttgagaccagcctgaccaacatggggaaaccccatctctactgaaaatacaaaaattagccaggcatcgtggcacgcgtctgtaatcccagctactgtggaggctgaggcaggagaattgctggaacctgggaggcggaggttgcagtgagccaagatcatgtcactgcactccagcctgggtgacaagaacaaaactctgtctcaaaaaaaattttatatatatatatatataattatgtaaaaattatatatataattatgtaaaaattatatataattatgtaaatatatatataaaattatgctatgtagttctgttaatgcatgatattataaaagcacagttgtaaaaaggttacatttactctaattctaggccacagactattcagttagtcctaaaaattcatgcaacatcgccaggcattgtagcacatccctgtagtcccagttacttgggaggctgaggatcacttgagcccaagagtttgaggtcagccttggtaacaaagccagacctagtgtcttcgagaaaaaaaatacaaaattcatgcaacattacttgacactagggagactaagtaagtatgaagatggagttatatgaatgggtcactgccacttaaaaaaacccctcaaaaatacatgaactattaatgagttgtagtgcatataaggaagacagaataatgtcttatatatcatgactccattaacctctataaagaagctgaatatctacatcttaaaattgtagactaatggagacattattttgtttatattaactctctacctaggcttttccattgtaaagaagctatatttatctagatccatcctcccccatacacacagagctgtttttctttcacattgaaaaattatgaccaggcaccctggctcatgcctgtaatcctaatagttgtgggaggccaaggcaggcagatcacttgaggccaggagttggagaccagcctggccaacaaggtgaaaccccatcactactaaaaatgcaaaaattagctgagcttggtggcatgtgcctgtaatcccagctactcaggaggctgaggcaggagaattgcttgaacccaggaggcaaaggttgcagtgagccgagattgtgccactgcaccccaacctgggcgacagtgagattccgtctcaaaaacaaaaaacaaaaaaaacctattacataataaactgatttgcaaatctcttgactggattttttttttttttttttttttgagacagagtctcactgtgtttcccaggctgtgcagtgacatggtctcagctcactgcaaccttcgcctcctgggttcaagtgattctccagtgtcagcctcccgagtagctgggattacaggcacctgccaccacgcctggctaatttttgtattttcactagagacggggttttgccatgttggccaggctggtctcgagctcctgacatcaggtgatctgcctgcctccgcctcccaaagtgctggtattacaggcatgagccaacacgcccaaccttctgactggtttttaatacaagatagctagatttttatatctgcttctgcattaatcatgtaatctctgtaaaaagctaccattcactcatgaaagagtaaaaaggataaatgacctcttcttgctacgattatgaaaattgttttgacctttccccttctgtccacacatatcccaaagggtctccagggcccccaacggtcccaggaccatattttgagaactgctgagtagatcatggcattcaagccaaggtaagtttatgttttattgtaagagcaataggaagccattagaagagttcaggtctgtgggaagatctgttttaggttttaaatcagcactttggatactacgtgatgaatggactgaaggggttaaaagcagaagcagaaagaatagttaggaggcagatgaagcagtccaggtgagagatgacagtggctaaattctagcaatagagatgggagacatgacatactgtgacatatttaagagctggactgtcagaatttactgctatatttctttcttttctttttttttgagacggagtctcactctgttgcccaggctggagtgcagtggcgcaacctcggctcactgcaacctctgcctcctgggttggagcaattctcttgcctcagcctcccgagtagctgggactacaggcgtctgccaccacacctgtctaatttttatgtttttagtagagacagggtttcactgtgttagccggaatggtctcgatctcttgacctcgtgatcctcctgcctcggcctcccaaagtgctgggattacaggtgtgagccaccgagcccggcctactgctagatttcctctagaaggttctgtgttccgcagacatttagcacagatgtatcaaatgctggaacccaagagacctggctttttgaatcgtaggaaagccattaactagctgtgtgagaaattgatagcgtttttccctgtctcccgaaaaaaaagtgaggtttatttttggccaagaagactaaagttagctgattctccatcagtctcagattctctgagttctctgactttggctgcgtatgtgtggcccaggcagtaatgtgacacacctttaagtggttgggattcagtcgattttgattgtggtaggggtggcttccatacaaaggcaagatgctaatcaaatttaatttaagtcttttctgttcatgtgagaaatactaagctggtggagacctgaaacagatggtgtgcagttggagtagataactatattattctaaataaatatttgctggagctgggaagcaacaatccatatttcattttttccctatttacattttcaggtcagctgtgttgctactgtttttaacttgcattaaggttatcaacagacttggcaattacaatatatctttaaatgttgaaataattagcattggaagagaccctcagcacgtagtgctgtaatgattcttaatgcatttctggtggatagctgtctaataatatcttacacttgaaaaaattttttttttgagtcggagtctcactttgttgcccaggctggagtgcagtggcccaatcccggctcactgcaacctctgcctcctgggttcatgtgattctccagtctcagcctcctgagtagctgggactacaggcgcacaccaccatgcccagctgatttttctatttttagtagagacggggtttcaccacgttggccaggatggtctcgatctcttgaccttgtgatccgcccacctcggcctcccaaagtgctgggattacaggcatgagccactgtgcctagcttaaaaatcttatacggtacttgttttttaattttcattttttttttaatttattttttttgagagcgggccttgctctgtcacccaggctgaagtgcagtggcacaatctcggctcactacaacctctgcctcccaggctcaggcaatcctcccaaggagctgggactataggtgtacgccaccactcccagctaaatttttgtatgttttgtagagatcaggttttgccatgttggccaggctggtcttgtacttctgagctgactcgatccacctgcctcagcctcccaaagtgctgggattacagacgtgaaccaccatgcctggcctacagcactttttaatctgttactttatttgccttttaacacctcccttcctctgttttacaaatgaagaaaccaaggctctggcatgacttgtccagggttccacagtagctgataaattggcagaaaaatcaggattcacagtcacagtttcatgcccagttttctttcttccacaatagcctacctttgactattcaagaatataaatctctagctggtctggaatttggctgttttgccaaactgaccttttcatctcatcttttgctgcatacagctttttatatttactgtatattctgtttcagctaagagatggtcttaaattgagggagtaatgaaaattttatattaactctttcctggcttaaggtgctgtagccactgtatctgtctcagttaagttctggggcgagatctgtgtgcagtctcttaaatgttaatatattctttgttacacataatatacttgttctcaccttcattgtacctgtattcttaatgatactttgatgaaagcaggttttcaaataagtaggtttaaaaaggcattttattaatcactggtctaatcattataataacctaaacagctagcatgtattcctatgctctttgtatatttattcttgaaattcacagtgcttacagcccggtagattatactctttacttggcttctggtttttccccttatttccttggcttttctttttcagtctctttttttagtttcttgtctttcatgatctctaagagtggaaatacctgcagatctgtacccacttccagtaagatacctgttctcaggctttccgtagaatctatatgccattatttgaaaatatttcatcacaacttcagactttcccaccccaggcctcagctccacacttttatatccagctgcttatccagcatttctgttagaatatctactgagcattttaaaggtaatcctgatcttcagttgctctttccccattttcctttaccagttcctccttcttagtaaatggtaacttcatccttccagttgcttaggctaaaaacctcaaaattgtttcttgacctctgttttttttttttttttttctttctttttttcagtctcatctgtcaaccaggctagagtacagtggcacaatcacagctcactgcagcctgaaactccagggctgaaggaatcctcctgtctgagcctccaaagcagctggaattataggcaagcactctcacacctggctaatttttttttggttttaattttgtggagccggggtcttgccatcttgtccaggctggtctcaaactctggactcaagccatcctcccaccctcagcctcacaaagtgctgggattagagatatgagccactgtacccggccttttgacctctattttgtatttattttttatttatttactgctgtcacctcagtagtagaagacttagtagttactcgaataattttgaataaatagatgagaaaattctaagattcaatttaggaaaagttactcaaattccttatttaactgcattccactacctgggggttatgttaagacaggggtctccaatcctcaggctgcataccggtatggatctgtgacctgttaggaaccgtgtggcacagcaagtggtgagccagtgcattaccgcctgacctctgcctcctgccagatcagccatggcattagattctcattaggagggcaatccctgttgttaactggacatgtgagggatctaggttgtgcactccttatgagaatctaatgcctgatgatctgaggtggaacagtttcatcctgaaaccactccctaccccacccccagttagtggagtgcaatggcacgatctcagctcactgcaacctccttttgtagttcttcggtaggtacatggcctcccaagtagctgggaccacaggtgcatgccactgtgcccagctaattcttttattttttgaaaagacagggtctcatatcggggaatctgccccaatattcacgtaggttcttttctattttcctttagcatcggccagcttgagaaataaagggacagagtacaaaagagagaaattttaaagctgggcgtccaggggagacatcatatgtcggtaggttccatgatgccccacaagccgcaaaaaccagcaagtttttattagggagtttcaaaaggggagggagtgtgcgaatacgtgtgggtcacagacatcaagtactttacaaggtaatagaatatcacaaggcaagtggaggcagggcaagatcacaggaccacaggaccaggcaaaattaaaattgctgatgaagttagcaccattgtcattgataacatcttatcagaagacagggttttgagataaaccggtctgaccaaaatttattaggcgggaatttcctcttcctaataagcctgggagcactatgggagactggggtctatttcacccctgcagtctcgaccataagagacaggcgcacctaggggggccgtttataagcctatacatccaggcgcgtattctctttcccagggatgttccatgctgagaaaaagaattcagtgatatttctcccatttgcttttgaaaggagagaaatatggctctgttctgcctggctcatcagcggtcagagtttaaggttatctctcttattccctgaacaattgctgttatcctgttcttttttcaaggtgcccacatttcgtattgctcaaacacacctgctgtacaatttgtgcagttaatgcaattattacagagtcctgaggcgatatacatcctcctcagctgacaggattaagagattaaagtaaagacaggcataggaaatcacaagagtattgattggggaagtgataagtgtccataaaatctttacaatttatgtttagagattgcagtaaagacaggcataagaaataaaagtattaatttggggaactaataaatgtccatgaaatcttcacaatccaccttcttctgccatggcttcagccggtccctccgtttggggtccctgacttcccgcagcagtctcacttcattgcccaggctggttttccagctttttaatcagttatagcagaagtcagtaaactgtggcccactgtcggccaggcatggtggcttacgcctgtaatcccagcactttgggaggccgaggcaggtggattgcctgagctcaggagttcgagaccagcctgggcagcagggtgaaactccatctctactaaaatacaaaaaaattagctgggctcagtggcatgtgcctgtagtcccagctacttgggaagctgaggcaggagaattgcttgaacccaggaggcggaggttgcagtgaacagagatggcgccactgcaatacagcctgggcgacagtgagactctgtctcaagagaaaaaaaaaacctgtggcccactgtccatttttgtgaataaagattgattacaacacagccaagcccatttatttgtatattgtctatagtgtgctacaatagagcaaaaaaatatttactgtcttgcctttggcaggaaaagtttcctgattcctgagctataataatgataaattaattttccagtatatgtataaacatggaatgtaaaaaatttattttttctatcagtgttggtacatgttaaagtattgattttgttttaattgtgctccatcttctatcttcaaaggtccttgtaaaatactttctggtaatttcccttttttttttttttgagacggagccttactctgttgcccaggctgtagtgcaatgaatggcatgatcttggctcaccgcaacctccacctcccaggttcaagtgattcttctgccagccatagcctcctgagtagctgggtttacaggtgcccaccaccatgcctggctaattttttgtatttttagtagaaacggggtttcaccatgttggccaggctggtcttgaactcctgacctcaggtgatccacccacctcaacctcccaaagtgctgggattacaggcgtgagccactgtgcccagcctctggtaatttctttgagtccttatgtctccatttttgttgaatgataaattgtttgtcattataaacagttgtttctggccatctcggcatatgaagcctgcgtgttattaggaagttggatgtgttgtcagatttgtggcagagttacaaagatggtaaatgctcatccttaagcatgtactatgtccataatcagtttagccaactttataaggctataaatgtaacagtaattttgatgtttcttcctccatctttagcaagttagaattatcacttttggaaagtttttttttttttttttttttttttttttgtgatggagtcttgctgttttccaggctggagtgcagtggcaccatctcaactaactgcaacctccacctcctgggttcaagcagttcttctgcctcagcctcctgagcagctgggattacagacgcctgccaccatgcccagctaatttttgtttagtagagatggggtttcaccatgttggccaggctcgtcttgaactcctgacctcaggtgatctgcctgcattggcctcccaacgtgctgggattacaggtatgagccactgcacccggcctggaaattcttaccatatgacaattacacattcagaacatttacctatgcttggcagtgattgaagagaggctatggtccaggaaatcttttccctgatttttccttcagctgtgataccacctcttgggggcactattcaaactatatcccatgtgctacctggagagcccatgtagcctttccagcaaacaccttaacattgtgttaagacttgcctggccgtcgtacatggtaatgtttctatttctttattttcccagtactgtatgtctgtctttcccataagtgaggtccctccctaccttcatctctgaacttccctaaggcctggcaaatccaggacagtcaagtagattgggatctggatcctcaaaatccaggaccaaattattggaaataatccaattgttcattgacaagggattgtttaaatgaactatggtacctcctcaaagtgtattatcatattgttttttaaaattgtggaattaagaattccaggacatattgtgatattataaaacacaataatagaaccaaaaaaaaaaaggaacattataatttgtatgtggtgtagattagttgtctattcctgcataacaaaccatgtcagaacttcatggcctaaaatgataagcctccccgctcccttctgttagtctaatccgcccacctcagtctcccaaagtcttgggattacaggcaggagccacccacgcccagcctgagagtctgatttttgttttttttgtgggttttttattgttgttgttgttttttgtttgtttgtttttagacagagtctcgctctgtcgcccagactggagtgcagtggtgcggtcttggcttattgcagcctctgcctctcgtgttcaagcggttctcctgcctcagcctcctgagtagctgggattacaggtgtgtgccaccacgcccaactcatttttgtatttttagtagagacagggtttcaccctgttggccaggctgatcttgaactcctggcctcaggtgatccgcccgcctcagcttcccaaagcgctgggattacaggcatgagccaccgtgctcagcctggagtctgatttttttataaagcaatggatttaatggcttccttggccagcttctttggaatgatcagtgttcctgtcattataggaaagatctctatatggatctttatagatagatctaatatagaaagatctatattctgcatattttctcagtcatgataaacaggaacacttgaccagatcttctaccccacacagcatagataacatctcaaactcggtaaactgttattctaatagatttttttttttttgagacagggtctcaccctgtcactcaggctggagcacagtggtgtgatcacagctcactgcagcctcgacctcctggactcaggtgatcctcccaccccagcctaatgagtagccgggaccacaggcatgcgccaccacatccagctaattttttttgttgtttttggagagatgaggtctccctgtgttgcccagcctgttctcaaactctgggcttatcctcgtgtctagcaattctcccgtctcaaggtggtttggattacaggcatgtgccatcatgcccaaccataattctaatatattttaaaatatgattcaagtaaaccatgtgagagtatctgctgtatacccaccattgttatgtccattatggtacccttcatataaccctgtgttgaaatatccccagggacagataaagaaaaccactgtcacacaactagggagtgatggagcattcttcacatcaggctcaccttttgcctcaacatgctttctccttgagacctaaatttttcttctttccaattgcttgggagtagcctttccctttagataacctcattattttcttatctcgtatttacacctctgctctctgccagtctctgattaaaaaaaaaaaaaaaactcaaaagcaatttataatgatttgtaaatgcccttgattgtgggcagtttatcatggaagattcttctcaagtagcacatttctgggatgtcagtcagtaatacagtggttcccccttacccacgtggaatatgttccaagacctccggtggatgcctgaaaccatgggaagtattgaaccctacatacattccttttggactgtaactgagcctatgagatgcaacagcaaaatgagcacaaacgtctttttccttcttacagtagatgtcagcaacctcagcataggaattttttctttccttacgaagtcaagaacttctgccttttcacttagtactttacagcttcactttggtgtgtccgaattgccagcatcactcctcttttactttggggccattattaactaataatcagggttacttgaccacaagcactgcaaaaccatgacagttcatctgatggtaaccgagatggctactaagtgacttatggtcgggtagtgtatactctggacaaagggatgattcacatcccaggtgggatggtgtgagatttcatcacactattcagtacggtgctcaatttaaaacttatgaattgtttatttctgaaattttccatttgatatttttggactttgggtgactgtaggtaactgaaaccgtggaaactgaaactgcagataagaggaagactgctgggtgttcagtgttactttcctgtggagctacaggatagttctactctttagtttcatctttgattctttaaattcctatgtaggaaaaaatatcactgctatcacacagagaactgtttattactttattctttcatctgttttctgttttcaggatatccttagcaaattgcacacagtgaagaaattattcagacatacttttccattttgactcatcaagttctttggcttcccatggtttaggtgttgaaccataagtcattttggaaatgcatgctgtcatatctgggttttattttttaatatatacatacatatatatgcacacatgcatttatttttaatacacgtatacaaatatattcagaataatcaaaacacaaactcatagggtgactaaattgtcagttactttgaatttgaaattgagttggacccttatgacaaaaccaagggttattttgacttcctgggactaaatctttatggctgtttgatatgctaagcaatggtgtttatggacttaagccacaattgagggaaaagaatttcttcttcaactctatttaaggttctccaagatagaagagagttcaatatatggttgattctttaatgggatccagctagaatatagcacataactatcattttcataaaaattcaaaaaggaagtcaccataactaggatgacataaaggcatgtcatagccttcttcctacagggacttactataatcctgtgaccccaggcagagggttaaaatgcctactttggaacataccctttcccatcatctgagcaactgctgaatttgtcaccttgtaaaccacttggatagatctcactccatgaagggcattcatgccacccagcttccatcaaaaatgccactttacattgtgcttggtgattttgcagctattaattcttggatcattccatacattatctctgagtttccatggataaattgttgatagtatacctattttccacagaaaacagatgttaatattaacttggtcaaggtcacatacctagttaatagtatgtccagaatttgacaccaggatttctatcttctaatcatcattcctgttaattaagcaccttctgtataccttgcagtgatttaggcatcatctttaatcattacatgtttcctgacaggtaggtcttactgtcactcattttacatatgttgaaaatgaggcctagaaaggtgaaatgaattggtgaaattcacttgcattgtaacagaatgagaattcacacggaatctctcagtcttcatacctgtgctttttctgcttcattcacttgaaacatgaagaaacactagtgttgtaggttttgggtggtgaaatgaaaagtatcaatctgtaaacagttctctagtggctgggtttggcccactatcaaagcttttggttggtaagagcacagagttcagcgttctgcatttgggctgctctaacttttttattctgccaagtgctgactgttaaaactcatctcactgctaagccttcctcaagtctttggcacccttgctatagagccaggtggtctgaagaaaagctccctctaggttgttgcacactgtacacaacacattacagtgcgagacaactgtcagttccttcctttccttctcccctacccttccagaaagctgggccccagatggaagagctggaaatgtgtcaactgttctctgaagggcattgagaaaatactgtcaggaagaaaaggcaagcgcaacagctcattagtccactaatcagacaggacgaccatcaatttcacaaagaaaatgtcctgaacagagaaatgggaagggctggcagagtgttgcccacatggttctgagaactgcacatttttgtcaggggatttgtaacttgggggcattgctttcttgattgactttattatatccctttcccaagtgtggccactgcaaactgaagcataaaaatggtatttggagatacttttctacaaataccattgtgtcccatcaatgcacaaaaatgttccttgttgccaggatcgtgaacactcttgtatgtattgtctttatagctgtgctctcacagaaggaaaacttggactttaccttcttatttgagcctttgctccccattttttacactttaatttgaattcagcagttattggagaatgaatggctggtacttaagtgaaaagcttagaattactgtgaggaacatagctcaatttaaaggtgattatggtaaccctggtcgtattattaactaagtatgtaacaagttctctttgatagggaaaaataacttgttagatatattagaatattactcattggtatcaagtctgattcctgttagctcagacctacctaattgcagcatcatgaagtttatctaatttatctttctggaattttgttgccatttagtattatcaaacaactgcctattattaattgttcccatagatgaagtagcctctgcttcatgtagactcagctctacttttcatctttttgaacaatgtatagcatgaatgacatttacatgtttgaggtcagagaggttgactccctcttttttcctacttgatgtagttgatatgtatatatataatttagtacatcattattaatggtgatttttttttttttaagacagagtcgctctgtcacccaggctagagtgcagtggcatgatcttggctcactgcaacctccgcctcccaggttcaagcgattctcttgcctcagcctcctgagtaactgggactacaggtgcccaccaccacacccagctaatttttatatttttagtagagacagggtttcaccatgttggccaggctgatctcaaactcctgaccttaggtgatccacccgcctcagcctcccaaagtgctaggtttacaggcatgagccaccgtgcccagcctattaatattgatttatatataactgattgattttcttttcatgtcttgcagttgaggcctaagtctagatagttcccatgttagctttttcacccctaataatttgattcatttataaggagaagttaaagaaaatgcatttgaggtaagctatatttgtaacctggtttcttcctttctcagccactatctaaagactgctaactttcagttcacatcacctcttgaccttgtttcctcattttagttcctagggttgaagtaacaaagtaccactaactgagtggcttaagacaatagaaattcattctctcacagttcagaaagccagaggcccaaaattgaggtatcagcaaggttgattccttcccggggtttcagaggacaaatgtgtccccttctccctcctggcttgctggttgctggcactccttggcattcctcggtgtatagatgtgtcactctagtccctgcctctgtcgccacttggtgtgactgtcctctctttggcttccctctgtgtatgtctctgtgtctgtgtctcatcccttctttaaggacaccattcagattggatttagagcccacccagacaatctaggatgatctcatcctctcaagatttttaacttaatgatatcttcaaagacccttttgccaaatcaggtaacattcacagttccagatgttgggatgtggacatatcttttagggggtcactattcagcctattataccaagcagtcctctagggaagtatgttggtatttcaaattgttgtctgtttttgcaaacttttagaaaaccctaacctccatttctctgattctctgcagttggtcctgagaaaagggtgccagcgatgcctggatcgcctgtggaagtgaagatacagtccagatcctcacctcccaccatgccacccctcccaccaataaatcctggaggaccgaggccagtgtccttcactcctactgcatgtgagacctcttagttacttatgtttgtagttcagagtgacatttggatctaagtgactgacttgtatgaagcgttccacatatattattcagtgttttcaaagtactattgaaaatatagacacagatatatatttctggttgtttcttttataaattacttttaccctctgagaataatacttagcttatttggatatttagttgtttaaatattttgttttcatattctttggctggtaactatttttatttctttgactctaacaataatgaatttaaattattatattgccttatgggattccaagtaagttttctaaaattatagaattctaaaaatgttccagtgctgtcatggtaagactttttacaaaagagaatattgttgtatttgtttactagggctgccataatgaaataccacagactggatggtttaaacaatttatttttattcactttttcacagttctggaggcaagaatgtaaagatcaaggtattggcaggtttggttttacctgggccttgtagatggttgccttcttgccatatcctcacatggtctttcctccattttgcgtccctggtgtctcttcccctgcctttaaggataataatcatattggattagggactactcataatacctcttttaaccttaatgaactcttcaaagtatctccaaatatagtcctattctgaggtacaaggggtaagacttcaatgtatgaatttggccaaggctcgggcagaattcagtccataaccattatgttagctaataatatatgtaacaatatattcaacttcactaaccatcaaggaaatgcaaactaacacccaatacagtaccattatacacccaccaggatgttcaaaatgataccaagttttggtgaggatgtatggagcaacttgaacactcatacaatgctggttggagtgtaatttagtacatcttttggaaattggcagtttgcactaatgctgaatttccacgtgccctgtaactcaacaatttcagtcctatatatctataatcaccaaaagaaccccaaataaactagtatacatacatgcacacaagtgtcttgatcttcatttgagttctacctttccatgcacatgctgccgtccccagttcactttgacactctgcagatcttttgcctgtaaaccaaaatgtactgctatttttggaatgcccaaaaagtgtcagagcactgagctagatgctgtatgtattgtttcatttaaatgccattacacaagcttgcacactgtccttgctcaaaattttttgttttttgtgtttattattttaaaaggcaagagaagagaatgtaagatgtacagctttaattggaagtttattattttccaaaacatttgaaatggagtagctggtaactgtagcattcagtttgagccagagtgaatgaaaagaagtgtgatatcccttttcttaaattctaatttctatctcaaagttgaacagccctagacatatatactatcttgaaaagaaacagatttaaacctcagccatcaatcagatttcaagatacaccaataggtatatgtatatacaaattcagccctttttacttccatatttggctgcttggcggtggttgtgtttcatttcagaaaatgtgatcatacatttttttctaaagagactacgaaaaagcctttctatacatcagagaagctaaaagcatggtaatgtgttatttttattggttccttcaaaatggagcaactttccaatggcaattgacctttctgtgaaaacaaagaaatggcagactattgcaactaattttctggattgctgaggttgagtgttcaactttcctttcattagctttactaattttctttagtggaagacacaagaaaactcaccccttttctcagcccgttagtctgttatgcagtgaatcattcagcagcattttcctaaacaccctttgctgaacaaagcaaaaatatacactgtatacacaacttataaaacttaattaaagtatgcacatatgtattgtgtattgtattattaataagtgaacatctattaaggcaacacaaatatagaaataaacaagcataggccaggcgcagtggctcacacctataatcctaacactttgggaggccgaggaggacagatcacttgaggtcaggagttcgagaccagcctggccaacatggtgaaaccctgtctctactaaaaatacaaaaaattagctggatgtggtggtgcgtgcctgtaatcccagctactcgggaggctgaggaaggagaattccttgaactcaggagacggaggttgcagtaagctgagattaaaccactgcactccagcctgggaaacagagcaagactcggtctctaaaaaaaaaagtgaaatagtggaagcatgcacataggcagcacagagatgtagtgaatccactaaggttaccttcaagcggagcaacagcagtatgtgtcaaagaatgctccttaacagagatgatacctgaaccgtatgggatgaagaagagcttgccaggtcaaatttgagtaaggttcagtgtaagaagagggaacagagatggttaactgactgtgactggcttagaggaagtagaagggaagtggaagattttttatgattaataagttggtttttggcaaaatatgactaaatgtcttttttctaagctaggtaaagattaaatgattggctctttaaacattgcttatgtcttaaattgtttcttatgtttttagataaagtttcacttttttagttttttaaggctggatatgattaagtgaaaacagaatgatacttaggtactagataatttagatttttacttgatgccaacaagaacgtagctcagtgccaggcacggtggctcatgcctgtaatcccagcctttgggaggccaaggcaggaggatcacttgagcccaggagtttgagaccagcctgggcaatatagtgagactccctgatctacaaaaaattttaaaaaaagaaattagctgtgcatggtggcatgtgcctgtagtcccagctactcaggaggctgaggtgggaggacacctgagtccaggaggtcgaggctgcaccaggaggtcaaggctgcaatgggccaagatggtgctgctgcactccagcttggatgacagaatgagaccctgcctcaaaaaaacaaacaagcaaaaccatagctctagggttgttttcgaaattaaaattttcaagaaatgactattaagaactaaataggaaaactgtaattaatcacatgtattataatttgagcaaaaatgtaggatgggagtgtcctgcatggaatcaggaagatgctttattgaatgaccaagggtttggcagtattaatctagcactgttaaggcagagagtaactggctctaatggacatgagtattctggatggccaaagagataggtaccttattgtaggaataagtcattaaatcagtaggcctaaaaaatatccctcatattatcataactcttttttctggtgtcttgctcacatgctaccttctgattgactgcctagtgttttggggaccttgaaattgggaaggagatgcaatgtaaaagatgggcatgagtatcccatcactggaaagatctattggcccagacccatctcaagcactacctgttgcaggaagtctttcttaaaactacccacccctgcccatggcacctgtagagttagatttcccttcttattgctctgggagcactctgctttctttttaacgctccagtgttactctgttaccatttttatctgacagcagtctcactgaggacagaaccagttttgcatacctttataacatgtgctttacaaaattcaaatgaacaaacgaaaatacaaacaagaaaaaatgaacaaaggttcccttgttttacacgtaacctgagtctttcattttggctttcttttagtaagcaatggcatcaaccattctcctcctaccctgaatggtgccccatcaccgccacagagattcagcaatggtcctgcctcctccacatcatctgcactcacaaatcagcaattgccagccacttgtggtgctcgacaactcagcaagttgaaacgctttcttaccactctgcaacagtttggcaatgacatctcccctgagattggggagaaggtgcggactcttgttcttgcactggtggtaagtacagcctcactgttgttctcagctgcctgagtatgtggctcaggtccaaagcgagcaaagttctagatatttctgctcattttcaaacccatggtcatatggcaaatgctacagactagactagttattgaataacttgtgtaaaactgtttaaatgtaggtttcttttcttttcttttcttctttctttttttttgagggtcttactgtgtcacccagcctggagtatgatggtgcgaacacagctcacttcagccttgaccttccaggtttaagcagttctcttgctgcatcctcctgagtagttgggactacatgtgcatgccgccatgcccagctaatttttttattttggtagagatgggatctctctatcttgttcaggctgctttcaaactcctagcctcaagcagtctgcctgtctcggcttcccaaagtgctgggattataagcatgatgtttaattgtagattttatgtcagtgcttatcaaagaaacaatcgataatgtttacttgttatttaaggtggtgatttaattccaataagcaactttggattttttttaaaactgctctcaacaggcccactggtgtccaaccaagttaatgcaaggttttgtaatttaatatattcagtgcttagtgcattgtttccaaaccaaggagagtagagaggtagcaagtttaattttcaaaacaatgatttctaaaattacaagttacgtggcctaaataaatactatcaaaataaacagtatcaaagggattgcattgttcagctcctcgtgcatataaacttgcttaagaatttgcaaggtacacataatttttctttctttctatactgcacgtggtgaacctgtggcataaaggagtgattttctgacttcgacacctgggtggggttttattctcagtgtttataagggaagtactgccagttcccaatgtttctaattgaatttacctccaataaaagcattctgtgctcctttgtgtatgttaacccctttatatgggataaaaagatgaatcacagcactaatccttgaagctgcagctctccgagtgtaaatctagggaccctgaagattctccaggatcctttctggagatccagaaggtgaaaactattttcataatataacagtagactaaatgcaaaagtagagagaatacaactggcttctagtatgctagatattaaagagactttctattatgctagatattaaagagacttgcaaaatgataaaacagtgctgctcttcttactgcatttattttggaaaatacagattttaaaaatcacacctcagtctgaaccaatatagttattttttattttaattaaattctcagctttaatttctgatatagtaatgtcaataaatgtaatccatataaattagaggaattctgagaccaaacagtttaagaattattgccttaaaaaatttctcagtctaaggccagatgtggtggctcacgcctgtaatttgggaagccaaggtgggaggattgcttggatgcaggagttcaagaccagcctgggtacatagtgagactgcctctacaaaatgattttttaaaagttagctgagtgtggtggcatatgcctgtggtcctagatactcagtaggttgaggtgggaggattccttgggcccaggaaagctatgtttgcaccactgcacttccagcctaggtgacagagtgagaccctatctcaaaacataaatttaaaaaatttctcagtctattatgaaaggaacaactttcatacaaggcaaaatgcaatatatgactttttcatcatttgtgaggtttagtccttgttacgtatgactgtaggttattttcattgctatatagtgtcatattgtaggaatataccacaatttatacctttgggttatctgacatttaagtcatttgtaatttggggcagttttggggtctccagcatctcccccatgtttggagatttgccagaaggagtcacaggacttgacatacagttgtgctcacagctaagatctattacagaggcatagtaaggagacatagtgagagagacacagtctggaggaacccatctgcaggtttccttatgctctctgcctctcctgaatggtaacacagagctccctttccttagcaacaaaaataacagcaacatatatgcagtgtttctgtcaagggaagcctattacagactcaatgccaaggtttttgttggggcctggtcacatagtcagtctttgcctagcacctgccaaattttaccctcttagaaggaaaacccgtgtttagcatgaaccatactgttcgcagaaccactctacacacggccacccttatcggttagggagaagtttagttcttttttattttaaacctgtttattcctcaaattttagactactacagaaaaatcttactggatccagagtaaggttattggagttaaatgtcaaaatgagcttgaacataattggaaacaaagcagacatcaaaatgttatgttgattccagcagcaaattaagtattatctattcttaaaaataatttcaagactaaaagtaaaaatgtcaaaaattcatttgcggcgggcggatcatgaggtcaggagatcgagatcatcctggctcacacagtgaaaccccatctctactaaaaatacaaaaaattagccgggcgtggagcttgcagtgagccaagatcgtgccactgcactccagcctgggcaacagagcaagactccgtctcaaaaaaaaaaaaaaaattcatttgtaaaaaatttgaatctttttttagttatgaaaagtatatgtaggtgtgtccaattatttcttttaaatggccacatttgggttaccttttttttccatagtaaaatatacattatagaatataccattttaacctcttttaagtagacagttcagtggtcttaagtacattcatattgtttgtgctgttcaccatgtgtccctgtttgccattgtgtatttagagcctatgagcaccacagggttaaggaatttatacaattgctttttttgaattgtgatgaaatttactatattaactatttttaggtttacagtttagtgacaataagtatattcatattatcatacaaccatcatcaccatccatctccaaaactcttttcatcttgcaaaactgcaccaattaaacaataataccccattcccccctctccctagaccctggcaattaccattctactttctgtccctatggatttaactactctaggtacctcatacaagtagaatcatacagtatttgtctttttgtgactagcctatttcacttagcttaatgtccttagggtttatgcatgttatagcatatgtcagactttcctactttttaaggctaatatttcattttatgtctatatcacattttattgatctgttaattccccaatggacacatgggttgctgccacctcttcagttaagaaaagttttatatcaatgtaggaaactgtttgccatccagggtcctagatgccagccagtggcccaaccttacaagcaggcctttctaaggctagcagttttaggcctactatgttaactcttttttgtacagaaccattacaaataatgttcctatgaacattcttttacacgtgtggaaacactgcacgcaacagtggaattgtggtttcatatgtgtggtgtgtacctgtagtcacagctactcaggagactgaggcaggaggatcactttggtccaggagtttgaggccagcctgggtaacatagacagacccccatctctaaaaataaaggccacataatttagtagctggagttatccatctgcattctgtgtccatggtgtataagaagtaaggtactgagagtccctaactataccagaaagcaagcatgggcattttgcacttcaaggtaatggtaaatgttttgtgcttcacttacttattattatttggagaatgtactttctggaggatagtttggcaatgtttctggtaccattcatcctaagaaaataataaacataaacaatatacaccaagataatcagttcaacattaagtaccccctcccccattgaagctaactgaaaggtctgtaaaaccctgaggaaagtacaatttatctgttgtcgttaaaaatcaagtctcattctggttcagaggcaaggtagaaagacagacttctccctattccccccaataagtagcaaaaagccgtggactttacctataaaacaaaaataattagagtcttcaccaggtgtggtggagtgtgtctgtagtcccacctatgtagtcccagctgaggcaggtggattgtgagcctgggggacagagcaagaccccatcactttaaaaaaaaaagagagagagactcttaaaggtagagagaagacagcagattcactcatgggacccaagggactacataagcagtgagttccctaggttttgtgtttttctgatatatcccacaccaggttatgcagaaaatgttgagtttaagagtaaaaatataggtaagtaaataaactttccttagctggcatagtggagtatgcctatagtcccagatactcaggaagttgaggcaggaggatcacttaagcccaggagttcgaggctgccatgagccatgatcacaccactgcactcctgcctgggtgacaaagcaatactctgtagatagagatagatagatagatagatagatagatagatagatagatagatagatagatagatgacagagcaatactctgtagatagatatagatatagatacatacatacatatacatacatatatatatacataggtaactagctaactaactttccctctcctgagttttctaaattatgtttcttgttggcagcaaaaattactttgcctgatatggttgtcactatatgtagaggaaataattgccaatttttattataaaccaggaggataaagatagacaaggtttctgtatttctgtattttggtcagtggtggttacatgaaaatacacatatggcaaaatggtatagaactataagtatgttgtaccaatgttagtttcctagttttgagattgtaaccctttgggaagccaagttggaaggatcacttgaggtcaagagttggagatcagcctggtcaacatggcaaaatcccatctgtactaaaaatacaaaaattagccaggagtgccagtgcacacctgtaatcccagctacttggaaggctgaggcacaagaatcacttgaacctgggaggctgaggttgcagtgagctgagatcacaccactgcactccagcatgggtgacaaaacaagactgtgtctcaaaaaaaaaaaaaagatgtaagcattggagaaagctgaatagaggatacattggagtataagtgttgcccttgaaatccagagaccagattccctcagcatcttacctctcaacgttcttctctctgctctgacacatctttcccaaagctgcatttcagtttcctcaaggacaacactgatgtacagaaatccttgtccccctaagtttgattcaaatatatcttctctggccaggtaacacccataatcccagaatttggaaggcccaggccgacttgaggccaggagcttaagaccagcctggggaatgtagcatgactccttcctctacaaaaaaaaaaatttaaattagctgggcatggccaggcacggtggctcacgcctgtaatcccaccactttgggaggccaaggtgggcggatcacgaggtcaggagttcaaggttgcagtgagctataatcatgctactgcactccagcctaagtgacagagctagaccctatctctgaaaaaaaaaaatttttaagcaaatacgtcttctctgtgagtcagtagtgtcctgtacatgtgtacctccatcatactgtaatgaatagcttagttgcctcttttcccactagactatgagatctttgaggggaagaaacaaacaattatgctcttaatataaaataaggttttataaactagctgaaggaggaaggtgtttatccctctcatacaggactgccctatatccactatgtatgtaaacctgagtccatttctctggcctaactcactatttccctgtgtcacacaatccatcctttccccttgtctacccacaagtatacttaaaatcattcatgtagcccttccatacatttaatctatttgtgtttgcttttcaagacctgattgcttcccttgcagtagatataaaagagtgtcattctcttacacttagtttttattcctgattaccagaattacaggtttcttttgctgtattgtgcaaatgtcatatacttaaaacagatataacgttaactttaaaagaatttttttggtatgaaatgtgggaaagtgttcaaacattttcctttaatatgtttaaattggacataccccttttccctgaaggaaaatgtcttaatgtttaccgaataataaatatgatatatttggaaaatccaacataattgcacactcagaaataactgttattgtgattattctcccaggcattaaatatatgatataatatgcatgtgtgttatttttgtaagtggattcttagaaaatataatgttctgtttctggtttttcacttaacagtattgtaggtaccttttctgccttaatgcgtacaaatctgctctaccccctccctgcataagcattctgatacatgactcttgtaattttaatgtagctttctgttggtagatctatatattttcctttttttttttttttgttaggaaaatatattgtgatagcgtgggggtaagttgcatgttacatactatgtttttgaacacttacaaagtttctaaaagtaaattcctagaaatgttatagctctttctggggagcaagcagggattcagaataatccccatatttcattttgttcgtttgttttaatttgttatcatacagtgttatcggcaattgaaatacaaatattgtgtgaactttgaagaaaatatttttatttgttcattccccttagcagagttgctgagtctcattcctaatttgaggcctagacttttgggaaaacacagaggacgtccaccttttagagaacagtgataacttaccaatgggggtttgccggttgggagttattctggtatgcataatgcatacaggccacttgaaggtagaaggcaactattcttttttcttttgcttctggtggtttttgtttgtttgtttgtttgtttgtttgtttgaagatttgggggaagttatgccaggaggtagggggcagaacttggaaaaagaaatgaacttttgaaaaaatgtgacactgggttactgagtccaaaatgtcttagagttgacatcctaggccaagtcattatctctgtaacaggaaacattgtaagcttgattgcctgttcctgaagtgacttgcaatgaacccctcaatatcagggatcagagtgcctctcttcatgggtagtgagaaaggcagtgccctattctgcagcctaggctgctgggcaaaggggagaatttggtggtggtgaagggaatcaaggagggtttctgtcataagaaaccagtgtggtttacctttgccaggcgtctgagttcctgatgatgttcctgcagttatccttttccttatgatttaaaagtctttagcagctgagcacggtggctcacccctgtaatcccaacactttggaaggctgagggaggaagatagcttgagctcaggagttcaggaccagcctagacaacatagcgagactgcatctctactaaacatttaaaaaacaaaataaaaagaccgggcgcggtggctctcccttgtaatcccaccactttaggaggccgaggcgggtggatcacaaagtcaggagttcaccgtcaggagatcacaggaggtggaggttacagtgagccgagaccgcgccactgcgctctggcctgggcaacagagcaagactccatctcaaataaataaataaataaataacattaaaaaaaaaaaaaaagaagagtttggcactataagttttggaagtccagttttggaagttgaacaaggttatttatcttttcagaactcaacagtgacaattgaggaattccactgtaagctccaagaagccacaaactttccccttcgtccttttgtgattccatttctcaaggtaatttgataattactgaatataatttatcttgaatatttcctcaaattctgctaatccctgttacgtgatttaaatcagagccgcttgccacgtttttagatctttattttgggctggtagagaggtctgagtgcagttaacagataaacgtcaggtttaatgagatgagaattgcaaaagccttaagttgtggtctgtgtgcagacactgctgctaacacatagaagtagctagcataggagagaataggaggtgcttgggctggaagtgtgaaagtggaagggaggctgaggtcctagcagaagaaataactggtcactaatcctttgggtatagtcagagtgtgaagagtgttgtctgagaggctgtcagacaaaaggcaaggtctttgcagtttagacttactctaaggtcaggagacgatgtaggaagacagtgtttgtgtctccccgaaccccagatagtctagtttctaaagatgtcttctgcaataatgttctctggagcataacttttggagagattgttctgcattatcatgcttacatgataaatgaaatgaggccatgttatatatgttatatttacatggaataaaatcttctaaacagcttttggccagtcacggtggttcacacctataatcccagcactttgggaggccaaggcaggtggattgcatgagctcaggagttcaagaccagactggccaacatggcaaaacccccgtctctgccaaaaaaaaatagaaaaaaaaaatagccaggcgcttgtagtcccagctagttgggaggctgaggcaggagaatcacttgaacctgggaggcagaggaagcaggtgagctgacattgtgccactgcaccccagcctgggtgacagagtgagacattctcaaaaataaaataaaataaagaataaaaaaagaaatatttaagagtaagccgcaaggccgggtgtggtggctcacgcctataatccatgcacgttgggaggccgaggcaggcagattacctgaggtcaggagttagagaccagcctgactaatgtggtgaaaccctgtcttcactaaaaatagaaaaaattagcacatgcctgtagtcccagctactcacgaggctgaggcaggagaattgcttgaacctgggaggtgcaggttgcagtgagccaagattgtgccactgcactccagcctgggtgacagaacaagactctgtctcaaaaaagaaaagtaagctgcagacattatacatctaaatacttaaatacaggtatcaaatcaggaaagtaacattcatacaacactgttacctatagaccttattcatatttcaccacatgtcccactaatgtcttttacaacaaagaaaaacttgggagggagcatagttctggatctgactcaggatcacccattgcattttgttgtcacgtctctttagtccactttaatctggcacagttactcagctctttgtgatcttgacgtttttacagaatacaagatagttattctatctgcgcacctggatttggttttctctggtgttgatttgattagaatcatttaacagaaaaactgtattcaattgttactgtattttgaattttgtcaatatttatggaaatttgttttctctcttttatgagtatctctataatacctttaattttactgccttttttttttttttttttttttttttggggagacaaaatctcgccctgttgcccaggctggagtgcagtggcgcgatctcggctctacaacctctgcctcccgagttcaagcgattcttctgcctcagcctccagtgtagctgggactacaggcacgcgccaccacacccggctaatttttgtatttatagtagagactattaatagtagcgaccatattgtccaggctggtctcaaactcctgaccttgtgatccaccctccttggcctcccaaagtgctgggattacacgtgtgagccaccgtgcccagcgtctaattttgcctcttaacaaagcctaaaatatttactgtctggtcaaataaatatgccccttttactttcttttaccttattttcatttcctaagaaaatgtaacagcatcatacagatgggttatcttactaaagtactaataccagttttttaaaaccttctattggagcacagcagatacacaggaaaatgcatcggtctaaggtgcacagcctgtatcatggctcggttctaatggcattgaagcctcggctgctctgagcagcctgtggtgcctttttgagccctgaaacagctgtgctggttctatcttggtctcctttatgtatgtcagagctggtagacaattatttccccaagactctagaatcaagaaagatttgtgaaatttgtgttaataggaaataattagcatgttttttattcatcatgggacacatgtcagccgtgtaaagatctgacatggtgtttttttcaattaagtttttacagttgcaacaagattgaggttatagaacagactttaaaagagttttatatagtcaaattccttattcttaactctgttattttggaaaacagcatgaggtaggttgttatggcagctttttggctagcatttggggttttgtcaatttatttctgctttaaaacagtcactaattatggtgcctgctaaattaaccctcagtgaagggatggctacttgcatgtattaaaactctcctttcacttgctcatctgtcccttgggattaagcctttgcttatgagcccagcctgcattgcttttaaatttggtgagaaaaatataatttctactttatgttttttttaataaaaatgggaaaagtaaattctgtatatgaaagagatcgagttctgagcttttaaagatgtatagggttttaaaatgtgatttgttcctattgcaggttttctaagtatgagagacagaaaaatacctacttaatgaattatctttttacattttacatcactcccagtgctccttttcaaactcccatgtttcagaataatcacagtttccagaattctgttgcagcttttatacagagctggaaggaaggttgagtagtgctatcagagatgagttggggtccagaagagagaaaccagggcttggaatgactcccacataggcagtagtaattctctcactgactaaagtcttcagaagcgtatgttttaaaattattatgttcaacaaccctttattgagctttgactgtatactaggctgcaaaggtaaataaggtacaatctcttccttaagcatatttacatctggttggggcaagagacaattgaaccagtaattcaagtgcagtataagagatatcattgactcacagaagaagcatttgaaaatcagactgccaaggagagaaaggcttttatcttgtatcatctgctttgtgaaagccctttgaggtgctgagccttcttgtgtagggcctaacactggaaaaactgcctcttcctttcaaggccaacctgcccctgctgcagcgggaactgctgcactgcgctcgggcggccaagcagaccccatcccagtacctggctcagcacgaacaccttctgctcaacacaagcattgcatcgcctgctgactcgtcagagttgctcatggaggtgcacggaaatgggaagaggcccagtccagagaggtgagcagatgagctttgctgtccttgccttcctggaaccgcactggtcctcccctttgcttataaaagagagagaatttgattgctgtggttgtaatgtctcaaactttttttgagacaaggcctggctctgtcgcccagactggagcgcagtggtgcaatctttgctccctgcagcctccatctcctgggctcaagcgatcctctcacctcagcctcctgagtatctgggattacaggcacgtgccaccatgaccagctaatgtttgtttgtttgtttgtttgtttgtttgtttgtttgtttttggagagatgaggttttaccatgttgcccaggctggtctcaaacttgtgagctcaagagatctgcccgcctcaacctcccaaagtgctgggattatatggatgtgagccaccatgcccagcccaatgtctcagactttctgtggttatttttgctttattccaatacctagctgcataatacatctaaaatctatgggagtagcttccagacatgagtatttttcgggaactcttcagatgcctgcacacccggtaagaaactctactctagagaatttatgggtcgactgttccagaagcctcaggagtacagttctgccttttccttgatgctgtttgtagaaagaattggaaaaaaaaaaaaaagaaaagaaaagaaaaaacaaaaaaaaagaaatacaatctgccaaatgccttttatgtcaaacgcatttttttctgatctgagaagttttgaaaaagtatagcaattaattattaatatttgccaatgactcacctttactgagattaaaattaatatgaatttattttagaaaactccctatgagtggctatcaaaatattctatgggttatcaaagaaggcaatatcaacaatagtggataggctttaatgacatttttttaaaagtaaaaaaaaaaaaaaaaaaagaaaatttattacagttgaatctgagtgactgaaaaccctgctactacacaattggacccactgttaatttgactggctttaaaaaaaaaaaaaagacacaattggatttgttatatgagcctttttcctcccatgtagtttctttccagtaactcatctccacagtaacaaatttgaccttaatactttcctaagtatggttgaacccgtaactcagaaaaacggtgtcatctccttagtctctcctttgctttataagggttaatgtttctgtctggttatggatggatttgacctcttttttcatgctggtataagtcagcaatttacatgaggtgcctggcccttgaagacaattcagctcatgcctcatgtcacacctttccttagaggcttcctgtttatgccagcatgtagcaaaatacctaatacatagtaggttctcaggaaatgtctgcatgaacacttgttgacaggatcagatacgcacttctgcttcttctacaggagagaagagaatagttttgatagagacacaattgctcctgagcctcctgccaagagagtatgtaccatcagccctgctcctcggcacagtcctgctctcactgtgcccctcatgaatcctgggggccaattccatcctacccctccacctcttcagcattacaccttagaggatattgcaacttctcacctgtatcgggaacccaacaagatgctagagcatcgagaagttcgtgatagacaccacagtcttggtaagcaaccgaagcagcatggtaaattcagactggattcttggatttctttccaactcaatgataaagtcaaataatatgattgctttttcccactgattggataaaacaatattatacatagactattagaatcatagttgatcttatttgatatcaatctcatttgataccttgttgctatgatatgatagaagtacagctaggtgtggtgactggtgtctgtaatcccagctcttagagaggctgaggtggaaggatcacttgaagccagtctgggcaacatagtgagatcccatctctacaaaaaattttaaaaactagccaggcttggtggcatgcgcctgtggtcccagctactagggaggctgaggagggaggatcagttgagtccaggaagtcaaaactacattgagccatgatcttgccactgcattcagcctgggtgacagagtgagacctgtctaaaaaagaataaaggggtatcgcctattctcagatggttcagaagaagagaatgaaaaagcaaaggaggtaaaatgttaacatttgagaactctgtttgaagatatgtgagaattctttgtgctccttttgcagctcttctataaatctgagtttattgcagaataaaagtttttaaaattaggccaagctcagtggctcatgcctataatcccagcactttggaaggccaaggcaggaggatcacttgaggccagaagtttgataccagcatgggcaacatagagagacctcatctctacaacaacaacaacaaaaattaaaaatgaggcaggaggggctgggcgtggtggctcacgcctgtaatcccagcactttgggaggctgaggtgggtggatcatgaggtcaggagatggagaccaatctggctaatacagtgaaaccctgtctctactaaaaatacaaaaacttagctgggcgtggtggtgggcacctgtagtcccagctactcaggaggctgaggcaggagaatggcgtgaacccagaaggcggagcttgcagtgagccgagatcacgccccagcactccagcctgggcaacagagcaagactccgtctccaaaaaaacaaaaccaaacaaaaaacaaacaaaaaaaatgaggcaggaggactgcttgagcccaagaggtcaagactgcaatgagccatgatggtgccactgcactcccctcctgggcaacatggtgagaccctgcctcaacacaataaaaaatgtttttaaaattaagcaggaaagatgcaagatttcaccttggaggagaaagtgcatggacatttaggtcaggaggtgaggcatatcgaaatcttggctctgcatcctaactagctgtgtgatctcaggcaagttgcttgggctctctgagcctcagaagagtaatttctaaatgattgtaacgccaccccctgtgctaggttgttgttccatttggaatgcctggtatataggtgctcagaaacctttaaatttaggaagaaacagaaaagaaaccttaacaaacctcttctagttttggacagagcggtttgtcatgtactcttacacgttttcagcataaggttttttggagtaaaactgctgagcagagaaccaaagggctatcagcttccagggtttccctaaatttccatgtataccttgttgagtaaaaaactgcaatacatttgccctcacttcctcttacttaggctcactagcatctttcagacgcttggccacagtggggcccctggcatcatgtagtgggatagtagctgaatagggaaggctgtagcagccatggtgttctcagagccaacatttactgagtcgtagctaccacttagattgtgttgtaagtacattgtcttattttatcctcacaggagtcccagacaattgttatcccctttttacagatgaaggagctatggccaaaaatcacttagctaataattggcagagacaaaattcagaccccaattgtcttatgcccaaggtttagatgtactggcagtatgttatgatacttatcctagtgttcaacccctgttactcctatgcctctcttttatctattaaaaactgcttgcgggcggtctggcgtggtggttcatgcctgtaatcccagcactttgggaggcctaggtgggcgaatcgtgaggtcaggagatcgagaccatcctggctaacatggtaaaaccccgtctctactaaaaatacaaaaaattagctgggcgtggttacaggcacctgtagtcccagctacttgggaggctgaggcaggagtagggcgtgaacctgggaggtgggggttgcagtgagccaagatcacaccgctgcactccatcctggcaacagagtgagactccgtcaaggggggggaaaaaaactggcttgctttgattggaaatagcacagtgggggaaaaaactggcttgctaattaatggtttcttctggaccttttttgccagtttgacttgagaaagaagtatgctaaaaactaggtatggggtctcactatattgcccaagctggacccctgggctcaagtgatctacctgtgtcagcctcctgagtggctgggactataggcccaccccaccacacctggcttttattactacattttttgacagattttacaaatcatgaggaactcaatatatactgaaataaacagattatcacactaatacatagtcactatgaatattatgactataaattcagactggtaacaggggtgttgtgttaatgactcaaagactaagcactgttactgtatgtgacttaggtttaaaatagtagacaattcttactggtatacccttaattcacacagttgttccattcctggaagtttcagtatatatcaaaactatccccccaccaaaaaaatttttttaagttactgataatattaagctgtttccaagtggttataccagtacacacgctagttttggtggttaattattcgcattgcaccacatccttgtcaacacttagtattatctgacattttaattttttccagtatgttagatgtgaaatgctatgtatgacatacctgtttatttcttttacctctttttctttagggctatttcgtgttttacaattgatttgttggagttttttatataatgtgaatcgtgatcctttgttggttatattgtcattttgtgggtcccccaccccattgtgaatcattgccttagtagtgtgatcaaagttattatgaatatgtgtgtatttacttggtagaatttgcttctattgtgtttttcctgctatctttgaatttaatctgtaatttctaataggtctaaatggaggctatcaagatgagttggtagatcatcgtttgacagaaagggaatgggctgatgaatggaaacatcttgaccatgtaagaatcttgtagtgtgtaatgtccctaactctttattacttttttttgaaacaggagtctcgctctgtcacccaggatggagtgcagtggtatgatctcagttcactgcaacttctgcttcccaggttcaagcaattctcctgcctctgtcttcggagtagctgggattacaggtgtacgccaccgtgcctggctaatttttgtatttttagtagagacagggttttgccatgttggccaggctggtctcaaacccctgacctcaagtgatctccccacctcagcctctcagagtgctgtgattacaggtgtgagccaccgcactcagcctacttaatgctaccaataattaatggaacatgtatgcttgaagtgaacataaccacagccatgacatcctttgcttttaataaaagctggtttagctactactccctcagctgaggaattacagagtcactccctaatctttgtgatgggatgatcacttcaggtcagaaaccaaataaagtcatgtagtataatggttaacaacaaaggtttgtagccaggtgcagtggcacatgcctgtagtcccagctactcgggaagctaaggcaggaggatctcttaagcccaggagccaagacttcaagtctagtctgggcaacatagcaagatggaattcatttgtatttgttaaatttttatcaaaagaaactttctttttatttttttcaattctgctccttctgtagtaaagagattgctttttagcccacatactcatgtttcgtagttttagaacacaggtcagtaacaaacttctaggtaattcaaccccccaaaattgtttatattccaaaattattttgcactctgaaagatagcagccttcctcatctcatcaaaattcataatttctgttagaaatgtgtgtgtgccttattttatggttcagccacagcaaatttacagtgctgcagaccctagggatacaacaaatgctgctgcaacatgaaatagtagactgttggccagaaggccatgcatctgaggttttgtccaaacactggaagccctggtagttattgtcctctttaggtatgtcagcctcaacaccaatgtccttcctagctgatggagaaacagacagcaataaaggttttaaatgtaaacttgatattcctaaatctgtactttaaggaacctgaattcctcatattgcgttggcctgatttacagtgttggttgtttgaatgttcttatctcatctctgcctggccccctctgtgactcaggcgctgaattgcattatggaaatggtagagaaaacaaggcgctctatggcagttctgcggcgctgtcaggaatcagatcgtgaagaactcaactactggaaaagacggtacaatgaaaacacagagctgaggaaaacggggaccgagttggtctccaggcagcacagccctgggagtgcagattctctcagcaatggtaaggggagagtctacgggaaacccaaaataaatgtcagcctttagagcccaccaatctgtcacagaaggcgttttctacttgactttaaagaaaggtggtactcaattgtggatttagggaaactcaggtgattatgaaaagtaaatgagaaaatatatgaagcccctggcatgttttggtgggtggcgcaggaagggggtttttttgttttggatagacaggatctcactgtgttgcccaggctggccttggactcctggcctcaagcaatcctcctgcctcaccctcccaaagcaccaggattacaggcctgagccactgtgcccagcctcgtacttggcgtgttcaaaaaatgttaattcttcgtggagaatgagaatatttgtgattttgttctgtctttaactctttacatatatgtgtgctaggtgttggtcagagtgtttggttgtcaaattcagcctggctggatgtatgtactaggcactcttgtgtcatcactttcatttctcacagtagccctgaaagtgtttaccttaccttccctcctcctgtccccagcccaccattcaggaaaataccactcaatccaccatggcctggtggcctcctacaaaaggttttaccataccacgctgggttgtttccccttgcctttcagagtctgaagcagcagcaatccagagtacatccagcaaacctcagttattcccctcaaaatgttccagcacattcacccagtaactgagaaagtgccctatccaaaggcatagctgagtgacaggccatctgtgataagactcttcccacgcactctgagttcccaaatgttcaccacgaagaacaagtctcttacgacagacctagtatgttccattgaaggcagctattagtctctaaaagactgtaaggaaaacttgaggcaaagccagaattaatacagtatgtacagacagtgggagttaaaggctcacctttccccaccccacccacagcagcagctctggagccaaccatggaattacaaccattaggtggaatatctagcacaacaaggcgtcaacacatatgtagagttatatagtatgattcctttcgtaaaaactcgaaaaacaggccgggcgtggtggctcatgcctgtgatcccagcactttcggaggctgaggtgggcagatcacagggtcaggagatcgagaccatcctggctaacacggtgaaaccccgtctctactaaaaatacaaaaaattagccaggcgtggtggcggacgcctgtactcccagctactggggaggttgaggcaggagaatggcgtgaaccccggaggcggagcttgcagtgagccgagatcgcgccattgcactctagcctgggtgacagagcaagactccatctcaaaaaaacaaacaaaaaactccaaaaacagacaaagctaatcttctggtctccctcactttctgaacatttgcagatccctgtgcgactttcggacagggagaaaggcttttggagacgtagctaaagtttacacccaagccatacctcattcatcagtgagtccacatgtgtgcaggtgagaagcatagagtacagagggagctgcagtcgtgagccagtggttgctgagccaagatacagctcttgctggagtcattcaggtcttgctggagtcatttaaacatggctatgcatgaccactactcacctttctcaccttttgcatcaaggattagctctggggagcatgttttctgatttgcctgagacagtccagtttatacctgtgtcctgttaatagttattactagcatttccctcattctcaacaatgaaggcaatctggatgataagttatattgtcattctaggtttggtttctgacagcactatcaacctgatttagatagtatattttagtgtcatttatatgtttatctcatgtttattacttgtccattttagtatagtatgacagtataattcatatcctaaataaatgtactatgcaaaatgtgaaccaaaatgactccaaaaagtgccactggtctgattacatgaggagcttgggcacggttggcttcatcaagaaagtcttactgtgaaattagttctttttgtttgtttgtttgttcgtttttgtttgtttgttttgaaatggagtcttgctctgttgtccaggctggaatgcagtgcacattcttggctcattgcaacctcctgggttcaagccattctcttgcctcatcctcctgagtagctgggattacaggcacctgccaccatgcctggctacgttttgtatttttagtagagatggggtttcaccatgttggccaggctgggctcgaactcctgaccttgtatgatccacccaccttggcctcccaaagtgctgggattacagacataagccaccatgcccagcctgaaatgagttcttagacacatagttgttttacattctggcatatgttataccaataatcatagtttgagtagcattgtcctatattgggcagtattcttagacatttcaaagaatttcaccaatgactttttttttttttttttaacagagtctagctctgttgcccaggctggagtgcagtggcatgatctcggctcactgcaacctctgcgtcctggattcaagggattctcctgcctcagcttcctgagtagctgggattacaagcgcctgccaccacacccggctgagttttttttttttcagtagagacggctggtcttcaattcctaaccttgtgatccacccgcctcgtcctcccgaagtgctgggattacaagcatgagccaccgtgcccggcctcaccagtgacttttaaataagtaattagtgtttttgtttgagacggagtcttgtctgtcacccaggctggaatgcagtggcacgatcttgcctcactgctccccaggttcgagcagttctcctgccttagcctcccaagtagctgagattacaggtgtgccctaccacagccagctaatttttgtatttttagtagagatgaggtttcaccatgtttgccaggctggtctcgaactcccagcctcaagtaatctgcccgccttggcctcccaaagtgctgggattacagacataagctaccatgcctggccaagtaattagtgtttttaaagtcttgggttagctgggtgcagtgtctcacgcctgtaatccccgcactttgggaggctgaacgaggtggatcacgtgaagccaggagttcgagaccagcctggccaacatgtcaaaacactgtctctactaaaaacaaaaaaagttagccaggcatggtagcacatgcctgtactcccacctacttgggaggctgaggcacgagaatcactcaaacctgggaggcggaggttgtggtaagccgagatcacacactgcactccagcctgagcaacacagtgagactctgtcgcaaaaaaaaaaataaataaataaataaataaaagtcttgggttatgcagaaatccatggtgtggatagttattgaagtaaagtggtttggtgatttggagagaaattgactagaggctttagatggcattattacttttcccatttaaattaatgcaatgtaggtttccttacctgaaaatttatgattcacaatgttttcacaaatagattttgttcagacagcaagcagtgtatttaggtgtcattaaaggatgcataaataagtgcaaaaaccataaggaaaagaagaaaatgcttatcacagagatcaggagactggtttcctctggctgtgtgggtggagggtgcagagttagtgagttctaactacgtctattcttgggacaggattgtcagtctggctagcattatttaaatactactatggcttgccatgacttacctcttagggatttggggttgctggtactgttctgtttcctgaactcaggcttatgatgttaaattgtatattaatatttttattatattgtatgttaatattttatgaactggtcagccatctaactttgcaagtaaaatttttttttgtttgtttgtttgtttttgtttgaaacggagtctcgctctgtcacctaggctggagtacagtggtgcagtctcggctcactgcaacctccgccttttggcttcaagtgattctcctgcctcagcctcccaagtagctggaattacaggtgcttgccaccatgcacagctaatttttgtatttttagtaaagacggggtttcaccatgttagtcaggtcggtctcgaactcctgacctcgtgatccacccgccttggcctcccaaagtgctgagattacacacatgagccactgcatctggccaaatttttaaacaaagaaaaagaatacttaatcagctatcagtttttcctcagaatgacagtcaagctcacattccgggcccttctggatgttatgattctgagacccaaaaatctgaatatagtccacctgtggtggctgacgccagtaatcccagcactttgagaggcagaggctggcaaatcgcttaaactcaggagttcaagaccagcctgggcaacatggtgaaaccctgtctctacaaaaaatatgaaaattagctgattgtggtggtatgtgcctatagtccggctacttgggaagctgaggtaggaggatggcttgagcccaggaggcagaacttgcagtgagctgagttcgtgccaatgcactccacctgggcaacagagcaagaccctatgtccaaaaaaaaaaaaaaaaaaaaaaaaaagaatctgaatatatgtgtttaatgagttcaataagcaggcaagtttgggaaaactgcctctagttaagtccatagcagatggacctcattcagtgtcacagggcttccaggcaactttttagtgacatgtgtgcacaattaagggtgaccactctctagaggtaagcctctaatattggagactgaaataaacagaaatgggaattaatagtagctcttcagggaaaagaaaactaccaataatgtagcattgttaatatctctggtgagaaaaagagaacaacattagaaatctacccaacttatatatccaaatcatgaatttcaaaaagaatgagcagaacaagtagagaggatagaatagttattgaaataattccaaaaaattaccaagacctgcaagacagttccaggttgaatcagtctaccaagtagacaacacaggaaaataaatagacttagtcgtttagcatcattgaaagttagaagacaattctgaaggaaaattattttaatttagaattctatacttaaccaaaacaattaagtgttagattagtaacctacaatttttcaaaaaatgcacctcctgcctaccctttctccacagtatctactgtaggatatgcctcaatatgtgaaagtaaaccagaaaatgggagacactgaattcctgaaagaggatccaacacaagaaaggaaggaaaggaatccctaggctggtgaaggagagccccaagcattagtggcaaagcaggcctagaaagcgcccagtccacgctggaacagcccagaaccttgctagagatttccttaagtaaatgaaatttataaaagatttacacaacaggaggataatttgagattgaattggaagtaattacatagcagcctggcacaatggcttacaactgtaatcctagctctttgggagactgagacaggaaaattgcttgaggccaggaatccaagacctgtctggaaaccctgagatagtgaaaccctgtctgtgcaaaaaatttagaagggaaattaggcggtcatggtggtacatgcctaaagtcctagctactcaagaggctgaggcaggatgacctgagcccaggagttcaagggtgcagtgagccagtgatcagctgtgtatcactgcactctagcctgggtgacagaacaagaccctgtcacacacaaaaaagtaatttgtaaaaatgctgcctttcctccccctacatttttccataggctcaatggttaacaattaatgtattcttgtagaattttctatgtacatatttaaagataatgtttcctaatgttttattttgaaatttccgaaacacgtagaaattttgaaagagaccaccctggccaacatggtgaaaccccatctctactaaaaatacaaaaagaatagccaggcagggtggcgcacacctgtactcccagctacctctcgggaggctgaggtaggagaatcacttgaacccgggaggcagaggttgcagtgagccaagatcgcaccactgcactccagcctgggtgacagagtgagactccgtctcaaaaaaaaaaaaaaaaaaaaatctgtgtgcatttatgttttatacatttatattttagggggtactgtaccttaaaaaccgatgtttataggggaaaaaattaggacataataggtaagtaaaaagaagaaagtgaagatcacttttaatctcactactttgaaatactgttaatttgttcatttgatgggggtgtgtgttttaaaactaaatatttactgtactattttataatctggtttttagcccttatatgagaatttttttatactaaatgaaatatatgtttgagtctaagtggtgaatgagaaatctgatcaaaaataaaactgctgatcatagacagcttctgaccctatgctttttatgtctcttctgcagattctcagagagagttcaacagcaggccaggtacaggatacgtacctgtggagttttggaaaaaaacaggtatgtgtctgactgcttgtaggtcatacatactcactaatttgtgggagcagagaacagataactgggtgaatggttggtaactgggtcctttggttgtataataacttgctcctcatagagctctaggctcctgcctctcctgctctggcttgtcctgcatgtctcctgatacctgtcttgttaatttgcaggtcaggagtttggaatagctccctccagtccctttcacactcttccactgggtcacgctgaggcaataagtacctgttgacatgtcctgtttctgggcttgcaacagagttcattttgcctgatctcttcactggtggctacagtatactgtgttcacactactgccacatttgtgcccaaattctgctctgggcacagctctgtaatccccctgtgctttctttcaccttctctgtgcctaccatagtgaagactgttcttggtaggcctcctcttttacaagaataaaggagggtggggactgcctattttgtaagttcaaggatgaacctcacatcactaatgtcagccttatccaaatattggcattctttcacttcttgcctccccatcccagtttcattttttaagtccaatacaacttttggttttcttactaagataaaatttatttctacaaaaatgtaatacctacattcataaagactcttttaagagcatctagacagtagtaaacaaataaaagatatgaacagacacattatgctatgagaaatacaaataaacatattgcaaaatatttttccttactagtagtcaggataatgtaagataaagcatatctgataaattaaccccttgtctttaaccgtccgttattgacaattttaaaagaccttgttgatgacactcaataattgatcagaggcttatataagaaattaagtgagtacctgcagattcttggaatcattcctcacttttccttttttttttttttgagatggagtttcgcgcttgttgcccaggctggagtgcaacggtgtgatctcggctcactgcaacttccgcctccccggttcaagctattctcctgcctcagcctcccaagtagctgggattacaggcatgcaccaccacgcctggctaattttgtatttgtagtagagatgaggtttctccatgttggtcaggctggtctcgaactcctgatctcaggtgatctgcctgccttggcctcccaaagtgctgggattacagacgtgagccactgcacccggccttttttttttttttttttttttttttgagatggattcttgctctgttgctcaggctggagtgcagtggcacaatctcagctcactgcaacctccacctcccaggttcaagcaactcttctgccttagccttccaagtacctgggattacaggcacccccgaccatgcccggctaatttttgtatttttagtagagatggggtttcaccatattggccaggctggtttcgaactcttgacttcaggtgatccacccgccttggcctcccaaagtgctaggattaggattacaggcatgagcctgtaatgtgcccagccacaagatctcttttaaactagtgagtttgattatttgggagatacctttggttaactatggttaagagcccaactttggtgttgggccagctaggtttgagtccttgctctgctacagtgccatctgtgaccttagacgacctccagtaagatagctagccaaaccgagatgattattaattcatgcttaagctgaggggataaaatgtacctaagagcattgttacactggctcaataagaggcatctgataagagacttatgaaaagttcttggcctctggggtgaagattttcttaaggccagagccataagatggaaagttgtttcatggtagcctagaactctgtgtttgaacctcccttgagcctgtgccatgtgcaagaggtaaaccgtgagggagtgtccttaggcttctggattgtctagtcctgtggacttacgtagggagctacgtattttgggacttcacattcacattctcattgggctgaggctcaaacatatggaatgtgttattttgcagcgtctacattagggaaatcaagcagggcattggtgatgggaggaagtgaacaggaaccaggtaggatgatggtaagtggacagggtttaaaaacccagggcttttggcagtctgcccaaatctatgtctttagcccttgtttgtgcacctagtcttatttatttaattgcctcctggccatttacacctggatgccccagaggcacctccaccttctcacttgcctccacactagctttgtgtggactgtccatttcattgcctagctttagcattcttctctttcacctccacttccaggcccttcggtgctcccaacctttttctgcctcatcccttcctcagtgccacttattcctgcctaaattcagcctcttctatcagttcaatcattgcaccagcctcccggttgctatctctgtctttaatcttccccttgcatagaatcctttatggagtttcctttgaaaataaagtcaagccgactgggcacggtggctcatgcctgtaatcccagcactttgggaggccaaggtgggcggatcacgaggtcaagagatcgagaccatcctggctaacatggtgaaaccctgtctctattaaaaatacaaaaaattagccaggtgtggtggcgggcacctgtagtcccagctactcaggaggctgaggcaggagaatggcgtgaacccgggaggcggagcttgcagtgagcagagattacgccactgcactccagcctgggcaacagagcgggactccgtcgcaaaaaaaaaaaaagaaaataagttcaagccgggggtggtgcctcacccctataacactttaacaccaacgctttgggaggctgaggtaggaggatcacttgagcgcaggagttcgagacaagccttagcaacatagtgagacatcgtctctacaaaaaaatttaaaaattagccgagtatggtgggacacgcctgtagtcctagctactcagaaggctgaggtgggaggatcatgattcagagaggtcaagtccgcagtgtgctgtgatcgcaacagtgcactccagcctgggcaacagagcaaggccctgtctcaaaaaaaaagaaaaagaaggtcaaatttcttagtctggcatgcaagactttttgcaaaatctcatttccatctaccatctcaagcaaaacacatgtcttgattctcccctgcccactgaagagctgatcacttttctccttggaactctagtctcttacgatgacatacacgatggcacctgaaacactttcatacttggtcacaagcagtcaggagagtgtggcctgtgtctagtcacttgcgtccacagccctagctcggtgcccacctccatctccgtacccagccagcacctgcatggatggacacatgagtgtgaagatcatgtgttcctccctgtggagttttagaaaagatcactttgtgtcagctctctccttacttagaattgccgtgggatgggagggaaaagatttctcggccagttgattttactgtcactttcttctagaagaagctgtgaataaggtgaaaattcaggccatgtcagaagtacagaaggccgtcgctgaggcagagcagaaagcctttgaagtgattgcaacagagagagcacgaatggagcaaaccatagcggatgtcaagcggcaggccgcagaggatgctttcctcgtcatcaatgagcaagaggagtccacggaggtcagagctctgcgccctgggggctggggtgagcagctggagtgaccacgcccgctgccttcctctcatacgctgggcaggaagacacaggcagtccactcttgagctcaatgaggataatttttatccagtgccaggagagttttggttctcatgctaagactcttttacatgccaagatagtgaattattacattgtatttttacatacatacatatatatatagagagagagagagaggctcagtgtattggtgtaaattttgagaattcaccctaaagacagagtttgtgtgattgcacgatgatgatgatgaccagcattgacggagtgggcttactgtgtgccagacacccagcaaagttgtatattttctttttgagtctcacaatggccctaatttgcagatgaggagactgtggctcagggaatgcaactaatatacccctttggtgctgaagtcaggatacaggagtaagaaagtgcagggtcctatagcacctaggctttttttttttgagacggagtctctctctgtcccccaggctggagtgcagtggtgcaatcttggctcactgcaagctccacctcctgggttcacgccattctcctgcctcagcctcccgagcagctgggactacaggtgcctgccaccacacccggctaattttttgtatttttagtagagacggggtttcaccgtgttagccaggatggtctcgatctcctgaccagcacctaggctttttacaaataggatagctggtttgtggactgaagtaacaggttgggtgtatctgcctgattgtccaggacccaggatccagggcccaggacttggtgatggttctatacaggacgcttgagtactacagtgaggagaaaaatcaacaaactgaaaaagaatctgtgacaacatgagaacagcccttttgaatttaatgcagtttttctgtaaatttcattttagtcatttttcagctttaaaacaagaaaccagtttctttctgtaagtaggtagatctcatctactggatgggagaccggctgtctttgggacattctcttgaagttcagcactcactctgtcaccgaggctggagtgcaatggtgcggtctcggctcaccgcaacctctacctccgggttcaagcgattctcccacctcagcctcccaagtagcttggagtacaggtgcacaccaccgtgcctggctaattttcatatttttaatagagatgggctttcgccatgttggccaggctaatcttgaactcctagcctcaagtgatccacccaaccttggcctcccaaagtgctgggattacagatgggctttttttttttttttaacaaacaatagaaatgttattttcttgtaatttaaatggtccatttcagtattgtactgtcacacatggcaatgtgcagatgaaaatgcctaaataccacgtggctatcacagaggatgtggtgaaattccttattacagctcttcaatacagatactatggattgtgagaaaatagtttctttaatccccctcccttttcgttctctcctcctcctttgtcttttttttttttgtgtgtgtgtgtgtgtgtgtgtgtgtgtgtgtgtgtgtgtgtgtgtggataacagggtctcactatattgcccaggcaggtcttgaactcctgggctcaagctatatatactcttgcttctgcctccctaagagctgggattacaggcatgagccaccacgcccagcttctcctcctcctttttctttagaattgtttttgaggctgggcacagtggccaatgcttgtaatctcagcactttgggaggccaaggtagtgtgaacacttgagctcaggagttcaagaccagccttggctagatggtgagaccccatttctgccaaaaaaaaaatttaaaaattagccaggcatggtgtcatgcacctgtagtccaggtactttggaggctggggcaggaggatcgcttgagcccaggaggtgcaagcctgaccatgatcgtaacactgcattccagcctgggtgggagagcaagaccccatctctttaaaaaaaaaaagaaaaaagaaaaaaggtgatgacgatggcaagatgagggggaaagaaaagagaattgtttttgagagtgagatatctgtttctcttctctatgtttaactgtgtatgtatagccatccatatcagtatctgtatttgtccttatttatctacttttatctctgtttatctttaactatgtctatctccaaagaaagagtatagcttttggcttagagcatagatcctggatctggactgcgtaggtttaaatcccagctctccattttgagcattgtgcttttaaggaattgtaattttaaataagccacaaagtagcctccaggtgaggtgcacacctggacctatccctgcaaaatcactttcaaaagcagggaagggatagagggcctgtcctttggatgagtttgcattggaccaaaacggctgattctcgtccatcaagaatgttcagctagaatatccttgttgaaatttggcaggtattcctggagtttcttgttcatcttgtgaaaggtggtctggtgtgggggaggaaggaggccaggactggaggttaggagccctgacttctagccgagttccctctcatactggcagtatacccttaaaggagtcagtctccatctctgttcaatgagtatagcagctcctatcctattggtctgatagttattagggaacaggcacagtggcccatgcctgtaattccagctctttaggaggtcaaggtgggagggtcctttgaggccaggaggtcaagaccagcctgggcaatataaggagactctgtctctacaagaaattaaagaatcagccaggcatggtggcacatgcctgtagtcccagctactcaggaggctaaggtgggagtgtgggaggatccctggagcctaggaggtcaagtccagcttgggcaacatagcaagaccctgtctccaaaagaaaaaacaaaacagcagcagcagccttcgttgagtcagattatcagtaaaaacaatgaagattattctctaatgagggaagcaatatcagctgggcgcttataatcctgacactttgggaggctgagacaggcagatcacttgagcccaggagttcaagcgtagcctggccaacatggcaaaacctcatctctactatatatatatatatatatatatatatatatatatatatatatatatatatatatatatatatagtatataatgtgtgtgtgtgtgtgtgtgtgtgtgtgtgtgtgtatataatgtataattacaaaaattagccaggcatggtggcacatgcagaaaggagtaggataaatgttcgtcttaacacatgtggtcttaggatagatggctcttgggggagaccctggcacagagtttggtttggtttctgactattaaaatgagccaaaagatgagtccatgccttaggcaggagagatggccacctgccctaggctggtgctgtgtaaggtattttcacacacacatctcatttcactgttcctgtcatcttgcagggaagtagttttcttgttttacagatgaaggaaactcagaaaggcagtgtgtatttctcatagttaaacagcagtagagggcggagttgaccacaggtgtatgtagttccaaagctggggttctctacatacagccccttgctttactgtgcagggaatgaatggcaagcctgcccctcaatcccagcaaccactaactgatgcctgtgtcttgcagaactgctggaactgtggccgcaaagccagcgagacatgcagtggctgcaatatcgcgcgatactgtggctctttctgccagcacaaggactgggagcggcaccaccgcctctgtggtcagaacctgcatggccagagcccccacggccagggccggccgctgcttcctgtaggcaggggctcctctgccaggtccgccgactgcagcgtgcccagcccagccctcgacaagacctcggcaaccacatcgcgttcctcaacacctgcttctgtgacagctatcgacaccaacggactctgagccccggactctgcttaccctgatggctgctcagcaccacagagtgcttgggctgagggactgactgttggaacccgtgcatgtagctgccgggtcatcagcaagaaatgaattggaggcaggaagagtccaagcctgaataataacaccccacagcctctctgtgcacttgctgtctgcggagccagtgtgccattctctgcacatgggcagccagcctgagctgcctcctccatggctttcctggtttgttcctctctccactgaagctgacttagccggccccttttcagtgtagaccaccagctcccctccccatctccttgagtcagcagactgtccaatgtgctcagccaggctggaggcggcaggcggcaggcagcaggctgtggaggaggcccctcggtcagggagcggcctgcctcacccctgaatagctccttcggccccatctccatcctcagcagatgacactgattggcctcacggggacttgggtaagcaacaggcggcattcaggactcttctcaaccctgctgttcagacttgataagatctcagagtccacaggaaagaagtcactgttgcaataaaagcacccgtagtagcaaaaacataaacaaataaaacttcccccacatcacagatgattttggacaagattttccaaccttgctggctactttagtttgggacctgttttttttctcatttgattttgcttgtgcagaaaatagtttccagcacatggattgatctgagagagaatgaggctcagttgtggatagtctgttttctctgagcatgttggccaactagtatcgtcaaattattgagtggatcatctcttggaaatgcagaacttctgccaccacttggctatttgcacagtcatcttgttctgtgtccttttatctctcagaccacacacatctggaacgctgtgggcatcttctgcccatgggctccatttggcacctgctgagccacagttgtcctgctggatgtgctgtgcaggttggtaggacttgcccccactgtcaaggcctggtctcatctgaaaagccctcctggacctcaaagaattcttcagacctcatagttacaggtcattatatctactatgttgatttatcatcaggcacacaacttctgtttccttctcttgtgttatctgatagcgtccctccttgagctcatcagaaaggttttatgaaatgtgaaccattttgggaaaagctgatcaatttttcttcctagcttcccattttcaaatgggacatcactcatatccctttcagaatgttaggaactgcctcccacattcttccctgtctttttgggttttgttttttgttgttgtggtggttttttaacacaaagtctcactctgttgcccaggctggagtgcagtggcatgatcttggctcactgcaacctctgccttccaggttcaagcaattctcctgcctcagcctcccgagtagctgagattacaggcgcccaccaccacgcccagctaatttttgtatttttagtagagacagggtttcaccatgttggccaggctgatctcgaactcctgacctcaggtgacctgccttggcctcccaaagtgcagggattacaagcgtgagccaccatgcccggcctgtctttttggttttgatgggagtctgaggaccccgacccctcctgctctccatctttgagcctctggcatcctctcacacccagaaatcagttggagtaagtttaattggccctgctccagctggcctttgaagcacaagtttaaatctccaccttctgtgcactgaccagagtctaaaataaaagttgtcagtaccataaaggaaaagggatccacacaggtagccttctccttggatacaggtacatcttactgtaagaatttcaagtcctggctgggcgcagtggctcactcctgtaatcccagcactttgagagaccgaggcaggcagatcacttgaggtcaggaattcaagaccaacctggccaacatggtgaaaccctgtctctaataaaaaaaaaatagaaaaatcagccgggtgtggtggcacacacctgtaatcctagctactcaggaggctgaggcaagagaatctcttgaacctgtgagccagaggttgcagtgagccgagattccaccactgcactccagcctgggcaacagagcaaaactctgtctcaaaaaaaaaaaaaaaaaggcaaaattaaagaatttcaagtccctaatttactctaaccaagcattttcagtcttacaaagaaatctagtgcacgacacctttaaaatgcctagatttccattgcctaaagtaaggtgtgaccagtgaaacaacagcagagaatcatgttcctttgctgtggaacacataagccccacagttttccagtcagcctaatacatgggtatcccccgaccccatctgcctccttaagccacagtccttggtggggaactctaagggggacggagtcagtaccccggacagggccacatttgcatgagacatggctgtctcacaggtcacagagccattacaacagcttactagtttttcatggatttgttggattaacaccttaagcaggttttttattgttattttgtttgtttgtttgttttgagacgggagtttctctcttgtctcccaggctggagtgcaatcgcgcaatctcggctcacggtaacctctgcctcccaggttcaagcgagtctcctgcctcagccttctgagtagctgggattacaggcatgcgccaccacgcccaactaattttgtatttttagtagagacggggtttctccttgttggtcaggctggtctcaaaccccggacctcaggtgatccccccaccttggcctcccaaagtgccaggattacaggcatgagccactgtgtccggtcttgagcaggtttttaaaatctccagtggccataaaactagccagggtagctcatgcttttactggttggaataaggagccaaaaccaacaaaataatatttattagggctcgatgcccatttctgtggctaaggcttaggtttggtgtgcagagcctggcctgctcttgtgggctgtggttgctgtgacagtttcgttttctgaatctttgtaatgctcttccaccctgctcgtgctgcccagaggctgatctgcaaacctgggcagtattccacactgaagctcagtttgcaaaccttctgctgtgttaattctggtcagtttcacacagaagtcacgagggcctctgcccaggaccttctattcacatttcaagaatccctttctgaaattctccaactctctggtcaggaggaggagcaccattggggcggggtaggcagctagaggcgcaggagcgaatccaggttccttgcgtggttcccagcctctgctgacagcacctcagctaccaggtggggagtggaaattcagcctgcttagaggactgacctctacagttcatatttgcagtgacataaaaggcaaagaggagctggcatggtggtacagaaggtatcagtcaagcgcaggctcttcagaaacctagaaactaaaaagagatgcaacatgtgactggccatcagccagacatgtctagggtgagaccagtgctcagcaccacccgccaaggaacactgatgagttgtgggacattatggtcggccaagtgaggaatgattgcagggaccagagaagaccaaagatgccagatgtccccagagtttcttgagggctgggtttcacgtctttgcttgtcctttttgtccccacttgcctgcaccgtgcctgactcatccagtggggaaggtgactcaagaagttgtttaagcctaggcctaggcagtccacttcgggaggtgggggcactccacactggggggccctgcagctccagggctggtgctctagcagatccgctcaggcacggttgggtgaccgtggggtcaccgattgcgtagattatttctagggcagtgctgggttagaaatgtctgtctggaaacaggacacatcttgccaccacaagtccacacctggccttggctgctgcccgctctctgcagcgtggatttcctttgcccatttgggccagaaggtcaccaggagttcatcactgcttagtgtcaacttgacatcttcagcttccagacagaaaacccatgctttactttgtacagccctgtcccagagttagtaagcctcggcttgtcacctgcttgcaaagggtatagacatcattctgggtagttctagaggatatcgcaacaagtgcgtttgaaggttcagcacagctggaattgtacggtagtgagctcttcaaaatgaaaacagaatgaccggatggccatctgtcctggaaactgtagaattgaataaatcactgaaaatagaacacttcttggaggctttcttcagaactgaactagaaacaaggtttccaggctcccaggtcagtagaccaaaccaacttccttagatttttttttttaagctgtttgcagaaaactgggtggtagcgtgtctgaaccaaacggaagaatagccagcggagcatggactgttccagcacgggccagatggccagctgtcgagagcagccctgcccagattgcggtgggggctgtgccagcggctccgcagggcccttccaactctggagtgtctgtagttcttgtgaaaccaaaacgttgactacctgcctctttcctcgggcatcgacgtgctcatttccaaagatgatggtgcaggtgaccttttccatcgtgagctaagagaaggttaggaggcctgaggggcgggccttgtgtcccctcctccccctccacagcccctgaggtggagcttccctcacagaccccatctggtcgagcctacggctgcccagtgtacactcagtgatgcttataccaaatagggcatgtgcgctggtgtctgttggggacagccccatccctaccttggagtcggcagagaagcagcaataagcattaggcgaatgattgaaagggctgctgcgccaagaggccttcagtccccttaacgtggctttccaacttcctgacgaggctacaaaggctccgctcacaaaagaaagccaataatgtaaataaatagaaaacgaagcctccacgcgtggtttttaaagggggatgatgaatgtgacaccacccacagaatgcattagaatctggtttttctgtgctttgtcattttactctgataggaatttttgttacctaactctgtgcataacttatttaatgtactgtataaatgaaccaaaactgttaaatatgtatttagtttgttctacttaaagtagtcaataaaaaggctatattccttttctgcctcaagctggaatgggaccgggaggaaaggtggtccctacactaggaggtgtcccctcaccctaattcccaaatccttgaggaagagggagagaggggcctcaactggttctagtcgtggcctgaagagcatccaagggcatgaagcagggggtgtctgcaccccatgtgcctggaactggcctctctggaaagccagctgcaccaactggtcagtgccctgtggggaccaggcccaaccaggctggctgctggagcccaccagtgggcctgcggtcaagggccaacaacagcttccagacactccccgttatttcttttaagtggtgtttcgttttgttttgtggggagggggcagggtctctgttgcccaggctggaatgcagtggcacgatcacagctcagtgcagcctccacctcccagactcaggcaatcctcccacctcagcctcctaagtaactggaactacaggcatgggctaccacgcctggctgattttttgtattttctatagagacagggtttcaccatgttgcccaggctggcctcaaactcccgggctcaagcgatctgcctgcctcgcccccgccaaagtcctgggactacaagcatgagccactgcacccggccaaattatcttgtaataaggaaaaatgaaccacagagaatctgaccatctgtcctgcctgaacagggtggtggacttgtggatatattttctagtaacatgtattttcttgtaaaattttaacacaaatgttaacaaacatacctggacttgtcaaatattcacttatgtccttatgacactgatgttaaatcacaggtaattttactgttgccttccaatttaatttatttgctaaatggttgcatcatttaattgaggccataattttttttaacccttcaccttctgttgggcaattggatcgctttcgcgttttccagtgtggcatacatcttctatgcatactctttcttcgcattatttatttccctaggataattttccaaagtgggggtttttgatactgaacatttcttggatccttgaaatctgtacaaactactctccctaaaagcccaacagcttgtgttgcctccagcagcccctgggtggtactttccgtggccctaaggctggtgcaggcacacctgtgtgtggaatttcaggctgccagtccggtttaccagctggtgagctgaggcctcacttctgtcactcagatacccatctgtgctctctccctgagacccgcctctcctgaacagccttgcccaagaggctcgttgggaccactagcttcacaatcccctagaatgcaaggggagagggactggttactagatctggagacgaggagaagggctagcctatggcgtaggggttggctgtatgatctttggtgcaggtggtgccaactgcaaacctttctgggctgcactgcaatctgcccacctagaacaatgacaagatctcagtcatgggactgtcagccctccacaagagcactatgttggtggaaacggaatgtgccatagaaatggcaggctgaaaatcttttcgtgaccacaaaacacccagatgccagataaattataatgaatgtacttttaactgtattgctgaggtcacagataggacatttccaagaactcaagagttggagggagattgcctctaggcgcaatgtgaggcttggttttgagcatatacaaagtacggaaacaaaaccggggcctttccacaatggcaggtagctcagcacctttggcaccgtgaaaaggcggcagggaaaatctgcccatctgcaatggaaactgaattggaaacagctctgtccctgcttgagaaaaagaaagaaaaactgggccgggcgtggcggctcacacctgtaatcccagcactttcggaggctgagatcacttgattccaggagtttgagaccaacctgggcaacatagtgagacgcccgtctcaaaaattaaa

SEQ ID NO: 12457 - DNA, 6819 bp, Human
tgtataaacaattcagattttaaaaacctattcgcctgcccctaatgtgtgagactatatatttatactgatagcttcaagtcatcaatagtcgttgcagagagctagcctggctctcctcggtccatctctttgcccctctttgtcgctctcctctccttcacctggcaaggcgatcctagagtcaagttcaagttcaaacgctccaggaaagatttctacactctgtcaaatattccctgcatttccctaccctagagagagctgagggcaaatgatctttttattcacattgtcccagaaccagcccaccccctgcccccaaccaaaagacaacttgtacagggagaaaacctttgcaaatgtgggtgagccggaggggttatgtgaaacattcccccggccccaaaacgcccctgctaagggtagcgtggcctgggagactaaggtggaatgatgcctgagtgatgaagtcagcctctgccagccacctgttgcagcacttcagccatcgagctggacgcatttgttctgctgtacgaactggcgggagccaggctggcccagctatctctgccagctctgtcctggactgactccacataggtccccttgcaccttgctcagcttgggagcctgtggactttcaggaaaagaacaagtgaacacctaagcctgtgtgacgactcagtttcatcattgtaaaatggggtaaccatatgccaaactcatacgggttttattactcagtgagctgctcacaagccgcgagtacagtgacgggcacacagcgggcactcagtctctgaccactggggcccgtatccacagacgtacttatcccctgaccaggaactgcgatgaccttcgagttaggaaataatgagactgcaaaattgttgtgttttcttgtgtggaagagcaggatgttttagtcttgtttggaatggaacatgatcattcagggtgctcctttgtcgtttttactttgaatggacgattgtgctaacttagcattctgcttccaggagctcgctcttcaatacacaatctattaaatacaatagcaaggattccctacattataatgcaaagctttagggccggatcctccaacacacgcattgtggtattaaaacaaaatcacatcacgcatggaactctcgagatagtggaaaataccagctacaacatccagtgatgtgtgacccggaggcacggagctgactagaataccgacgggccagaatttcaaaacgcggattttgaatctttttttctacttagcctaataagtttgggtcttttacttaacgtctatctaggcggctcagcttcaagttctgcaaattggagataatatcattaagttacagatgttatttgaaaaggcaacgaaccattgtaaccatttttgtaaaccatgaaggtatattataagaaaaggaggaggaaaatgagaggtaacttgtgcattgttggatgttgtttgcctgttctgctttttctcttgtccagcaaggcttgggtagacaatcatacatcatgaatggttaacttgaaaactgagttctactggaaagactggcaggcaagcagaggtcggaatcccgtcgtttctaagtgtctggtaatctttgccactgctaagattacctgggggtagaagcaccgtcggtaggaacaagatgtgccccttcactccccgaaagctcacttatcctgcgcagacatgttgaagggccgtcgggcttcagagcccaaatctcggctctgcagagacgtccccttcccccgcctccaccaaccgctcttcggcatgcagaaaagcggtccccaccccttccacgcccctgccccacctcttggccccctttacaaccccctcttctttgcccggggtggtttgttccaaggagtacagatagccttttcaaaaggcgcagcttaccgcggtgcgcgcggattctggacttgggcgccaactcgtagtccacgctccccggggtcagcagaggggcgctcacgctctcgccacccacctcgctttctcaccccgcgcttcccggcctgggtttttagtcttccttggagcgctctctggcctccgcctccgccagggagcggaaggcggagacagcgagactggccaggggggaggaaagaggacgcgtgtgggcaagggggacaacgggatgtccacgggctcggtgagtgatccggaggagatggagcttcgggggctgcagcgggagtacccggtccccgcctccaagaggccgcccctccgcggcgtagagcgcagctacgcctcgcccagtgacaactcgtcggcagaggaggaggaccccgacggcgaggaggagcgctgcgctctgggcacagccggcagcgcggaaggctgcaagaggaagcggccccgtgtggctgggggcggcggcgcaggtggtagcgcgggcggtggtggcaagaagcccctcccggccaagggctcagccgcagagtgcaagcagtcgcagcggaacgcggccaacgcccgtgagcgtgcccggatgcgcgtgctgagcaaagccttctccaggctcaagaccagcctgccctgggtgccccccgacactaagctctccaagctggacacgctccggctggcttccagttacatcgctcacctgcggcagctgttgcaggaggaccgctatgagaacggctacgtgcacccagtgaacctggtaggggcgcggcgcgcaaggattcgggagagcagccaggagatacccagggcgctcctgggcgccgggcagggtcagcccgttgggaagaattcgaaaggggtggaggttctgggactgggaacgagaaggccagtttagtttctcccaaatcaagggagtggccagccatttccctgaagaagaatcaaccctccgtgtctgtttgcatcgttctgaacattgtaccccagtgacagccattgactaatatcctacttccagggtaaatcttggttccatctccatctgccaccaggttgcagactgacggcaaatctcccttgcccaacttaatccagctgagtcgggcaggtttgaatcggcaagccctttcttaaaggagggaaggccgagctctataaaagagcatttgcatttttagaaaaattgcttgtggaagatagtaacgtttccccagatgggatttatctggaaagtccctctctgatctgccagctctcccggcttgggaaaaatcctgtccaagcccagttcctacttggagcttggagtggatgactgtgtgtgtgtgtgtgtgtgtgtgtgtgtgtgtgtgtgtgtgtgtgtgtgtgtgtttggggaagggaactaaacgacagaacctcaaagtcagatgagtttcaccaaattatcctgcgggcaaagtccaggaagaagcgtgaacggatatggcaagtctcggattatcaacctccagtaaaatgaaaatcttagttcagagagaggacatgcaaattcccagaatgctgataaaatcttagctactccaagtcaggaatatctggggttcgcgtaggagagcggtttcggtttgagacaatcgtttctctctaatatctcacgttctttttgatttacagacatggccattcgtggtctcgggaagaccggactctgacaccaaagaagtttccgcagccaacagactatgtggaaccaccgcttaaatcggactggaactcacttgatgggattattcgttaaatgcgagtgtttgggggccacggagagaagggagagctcgtgagatgggaagaagtttccgctggattctccttgacccttcccctttccctggaactgtgatcgtgacaggtggcgggtgtggctgtcactgcacagcgcccacggctacagctgcgccggatctgggcgaccacgttttgcctctccaaaaagagcttcctttcgtgacgagacgcggacgcaggtccaccctcgggccctagctctgtagactaactctcggctgctgccccagcccgcgccagacagcccacggatccgttctcagcggagccagattcatcgcacacgtgcgggacggttccacacagccccggcctttcgcggtgacacaatggttagggaacggttagaacgcgctctacatccgctttaaagacagaggtctagacgtgagatccgcgtcgggacagggttttaagtgacaaagaagggcgagtggcttctctgggccgggttcgtactccagcacagcgcccttctaacgggcgggaggaaggccgctgctcgcagggctaggtggagacacacttcccagatcaccgcaggcgggttttacccggagagctctgggccgttcggcctccctgccgggtggcttcttcaatcccgtctccttcccaagctcccggctttttctaatcaggcaggcgtctgtcaaccctctccacttctgggctgaagcctccccaagccccgctgcgccaacctgtgtggggtcttcttcgggcctccctctccgccccgctcctgctcctacctgcagcacccccagctccgactccagactctctgcatcaggtctccccactccacgctccgggcgccccaactccaacaccacgtcctgccgcgcaggttcttccccgcgcggaggagcgcgcagggtgggcggcttaccatagcaagtgatcctgcgatagggaacgcgcccttgccccgaggctgcactaccacaggaaataacatatgtaaataaatttatttttttatgaataataaaacgcgctgtaaaaaccgtgtgccccttggaggtgtcaggatgtggtctttgttgccctttactaagagggtttggctgtagaagttaacttttaagggctgatctcctctggtcagggcggtgggtcattgcgggaggaatggtggcgatcacttttggatcactccatttccaaacgtcattctttattaatctctatgattctgctgcttctccgcgccgggcttcctggaaggccataactggaggcctaataaaagtcctgagtcttgaggcccctgctgtcctgacagacatacactcctcaggctaacatgggtgcacgtctctcatacacacacacacacacacacacacacaacacacacagcagctactccagctaaaagcacactccaatccttaccattgcaagtagttcaaaaaaaaaccctaaggcccacccacaagtctccagtgtaactggcagaataaaaccctaatataagaagccaatttgtatttcaacggtgcttttcttttatcaaatgtttatatatctttttaaacgtacactcattttccgtgttattttcttccacttgtactgcaatttttgtagaaggtaacaacttggaaaccctataatacaatttttaaaacggctggttcttttaaaagcaacgttctctttgtagaacatttagaaaagtgtaaaggataaaactacacaaacaactgcccaacttggggttctgtccattttgtgcaattgaaaggcagttttcctgaccctgagagaaaaatacagctggattttagttaggaggtaaggggggttggggtggggagagtgacttcctgttttgagttaaaccaaccaaaatgctaaagaactgctttctgacaagattgtcttgggcttttattcataacctgggacggaacccgccctggggatccagtctaacatcagtggtgtctgtggcattaggggctttctgacaagagggaacctgaagtaacctgtggcaggaaaccctaccaagcacttcagcggtgagtcctgggtagaaagcttcttgaggaagagtgtctgctgaaggccagatcttagtcaaggtgacttccaaaaagtccagcaaattaggctcttttcaaggaaaggaggcagctcagtgtaagttggttaaagggaacctgagtgtctaaagaacccagcttgaaattcaagctttgccacaggattagtgagcatgtgcaagttacattatgaacacctctgagcctcagtttcctcttccgtagaatgggggtcatcacagtgcctacctggaatattgccttaggaataaatatgataatgtatttaaacaaatcatttaatatgcaatgagcagtgcactaaatgctggtcactaaaggaaatccagaggcagagggaaccacttccgcaaagggggatactttaaacaggtgtgacattcgcagagtccagtctttaaggttggatcttgttttgagatgcctggattacaaccgtgaaagagaaatgtcccacaagagtggacaaacagaaatacagaaaaacagaaagaatagctatatttgcagtgaatacaaataagaacaagcatttgaataaacaaggaaatatttgggcaaatttccacaagtgaaagaataatatttaaaatatgtgtttctataattatattccttctggccaactcaggagtaaactcacagattttctgtctctaacccccaattaaggtgatgcttgtcactgactcacatgtacagggagtgttgcactgcaccctggaaattcattttaatgaccactttatagtcctatagtttatgaagaaaaaaaaactttctcaagaatgctctgctccacagtttctgtaaaaaatccaatgccaggcattacgttatttaagaaaagaagaagaaaaagaaagaggccactttctagtaagccccaatgagtccatgtaaattatgcaagcttctgtgcatgtgttgctgttg

SEQ ID NO: 12458 - DNA, 49818 bp, Human
aggagaaggggttgaggggttcttgcccctgccccagaaaaatcacagaaggggtagagacaaggagagaaggggttggggtactcgccccttcctcagaaaagcgggacttgccgctaagggtgaaggaccaaggcaggcgtccctgcgtggtctgacacctttgaaacgtgggtgaataatcagaggcgtccctgcaatgattaaacaccaagggaaggctgccttcccagcccgtgaccggcgccggagttttgggtccacggataaaacgtgtctcccttgtctctaccagaaaatgaaaggaactgaaattaagagaagggagagattgaagtgcggcgccaagattgaaaggagaaagaggttgagggatagtgagggaagctggagaagacagtaaaaagaggccgcttactggatttgaaattggtgagatgttttttgggctggtcggtctgaggacctgaggtcgtaggtggatctttctcatggagcaaagagcaggaggacagggggattgatctcccaagggaggtcccccgatccgagtcacggcaccaaatttcatgtgcgtccgtgtgaagagaccaccaaacaggctttgtgtgagcaacacggctgtttatttcacctggatgcaggcgggctgagtccgaaaagagagtcagcgaagggagatggattatcattagttcttacaggttttgggtcaggcggtgaagttaagagcaatgttttgcgggcaggggtggatctcacaaagtacattctcaagggtggggagaattacaaagaaacttcttaagggtgggggagattacaaagtacattgatcagttagggtggggcaggaacaaatcacaatggtggaatgtcatccttaaggctatttttacttcttttgtggatcttcagttacttcaggccatctgggtgtatatgtgcaagtcacgggatgcgatggcttggcttgggctcagaggcctgacagctagattttgtatttttagtagagacggggttttaccatgttggccaggttggtcttgaactcctgacctctagcgatccgtccacctgggcctgccaaagtgctgggattatagatgtgagccacctcgcctggcctactccaatttttttgtattgtagtaaaataaacataaaattactatcttaaccatctgtaagtgtatagatcagtggcattcagcacattaacactgtcgtggaaccatcaccaccatccatctccataactcttttcatcttgcaaaactgaaccgcccaatcacacttagtttttatgaggtctaaacaatttcttgttactcttatcactccgacattgtaagccctgtgtatggggcacccatgtattagttataacatacacatagggtatctactattaggcattgctctaagtgctttgcaaatgttaactggcataattatctttgtatgttctgcaggatctagccagtgctttgcacgtgagaggtaaaatatttgaggaatgaacttcggtaccacctaaacatttcccattgactctggctgttattctggttggcaagttaggaaaggagcaggttaccttggggaaaacgactttcggggcgtaatctgatattaggtcgtaagtttaaagaagtcctttattttagccacatttaggccaagttgctaataagggaagctaacagggaagttattcctaaatgatagagaatataggaagtgactcaaggcagttaaggtcttggctttctagtagcaccgcgttcaactccaggaagactcaggccaccggagacccagggttgggacagcctgggatctgtcagcacggtagcgggcgggggcggggcttcgggccggggcggggccgggctgggcgggctgggccggcctgggcggggcgcgcgactgctccgggcggcgatggcggcggacggggactggcaggatttctatgagttccaggagccggcccggagcctcctggaccaggagaactgtaacgcgagccccgagcctggggcggaggcgggggccgaggcgggtgggggcgccgacggtttcccggccccggcctgcagcttggaggagaagctgagcctgtgcttccgcccctcggatccgggcgccgagcccccgaggacggccgtgcggcccatcacggagcgcagcctcctgcagggggacgagtgagtgcggggccccggccgggagtgggcgggagcctcccctacccctcgcccgaccggcagccctacggccgcagctcctccctgcgccctccttccgcccggacgcgggagtccccgccctctcgcctccttcctccggccgtcggcctcggctcgcccagcaatttaaatcccctgccccccgccgccacgagccctgaaaacctccgcctcggtacctcccgccctccttcctgcaaaccaaaccctcgtttgtattagaagggaatcgcccatgcagagcccatagttagagacggcacctcctggggcacgtgtgtcgccattcattcactcaagtcgcatttattaagcacctgctgagtgccaggcgctgcttcgcacagggaacaccaaaacgactgggcactgtccctcccacttaggacacaacgtaggatgggagatagatttgtaaacaaatacatgtatggatgtaattagcgctgcaatggttatatgtaccaaatgtgagagacttaaaagcgtgtgtcttggggagagtaaggaacgactttataaagaaatgtgcaaacgagatctgactgatgagtgggagtgtgcctggcaggtggaaaaaagtctaacgttctaggtggagtatattgcctgtgcataagtaccaacgtgcgaggcagcatttagggcacaggaatctgtgggacccacccgggagccctggtagagtgcgagccgccacagagacgaaaacgaagggccctgcttactgatggtaacgatcgcatggtctggtggggagaccaaggcatacacaagtaatattaataattacagaatcacctaagagcaatgataggaggttcacggggttttatcacagctgggagaggtgaggcgcagagttcctgagggcactttttaaaccacctgagccgcaattataatttggttaagtaagagttgtaattaggtaccatggttttacccccaaaagatggtaaataggaatggtgagagtaaagggacttgagcatgttgtgtatatagggggagaggagcctccggagaggctgaaggtaaaatgagtggaataagattgggcgcggtggctcacacctgtgatcccagcactttgagaggctgtggtgggaggatggcttgcttccagcagttcgagaccagactgggcaatatcgtgaaatctggtctttacaaaaaaattaaaaaaaaattagtgaagtccggtggcgcatgcccgtggtcccacggacccagctgcccggaggctgagatggcaggattgcttgagtcctggaggcgaaggttgcagtgagccatcatcgcacaactgcactccagcctgggtgtcagagcgagactttgtctcaaaaatgaggacatgggaaggaatggattttcagagcattgatgggatggagagactcttagaggttagggaagaatttttgagagacaggacaggagtcacgggcacggaaaggagtttccagcctgattgtctcctttcctttgtgaaacaaacagatttatcaggaataaggtaggaagcttgtaaagacagccttgggagtggggcctgtaaacatggctgagcagtggtgcaggcccacctgtgtttggagaccatctccttttattggttcctcagtacagtgttctgcccaggtgtagagaagggaaacacttataattggattttatacacacatgcatgccgtcagtagcaaaagatgacatttttggaagcttgttcccaaagagaagataattttatgtatatgtagatttagatactctgaatcactaaacccaggacacattctggatttaaaaattagtgtagatgtattatgtatttgggtttttcaagagtagctgacttaaatcaattagaggattgtacgtagatcgttaagagtttttgtttcacttagaccgtcaggagagtaggttattttagcctttgcttaaaaatattttgttgctcttgttaatggtatttagtagatgatatgttggtggtaatgcatgtctcttgacttgggaatgcatatgaaatctctttttttccgggagttgggagctggtcatcactggcattgtcccttttatattgcaaaaacatactcatcattgcttgatagtctgttccagttcccttttcactagatataattgataattgttttactcagatattgctgtgctttaggtcaaggggtccccaacccctggtccacagaccggtactggaactgggccacactacaggaggtgagtggctgagtgagtgagcaaagcctcatctgtatttacagctcctccccattgcttgcattaccacctgagccacctcctgtcagatcagccacggcattagattctcataggagcgtgaaccctattgtgaactgcacaagtgagggttctagtttgcagacaccttatgagaatctaatgcttgatgatctgtcactgtttcccctctcccccagataggaccatctagttgcaggaaaacaagctcagggctcccattgattctacgttatggtgagttgtaaaattatttcatgatatatgacagtgtaataatagaaataaagtacaccgtaaatgtaatgtgcttgaatcaccccaaagccctccccgacccttggcacttcatttaacttctctgagcctcagcttttgttttggttaaatatggattgtatttacgtactgaggttttacttataagagtattctgcaggattcgatgttggcaggactttgacctccttgcaaaagagctgtcctgaccgttgtttacgactggttgtaatacttggtgataaagatgaaggcagttcatatgtcttgactgcagaattctagaaatctttcactagagttgcctctgtgtccttccaactaccattgttttgaccttggtggagactgttagttggctttcattttcttggaagatcaaactcactgacaggcacttctaagtgaaatattccatcccatttgcctttttcttatagccttgtttaagaaggagcaaatcagcagacaaagcaaactcctcaaattctggactgtcttcacctgctagtgtatcctgcttaaattcctgccaggattaggtctatagtcagtgatatggtttggctgtgtccccacccaaatctcaacttgaattgtatctcccagaattcccacgtgttgtgggagggatccagggggaggtaattgaatcatgggggctggtctttcctatgctattctcatgatagtgaataagtcttacaagatctgatgggcttatcaggggtttccgcttttgctccttcctcattttcccttgctgccgccatgcaagaagtgccttttgcctcctgccatgattctgaggcctccccagccatgtggaactgtaagtccaattaaacctcgttttcttcccagtctcgggtatgtctttatcagctgcatgaaaataacctaatatagtaagttagtaccagtagagtggggcgttgctgaaaagatacctgaaaatgtggaaatgactttggaactggggaacaggtagagattggaatagtttgaagggctcagaagacaggaaaatgtgggaaagtttggaacttcctagagacttgttgaatggctttcccaaaatgctgacagcaatatggacaataaaatccaggctgaggtggtctcagatggagatgaggaagttgttgggaactggagcaaagatgacccttgttatgttttggcaaagagaactggtggcattttgcccctgccctagagatttgtggaactttgaacttgagggagatgagttagggtatctggcagaaaaaatttctaagcagtaaagcattcaggaggtaacttgggtgctattaaacgtattcagttttataagggaagcagagcataaaagtttggaaaatttgcagcctgactatgcgatagaaaaaaaaaaaacccattttctggggagaaattcaagctagctgcagaaatttgcgtaagtagcaaggaccctaatgttaatccccacgaccatggggaaaatgtctccaggccatgtcagagaccttcatggcagctcctcccatcacaggcctggaggcccaaaaaggaacaagtggtttcgtgagctgggcctagggtctgcctgctgtatgcggcctagggacttggtgccctgtgtaccagctgctccagctgtggctgaaaggggcgagagtacagctcaggctgtggcttcagagggtgcaagccccaagccttggcagcttccatgtggtgttgagcccacaggtgcacagaagtcaagaattgaggtttgggaacctccttctagattcagaagatgtatggaaatgcctggatgcccaggcaaaagtttgttgcaggggcagggccctcatggagaacctctgctagggcagtgtggaagggaaatgtggggttggagcccccacacagagtccctactggggcactgcctagtggggttgtgagaagagggccgctgtccatgagtttatcaggggtttctgcttttgcatcttcctccttttctcttgctgccaccatgtaagaagtgccttttgtctcccaccatgattctgaggcctcctcagccatgtggaactgtaagtccaattaaacctctttttcgtcccagtcttgggtatgtctttatcagctgcatgaaaatggactatacagtcattcagtgtttggaaatttcttatccaggaaggtatgagccagaaacccagcaagtttagtagtccacagaaacccagcaaatttagtagtccacagacattgcctctaattctacttcactggcattagaggagatattccaacagagaggagaataggaatggactgtgcatatgggagctttgctgggtagatgagttagttctctagagctttttgggttcacatttttattaaggctaattttattttttattttatttatatatttttagagacagggtcttgctctgtctcccaggctggagtacagtggtgccatcatagctcactacagccttgagctcctgggcttaagcagtcctcctgccttaccctccaaaagtagctgggactgcggcacatgccacaggcctggccaattttttttttttttttttttttgtagagatgtggggctcccttttgttgcccaggctggtcttgaactcctggcttcaagcaatcctcccactttggcttcccaaaatgctgggattacaggcatgagccaccaggcccatccctaacgtgcattttaaagccaaacatcatttgggatgttatgcttttagccgttgcagtcctattgcttctttttagcgcccaatccctatttgttaactatgttatgtctgtattttaaaattttcattcttgggcttaatacctaggtgatgggttgataggtgcagcaaatcaccatggcacatgtttgcctgtgtaacaaacctgcacatcctgcccatgtaccccggaacttaaaaaaaaaattcattcttatgtttatgccccagccaggattgtttttgtatcctagtgtcttacacacttggaaagaaagcctattgcttattcacaattagatacctaataaacattttagggtgtttttttctacatgacatctttgtgtatacctctagctagtaagtagcttgtatgtttagtgtttgattttacgtatcccaattagatttcaagtcacttgtatctctgaactttagtttttcataaaacatcatgttttattgtgctgattattactttggtattgaaacctgaattttggttgtgaaatttgagtttggtgttcttatctggtgtggtttgggactctcttcaatacacctcatttgaattaatgcttagagtaatggagctggaaggagtatctgcttcttgtccaggtctctcatttatagaagggcagaggatacctagggaggttaaggggcctggccaatgactcgttatttgaagaaggatggagatgagagtttgtttccctagtctcagtcaaatgcccttaccatttgaccctcttgcctccctgtaatgctgttgggtaataaggtcaggtaactgcattggatagagcctgggtgtgttttattgtgaactccctctctttctcctttttgttgtatctgccttagtgcttagcttctttattacaaattagatattaaatcctgttctcacattgagagcgaattctttctccagaaaggataacaaaccttttgtttgagagagatttttcactttttgaaatggtctgtttgtttgaagttacagaagaaaaataagtgtaatgcacagttgtatttattattcatgtgaccctggaaacatttcttccccgccctgtgtttcagtttcttcatctgtaaaatgaggttaataatggttcccccttctaatgttgtttttgaagattacatgagttaatacatgtaaattgcttagaacagtgcctagcacctaatataatggaagtgttgcctactgcctattggcagttttctgtacggcttcaccttcccttaggacttcttgtcagcccagttatgtgatttttcacctcgtttttgtttaggagactctactttgttgatgtttttctgagaaacaatgtgctgtctgtttttctctgtttcctttgacatttgctgttcatctttcactgaatatttgtttaagaaagacatacagaatgttaattttcattgattgtagctttcttctttttaaggatttggaatgccctgacagataattatgggaatgtgatgcctgtagactggaagtcatcgcatactaggaccttgcacttgcttactctgaacctctcagaaaaaggggtaagttaggaattgaaccaatagtgtttgaataactgatgctgataatagaactaaaacagtagcatttctgcttaacacagattcactgacctgcctctcatttctgaaattatagcagtttgggtggctctgtcttgatgtcttggctgtagggccatcaccttgctggcacattcctccagttcttctccagcacactcattttttatgtgtagctaaatttccatcacaatttttttttttttgacggagtctcactctgttgcccaggctggagtacagtggcttactacaacctctgcctcctgggttcaagcgattctcccacctcaaactcccgagtagctgggattacaggcatgagccaccagtcccggctaatttttgtattttcagtagagacagggtttcgctgtgttggccaggctggtctcgaactcctgacctcaggtaattcacctcccagagtgctgggattacaggtgtgagccactgcacctggcagtgatgatgcactgaaacactcagtaaaatttggtgcactgaaaccctcagtaaaaatgctagcctttggtttaatatactgagagtattggaatctcaacacggagttaactttttaatgagtgtagtgacctgctagacatgatatgttgtcaggagactgtgtattcctgtgaatactggagaacctttaaaagatattttagttcttggcttttaaaatacggtcttggctaacttacctttcttggggtctcctgtgtacatcctggtattgtaaagtgaagatgtcttgactaagaagtgtgagcacgagtggtgggacaggtagggaggcagaaaagggttgagaattacttgaaatggaaaatcacagtgttaagcttttttaaatctgatgagaaacatatccaaattatctaagtttcagggcctggctgtttaagttccttatcaaataataatgtaaactcatgccagatcttcttgcgtgctctatatttcattaagtgtaattatgtgattattgagaatatagtgcagtaggcctgtcactattttacatagtattgttaatgttttgttaaaaggattttcttacatatgtgatcagaaaagcctactgttattattttctagtaaaatgtagaattctggctgtatttcccagtattcagtagctatggaaatcttcctgactgtgccagtcattaatcccattaagctttgcagactgacctggcatatatttaatgaaaaggaataaaatgagggatcttttgctctgtcttgtttacttaggtcctggctatcattttgggcttagttcaagtttcccttcctctctgaagcttcctattactgttttagcctttgctgatctcatggaattatacaattttagagttggaaggggctttaaaggacacttaatccagcctctcacttggggggaatcctcacctccagcatctctgacagatggtcatttagccatggcctaaattcctgcacggaaggaaaacacactcccctctaggggaactgatggcacttgtggggttgtgaactttgaaaggacttgttatctgtgccacggggtttagccttgctgtctcatgggtgctagtccccagatcactttgtccctgtctctaaaattaccactgccttctcttgttaatcatatgtttctgggtctgtcactagattgtgacttcccggcaggtatttgtatttgtctttatagtaactatactgttcctggcacatagtaagtatgaagatacctttttattgagtgaataagtgaatagccttgtcagtgaaactgtagggccagagatcgtgatagaaaggttttaaaaaaatattttctatgttatttaaaataatgcagaatgcaccaaaaccagtccatgggtactacttttttgacatattaaaaaatagcatagaagagtttccattcatagtttcaaagtcaggcccattagcagcgtgagtgagacagtttaatccaatttcattgactaaatgtacagcgggcccaccatattctctggtttcacatctgctgctttagccaactgtggattaaaaaacttgaaaaaaaaaccccacaataaaataacaacacaacaattgaaaataatgaaaataaaaaaccgaaaaccgatacaatataactttataatataaatattgtatagttatatacaatataactataaaccatttaccttgtattaggtattataagtaatttacatataatttaaagcttatagggggatgtgcacaggttatatgcaaatactaccccactttatataagggacttgagcatctgcagattttgctattggggtgtcctggaacaaatttcccttggataccgagggactgctgtatgtcttgtattgttcttagattgcatcttgggaggttgctcccttttgctgccttttgaatgttattttcaatgccacggtaatgatatggccaaggcagtgattagtaatgacgtagagtttaatgctagtactgacattaaaaagccttacctggctgggcgcggtggctcatgcctgtaatcccagcactttgggaggctgaggtggatggatcacctaaggtcaggagtttgagaccagccttaccaacacggtgaaaccccgtctctactaaaaatacaaaattagccaggcgtggtggcgcatgcctgtaatcccagatacttgggaggctgaggcaggagaattgcttgaacctgggaggcagaggttgcagtgcgccgagatcacgccactgcactccagcctgggtgacagagcgagactctgtctcaaaaaataaaaaaaaaaacagccttacctggaaaaactcagcagatgaaagtgaacacgtgatcattcacctatcatctctctgttgtgacatgactattctggtgatgaatagaattgaaatcagaactctgtttctcagggaggattagcacacactgagtttctgaaaaacaaatgggcaataaggactatgtaagaagtcatcacgtcattctattacatggtatataattaagcattttttttttaatctggcaaagtgactgtatttaccattgccacctggtgctctgttcgtgccgtgactaagctatgtaaaatttaccctttgaaagcattctttagattattttacttataaaaccaagtgtatagaaattttttttgacaaaagaagaatggtttttgcattaaaaagagaaaaacattcaggaaaactagtttgctagattgcagttttaaatttttctttgattgaagattaagatggcacacttctaaatttgatatgtcttttttagagtaaggcaactggtatctttcaaattcttacgtgggcacattttttccatttgatgtatcttcagttttatacagggaaacagtaccaccaggtctgtatctaaccctggcattggaaggagtgatgggaatgcttggcaaagagaaggcacatttaatgctgaagggaggagtgaataatgatacccatgacagccagggctagtttgcaaagcctgaaagatattccagctcttagcatatgccatctctgtggggaatggacttggctctctctctggaaagatgatctgggatcatttctgttgtcatggaaatttattataatagtttactgttattactcatgtgttttggccataaccctattctaaatctggtgccattcttgaatatacttatatgatagaatgcttatcattcatttcagcttaagaacatcttctgtgctgtatttctccttccatgtgcatttctttcaggacagggacttttgtatgcatctttatacctttaagagtagaaataagaaaaagataatgtcttccacagaagcaatttgattgattgatagattgagagagtgtctccctctgttgcccaggctggagtacagtggcgccatcatagcttactgcagcctccaactcctgggcttaagcgatcttcccgctccagcttcctgagtagctagactacacacgagtaccgccatgcctggctaattttaagaaaatatatttctgtagagacgaggtcttcctgtgttgctcagggtggtcttgatgtcctgacctcaggagatcctcccaccttggcctcccaaagtgttgggattacaggtgtgagccatggcaacctgggcttccttaggagtaatttttttttttttttttgagacatggtctggctctgttgtccaggctggagcgcagtggcaccatcttggctcactgcaacctccacctcctgggctcaagtgatcctcccacctcagcctcctgaatagctgggactacaggcatgtgccatcatgcctggctaattttttgtagcaatggggtttcaccatgtttcccaggctgttctcaaactcctgagctcaagcaatccacccgcctcagcctcccacagtgctgggattacaggcatgagccactgtgcccaccccggattaattttaaaattaaaacttttagtatttataagccagaaggggaaaaataaaacaaaatcatggtcctcaagttgcaacataggaagagtgattgggaagggggtgtgaagtgttcgaagtgtaaggatcgatgaaactaatcggtaggtctactccatggtatcgacatgcctttgtgatcacagtgtgccacattttcatcttctacagtatagaaatcatacatcccctctcatcaagagcctagtctcttgatctttctccttctttaaaaaattaaattattaaaggaacagctgtcatagtttaaaaagtaaattagaactataggacttaaatgaaaaggcagtctctgctccacttgatttctccttaccagaggtggccactttaaatgatatcagctatttcttttagcagataacatgctcatgccattttacttgatattattttctcaattttagactttatttattttctacccagagggtgaaggtttagctctcttctgtcctttgccaatccctgacactataccctcccaaaaacttccctttccccatcttcccaatgtaattacataacatctggggttgaattaatcttcatcatttatatttactatttaaatgtgcacagttgacccattatgatatattatgtttacattttctctttttctacttaggttttttcttaggatactacctgcctttttgtggtttatttagtttataattagctgaccagttcagcctcaatagagccgtagaactcattttagtaaatggaccgcactaggtaatctatctagtccttctgctctccctccccacccacctctccctcttctccatgctctctgcaataaaaattctaatctgaatgttactctctagtgtagctttacagtcatcattctgggattttcactttactatcattacgagaattctctttgtcacttgttattagaccacatatcttttttctttttcattttcctcctggtagctttttgagaaagggcacatgagaggtaaattttttcagaacttgtatgtctgaaaatgtctttatcctagcccctgcctacttgttttagctggatataggattctaggatggaatttctccaaacatggaagttacatcgattattttctagcatctattgttgctattgagaattcacttgacattttgattcctgatccttttaatgtgatttttttttccctccctggaagcttttagattctccttttttccacacagtgttcttagttcatgatgctgtgttgaaggtcatggccaggcctttgctaggctgatggtgcagtaagaaataaaatgagaagggctgtcgtcactgcgcaggagcctggagttgcattatagggttgtaggtggaccgtgcagtgttgatggggcccttctcccagcctaatgttggaaagtcagtgtgccagtgcttcttcccttggcccttctcacgtgcaggtttcttactctgtaggctgtgttcacctgcaaacttcagatgctcatgttatgaagaactagggaagcagtaggaacctacatccattccattgtgtcctcagctttagacatatatcctctgcatggataaataattttgccaggtaaaattttatcatgttagttctacactatgtaatagaatgacatggtggcttcttacgtaatccttgttgcccatttattctttggaaactcagtgtgtgctaatccttcctgaggaatagagttctagtttcagttccattcaacacctgaatagtcatgtcatgacagataggtagatgatagacagatgttcccttgttcattttaatctgctgagttttttcaggcaaagtttttacaatcagtactggtactaaactctaaggctgtttatattggtgtgggcagggttaagggaaacaaacttgatgtggtgcaatcccccagggctggcaacagaaactggtactttagcagtcctgggcatgaagaggtaaggagagggagaaattaccataaactgttgagattggccttgtgggagaagtctgctaatcagagctatggctttggtgaagagccatagtcaacaaatgacagtctgacagggaggaagacagcaaaatacatgcccagccttcaccatcccaccttgcagtctgccagtgtctgccaatggggtttaacccacctggaagccagacagcaagggcatcctttgatgtcttccataaaggtcgtcctcctggagcgcagagcagggtggaagatggtgaggaggtgagtggtgaatcaccagcttagttaggtttaaagatgtttttggaacctagggttattattttttgttaagaaggaatgtgcaattggaagggctaagtgtgacgctcatggacagatcccgcctttcagggagttgatcatcttttactcagatattagaagttagtttgcaagtaactaacttttatgttttctttagaatgttaacgtctaccaatcttagtgtgtgttgctaaccctgcccatattctcccttctattcactgtaattccctatgacttgctaatgaataccgtatttttttctgcatatctgtcagcttttatagcagtcttatgcagcatctcagtgatttcatatttattctacattcttctcatttctgttcaagatgaatatatactcattgcctggtacagagtgattgtaataatttctccctcttgagggaaggctcttagtagttgcttttctctgcagcctcttttactcagagctgttaactttgttttgatgaggatgtcctgcttttaatgatgggtatttttgtttttaggtaagtgacagtttgctctttgatacatcagatgatgaagagctgagagaacagctggatatgcactcaatcatcgtctcctgtgttaatgatgaacccctcttcacggcagaccaggtatagaggagatcctcagcaacgcaaggaaaggagactctagagctgaaaaacggcttcttgttatgacagtaaatgatggctgttggtttacttatctttcctatttttttctggttatacaggcttaatagttaactcttccacagagaaaaataagtatttgtgatctgaagcagaagggattatgttagttgggaaggtttccaacagaggccttgttgaagattatagcaaggtaccaaggaaaggttgttgcttaaccccaaaccagaaaaatattgtgaatttccttgtttctttagatttacccaaacacggacaaactgtaaagtatctgtgtagaaattatttagtatcttcaaaaccctgggtaaaaagcattagcatgtattaaagtaacatattgtgtgccccagaaagaagtgagcattattcccgtggaatgcgctaataaggtcaaccctgtattcacttaaaaccagtcgaatcagctttctcattttctgaatactcttcccacctctgttgtattgttgaaatgtgatgccagaacttcttcctgaaataaaatgttccatggctactcggactgtgagttctaccacactctatttttaggctggaaagatgagatcagtaaggagatacattatggcaagcttgggaggagtacattaaaaatttacattaaaattgtgttatttggatcctccttagtcatatttgtggttgaattgttctaggcgtgggaagaatgtggtgcttaaaaaagcaaggtaatagtaggttggaaggttgttttgaggtagagggtaatctagggatagacatgaccttgagaattcattgtcccctcactgacctgcctaataccgtaaactctccctttttttaagagttagaataacagattctgtaggatccttgagtggctcattgtaccttattatatttcctgttttggagactcttcttataattaacataatcccatctgcttcagatttgcctttgtttttccttggtggaaatcttacctgttaagcttgttaattcataaagcatggaaatatgctcatgatgtcttactccttcatttaattgtgtttaatttttttttttaactttaggtccttttttctaactattgagtaattttcctgggtttcctttacattttcgctgagttctatatccttctcaacttttagaatctggaaaagggcaagatactgttgtaagatttgagcagcactgcactagacagtagatcattgtttaaagtcaaatgtatttctgaagtttttctgcttttcacagcatttttctctttggacttctactttttgagtaatttaaaaaatccctttttttcgttgaattaatatataaaattatttttctgctgttgaaagaatattttgctgtcatagaggtaatttcccatttatatatactttttttgtgctattgtattttataaattttatgtcagaatttttgatgagatacctttaaattgagcacttgtatgtctatggtaaattttctgttatttgctttcttctaacgattactgtatgatctagctctggtgtgtctgaagtaaattattatgtgtttgtagcacgattacctagactttgcaagacatgttagggccttctgaatcatgatggacgtagtaaatccaattctatttaggtttgtgtttagtatattgtaattttttcttgataaaccatgttcactcctacagtcaaaattttgattatttggagcatccacacctgaacaccattggttaatggagaattcagtgcatttctgctctgggtgccttaggtgagcactgtgttccagatagatcattttccttttgtatatttgattaacagtggtgtgtgtgttttcgaaggttattgaagaaattgaagaaatgatgcaggaatcaccggacccagaagatgatgaaacccctacacagtcagatcggctttcaatgctttcccaggaaattcaaactctcaagaggtctagtaccggcagttatgaagagagtaagggagcctgctgaaatcaatgatttctgtgctttttgtctgtatcaaatgtatagtatgatcatctccagaaagctttgatttcatcctccttctgtttgtgtttgtgtccaaatttacatttttgttgttgttgttgagacgggatttcactttttggcccaagctggaatgaagtggcatgatttcagctcactgcaacctgtgcctcccgggttcaagcaattctgcctcagcctcccaagtagctaggattacaggtgcccgccaccacgcctggctaatttttacatttttagtagagacggggtttcgtcatgttggccaggctggtctcgaactcctgacctcatgatccgcccgccttagcctcccaaagtgctgcagttacaggcgtgagccaccattgcctggccccaaatttcctcttacaaggacagcaatcatattggattagggtctatcctaatgaccttattttaatgtaattacctctttaaagaccatatactgtaacattctgaggtacttggggttaggacttcaacacatgaattttggggaggacacaattgagtctataagaaaccccatcatatttgaagtgtagaatagatattcagtaattatttgtcaaatgcaattcctgtttgtacaaatagtcttgtgtgttactatgaagaattttgggaaccatggatctgtttgacatatgtgagaataatgaactctagaaactctacagttgattttcatgaaaaatgtctgaataaatataaccagcctgtgaacagcctgaggctggttggaaggtgtgtatctaatcattgccatatgactggtcccttccttgaataggcactgatggggtctgtatctgctcaactcgtgttgtcacctagttttatctttatggcatgcccagtccaaagcttagttacctaaagacctttgggttgtatggcttcaacatacagatggtcagacagaccaaattctttcagatggtctgatttggccatgttcctgtaggtatgggctaaacagtgttaacgtcctgactcccaaatacagtcctgatacctgatacagatactaaaatctgtattggtttgctagggctgccagaacaaagtaccacagagtgggtggcttaaacaacaggaatttatattctatagttctggaggccagaagtctgagatgaaggtgttggcaggtttggtttttttcagaggcctctctccttgacatgcagatggctgccttttccctatgtcttcacgtggtcttcctactgtgtcctgatcaccctattttataagaataccagtcatgttgggttagggcctatcctgatgccctcatttaaccttaatttacctctttaaagaccccctctccacattctgaggccctgtgggttgggactttaacagtgtcctatctgtcacaaggggcagaagtgctgagaaaagactgaaatggggtttcagggaatattgttcccttttgtcttcccagtttttttagtccattcttgcactgctataaaatgcctgaaactgggtaatttatacgaaaagaggtttaattggctaatggttccacaggctatacaggaagcctggtagcatctgcttctgggggggcctcagggagcttttactcatggtgggaggcagagctggagcaggtatcttcacatggctggagcaggaggaagggggctggggggagtgccacacacttttaaacaaccaggtctcataagaactctgtcatgagaacagcaccagggggatggtactaaactgttagaaattgccctcatgatccagtgacctcccaccaagccccacctccagcatcacatttctgtatgagatttgggtggggacacagatacaaaccatatcaccaatttcaacaaaattcacagatcaggacttatgtaattaagtgtatatttagtttaattctttcagatcaactcctttcctgttcagagatatcccagaaccctgctgaacggcttgcagttttttgtcagcaggtggattctgtactttccctcgacttttgtgtttgttcttttccgtgtacaagccttcacagtcttgactgaagtattattcatgcaatgatttatttgcacaagtaaaaacttttgttagactttcttgccagcaagctgagaagtgactcacctgcccacttacctctactcagatctgatctccagaagttgtagaattctgagaagatcacccacagtcaatttaattgcttggaatatgatttttgctctttggcattgattacataggtgtttatttagtcattcctagtgactactctgttttgcttccttgaaatgtttttgtcttaatatctgctgtattttgcttttggtcacaggagtgaaaaggctctcagtgtctgagttaaatgaaatcctggaagaaattgagactgccattaaggagtactctgaggagctggtgcagcagttggctttacgagatgaactggagtttgaaaaggaagtgaaaaacagctttatttctgttcttattgaagtgcaaaacaaacagaaagagcacaaagaaacagcaaaaaagaaaaagaaactaaaaaatggcagctctcagaatgggaagaatgagagaagtcatatgcccggcacagtaagtgatgttttgcaggaggcgtcgaacactggaaacaggttctgtggtagtcccagcctttggggctggtggcaggtgcgacaggttgtacatgggcaggagtgttaacacttctaatcagagcccagtgggattttattccagaataccgctgtgctcagcttcttcagaaagtcgttttcttgactagggtgtactggttatctgaataatactgaaatgtttagcaaggatgtaagtggaaggaagagggggcaaaaaaggagaatgtcttgaagaaaagaagctttagcaagtgaacatttttaccacatcaaaatgtgaagagtggttatgtatatttggctagtagtttttttcttatttttgctgaactcttacgagttgtgtgataagaaattagaaggggtttatttagaggtatcagaactctgctcaaggcacaaattgtttgtaaacaggttcctcctgatttttcagtgaggttggaatacaagaaggtaagtgacatcagccatgtggcctagtatttggcagactagactatttctgactggtgaaaacaagtttagaacatctgaaacgctgaccctttgataagatttttttgtgttgaagtcttgtgtattcccaccttgattttgtttgtgtgtgaagaaatgttggttttatttttagagtatgatggttgggtaaagggatctctttttctaaatgggacatctctttttaatttgtgatatcaataacatggtcttacaaatcacaaactagctattatggcttgcaataatatgagttctgtttttgataaagtctgatttacttatctaaagaatacttagcagagaaatagatctcattaagcagatgctgatggaatcctggaaatacagttctaggatggtgggccaccaatgagcagttaacacaaaaagagtcttaccatatagctcatttattatgctgtaattagcctatgaataaatccatttttttcagtgtaatgttcatttgtatctattttgaaaggacatcgtggctgggcacggtggctcgcgcctgtaatcccagcactttgggaggccgaggtgggctgatcacctgaggtcaggagttcgagaccagcctcaacatggagaaaccccgtctctactaaaaatataaaattagccgggtgtggtgctgcatgcctgtaattccagctactctggaggctgaggcaggagaattgcttgaacccaggaggcggagattgcggtgagccaagatcgtgccattgccctccagcctgggcaacaaaagcgaaactccatctcaaaaaaaaaaaaaggacattgcttatgcactgactttgaaaaaagttctcaggtatctattatttttaagaaatggcagtattgattgaataggtgtttatttagttattcctagtgagtactctgaaaaaaacccaaaaccaacccacatttgtttgaatatacaatcctagaaaatttgctttaaaatattagggacactattttgcatttgcatctcatatttttagaactggcaccctttaaattgccctgttatgcaagtgagattaaataaaatgcttagttaaaaagtcatagcatggttggtaatttctgcctatttgcttttagggattacatgtaaatcctccatttattgctgttaacacttggctgagaaaagtaaatttatccctagaggggtttaaaggcttcgttttgtaactcccatgtaaaaagggttagagtaaatctattgtgtaattttacatggcatttatattgagaaatggatttggcaaggcaacagttaggtcttacttcagccttcattggtcttgaaatagattcatagtaacagtaaatatttttcataatatttgaacttttgaagttgcattttgcctgatttacaatttgtgtcaaaaattttaatcagttcagtaatggcacggctaagcttgcagtactagtttcctgtatccttttaaagcctaaaatgcggccgggcgcggtggctcacgcctgtaatcccagcactttgggaggccaaggtgggcggatcacctgacgtcaggagttcaagaccagcctggccaacatggtgaaactccgtttctactaaaaaatacaaaaattagttgggcgtggtggcgcatgcctgtaatcccagctactcgggaggctgaggcatgagaatcgcttgaacccaggaggcggaggttgcagcgagccaagattgctccactgtactccagcccgggcaacagaacgaggctctgtctcaaaaaaaaaaaataaaaagcctaaaatgccagggaaagaccttcctatctgtgacacaagtaggctggaagggtgattctgaaaatagtggtaggttgctcaaaagaaacccaaagtgaaataggcagttggataaacagattccaggagcttgccaaacattttaccaagcattttatatcacatgcagtcttggcaagacctggtctctatgagtttgctattatcagtgatactaattcctaaaaaatggtgacctccttagaattgtcatatgttacctgtttttccaataacataagtcacttttttttttctcctgcctgagatatttttgttttattagcaggacttgaagtttttcgttaagtatagaatagcttccatttttcttcatgtatgtttcactgaagcagtacatcaatttgtagttggcataccacttaatctaaaattgttaccttgttctctttggtccaaagatactctaatgaaatattggagtgggtatagagcagagttaaacttggagacagattttgttttaaatatttgttgtggtgaaaaaaaaaatagagggcatagggatgctatttagagcattggaaaatttcattagaccatgaaaatatgtgaaatgttacagaaagtattatcttataaaagtgaaatatgattttgattggagttttaggtttaaaataaccataatgctgtatgttgggtaagatgaaacaatattcattcattcagcaaggatttgtggagtgctttcctgtggcaggtgttcttcaagatacagtgggcaggatgactcatgatggtaattctaggactttgagaggctgaggtgggaggattccttgagcccaggagtttgaggccagactgggcaatatagtgagaccttgtctttacaaaataaaaattataaaattagccaggtgtggtggcatgcacctgtagtcccaactacttgggagtctgaggcgagaggattgcttgagcccaggaggttgaggctgcagtgggccatggtcacaccactccacttacagcccgaccttgtctcaaacaaaaaacagaaaaaccacagtggcgaatagaatagaatagatgaggcccatcccatgccttcctggagcttatagtctaatgacggagaaaggcaataaacaaggaaaaaatgaatagatgatggaattttagtagtaaataaaggccatgaagaaaaccaaaggctgggtgaggtggtagatggtgatgctgttgggaagctgttttggagagtgtcactacaccactgcttctcctcattgacaagggagcctgcctagtccctttccaattctccgtttgaagaggaggttaaaggagtggacctctttgggaagtgcaactcaagagagtggcaggctttatatttcctctgtccttttttgcagcatctggaggagcagaggatggggggttagagagtggttaaagggcactgtctgtttatcactatggtgacctacatgtatttctttgtgctgaccatgctgttttgggtgacacttctttatattcaatgctcttcttctggaatcaaattccttacctgctgcttctgtccacttgggggattttttttttttctcactcatcctttaaaatcatggccaagcattgtcttcctttcttagaaccttccttgatgactctgtccgatgcagagttgactactctctctttttagaggggttagtgttactcctctttagtatttctattatcactgttgtatcatactgcaattttttgttttcatgcctatctctgttttatgtccctaatgataagaaatttaactttactttctcggtattcgtagatccaaccttaggtacctaataaatttctgctgaatgaatgagtgaacgaaagataaacttgcaaatatatatttctatattggatctttctgccaggtgtcaaacccatggacagtgaatattgtctaagacaatagaatattgactaagagctttgggttaagagctgtgtttgaatcttcgtcctacatacagacggctttgaattttggagagattaaatgaaataatgtatataagattagcaaacatagcaaacaccatgagtaaatgctaattgttatatatgtccaactgcctactagacaattccctttggatatcttgtaggagtctgaaatttatactattaaaccaaagttaccattttcctaaaattgaattattttcttttggttagcaaaactagtttatccactcactgaaaccgatagaatttccaagtcaaagaatatagagttttaaatggctttaaatgaccagcttttcaaattattgtgtagaagtgtagcccagtagagcgtaagagtgaccattttcccacacctcccgccaacaggagatattaagagcttttgaatatacactgcacaggcaaacaatgggtttgatctgttgaccatttgtattcttttatgagttgcctattatgtttatatgcctgttatgaggtgttttcatatttatttgtgagggtacacatacttgtgatattgaagtaccacactgtgttgtaatcattggcttaaacctctcttctaacagagtgcaagctctttaaaggctcattcacactgctttcccagcacctcacctaatttcttgttcttcgcacatcacttaatgcatgtttgttgaattgaaacttcagtgtacaggagattgaatcccggaggatttagatttgtagtatttgaattattattgttctattggggatttttattgggggagccaggcttctgttacatcagacattcacaggtcattgaatttcagtagcagttctcatgaatacaagaataggttgaacaacaccaggttatgttgtaatttagtagttgctgttcatctagtgttatctgcagttgtctgggcattatggcctacctgcttagcatcataacttagtaaacttatatgtatgaaaatggaatagttaccctctgagtatctagtaacaaatctttgaattgaatgtcacatgtaaggttgtttatgctaagtcttgttgagaagataggaatcgatagtcttttctgtttgccataatgacattgaactttgaagagagaatttctactgtgttacactccaccatcaaaaatgcataactgcgtcagtcaaccctgaaaaagtttatacggacaacttttgggatattagcaatcagtgactaacggtagtagagaaaagaaaaaactgtaaaaagaatcacattaccctaatttattgcttttcgggggttagggagagaattgctgaaggatgggggagagctagggcttagatgatatacactctttcttgtatatattttctttcacagctacattgctccgtttctgtgactcagctcatgttataatatgattgatagcctttgtttggggcttctgtttaaaacaacatggacctggctttttccccccttctttttaatttggaatttttttaacagcacatttgctcagatgatttaaaccagggattgtcaaggcagactactgtccaagggctaaatcaactcttcacctgttttatgaatacagttttactggaacacagctatgttcattcatttatatatcatctgtagcagctttggggctatatggacagagttgagtggttgccgtagagactgtgtggcttacaaagcctaaaataattaatgcctggctcttgacagaaaaagtttgccaatctctgatttagacttagtaaaattaaaaagtagaacaaaaagttatgaactccagttaagtgagtttgcatagataaaaagagtactgtaatgtttctaaagtttgtatttaaaaggttactttgttttatcttgagattatgttgaattgttccttttcttggggccccttcagcagcagcctgagtgatagtgacaccttggccagccaatctccaagctacgtgtggcagcttcttgtctaacagcagacctctgtgctgtgtgtgtctgaatcccggtggctaggtaaagagagtgagcaggtagaccagtgttctctaaatatggagacaaacaaaaggaataaaaatgttgtattatacacagtgataaaatgtggttttaaaagaaggttagaggagaagtggaaaaggcatgagtttttttcccctttatctttttttttttttttttttttttttttcctgagacggagtctcactcagccgctcatgctggagtgcaggggcgcgatctcggctcactgcaacctccgcatccccggttccagcgattctcctgcctcagcctcccgagtagctgggattacaagtgtggtccaccccgcccggctaacttttgtatttttttttttttcagtagaggtggggtttcaccatgttggccaggcttgtcttgaactcctgatctcaggtgatccacctgccctggactcccaaagtgctgggattacaggagtgagccacagtgcccagcctttttcccctttatctaagcagtggtgcttgagatactaaattctacctgacatacattctttttttttgagacagggtcttgctctattgcccaggctggagtgcagtggtgccatctgggcccactgcagcctctacctcctgggttcaagcggttctcctgcctcagcctcctgagtagctgggatgacggcgcccgccagcacactcggctaattttttttagtagagatggggtttcaccaagttggccaggatggtcttgaactactggcctcaagcgatccgcccacctcggcctcccaaagtgctgggattacaggcgtgagcaaccgtgcccggctctgatacgcattcttgaatgtaaatattgacacattttaacaataatttgttggtgatatttgatagtatcttgctgcattttctttagtgcaaagcatttactaagaattactattagcatgatagaaggtcattgtagggtggagaaaaacttgactatataatggctattattttaataattcaaacctatgaattatgaattactttagatgtggaacaaatttgttttatgaaaaataatattacctagagaaatatatgtcatcatcagttttcgatatgtttttatcatctacactttgttttctgcaatggtttttggtggtaggctggtaatagtgaactttcatgatccatcagttaatgtagtaaaaatcaggagtccattcttgacttctttatgtgttagagaggtcattgttaatataaacaagttcacataaaagctgtaatgtgccaggaaattgtgttcttcttgtatacagtcttgtgccacatagtgatatttcggtcagtcatggactgcgtatagatagatgatggagtcaggattataatgctgtatttttactgtactttttctatgtttatctatatttagatacacaaatacttaccattgtgttactgttgtctacattattcagtacagtaacaggctatataggtttgtagcctaggagcagtagactataccatgtagcctaagtatggagtagactatacaattatgtaggtttgtgtaagtacactctgtcatggtctatacgacaaagttgcctgactcatttcttagaatgtatcctcatttttaagcagcacatgactgtacttagagtatttatgtttcaggaaggaatttctaaaattgccaagatcaattattatattctagttttagtggttttgaaaatatttggcaataattagtttagtttccacattaatattaagttacataaaaaattttaaaaagatcttcaaagataaaaattaaattatttaatgctaattttgaagatctttgtattatattttttctgccataaaaataaactcatataacagttgtttaatattgaagattttcaagtgtgtatctgctttggtataatgtatattttctaatttacttagatctgtttttttaaaaaaatttttggtagaatttgcttttataactgctttataattcacattaaaattatttgaagtattaaaacaagatattacttttacatcttaaataatatcttaactatttgaatatttttactctaaattttttacacttgtttcctcattttgattattttaatttattaaaaattaaacctactgttttataatgtttgaaaatcatattcaagctattgaaagtgtcgtgatttatcaggaacaataattatgttttcattttgctttcatttgaacctcctgagtataaagaatattaatgaagtaagagtagattagagtaagagtcagaaatagatgaaaagcattccttgagtgctttttcaaaccttttttctgtcattgagctttgatattgagattttaaaatgatttcctggccagttagaaatctgtaccagttggtgtcaggtgaggctgagaaacaagtttgatagcgggaatagtgtaaatttcctgagccctttgttgtcttgcttttccctgtcttggatgttgctttctgtgaagctggttgaactggtgaatatgctgtgtgtagaagaagctgatatatttaagataccacagaagaactaacaaactgcagcactgtatctgattcttgttcacttttatgtagcatagtgttctctagctcttttctttttattgttcagaaagaccgaattatttaagtgttaacttgttttctgtttaagcttttttgctgattctgtgcttagtcatagatagtaatgtctctttatgttgttttcagtcctatcagctaggaactataatcggggatttattttttctcagctgcaattttatttatattagaagaacttgaaatgctgtttttgctgttctggagaaaagtagaaaggtgtggttatttctctttgggagttgtgtctaaaatattattctatcctttttatttttaggaattatagccaatacttttttgaatattgatatttgctgagcactttgctaggtacttgcatggattattccatgtaaccttcacaacaactctataaagaaggtattattgttattatttccatttcataaatgagtaaacaaaagcttaacagggaccttagctcacagaaccagcatgcattggaatgaggatgtggagttatttagaggtggatggaaggatccttggcttgaattttcgttttctgagctttgcaaggatgttgtaaatgggccttggggatcttggcccatttcttcgtctttcagattttggtgaatttttataaatctatatcctgtttatacattgttgctactggttttgtctgagaaaagtttccagataaggactgattttgagactttcaatacatacttatgccagggaaggaaacaaccacgaggcagtggtgagtattctcagcgtaaatactggtgttgaagctgtgtattgaataccctcttcctccgtccttgccacattactttggcatttgtcagtagtgagggcaacaataaagtaaatactgtaatgcttaatcatttccctgctcacaaatgggctcctatcaaaaattccatcctgagagggggcattttatagcactattaactccttcctaaagacgtagtgggaaatggatgaatcaattacaaaataacttcagattcagaattttcaccagttcttcactttgaatttgaacacttggattctttatttcaaacttggaaatggtagattaaatggagggaggattgggttttctgatatactgcgttattgcagttatttaaattaaactgtaacaaattgttttttcttttcttttaaaaaattatttacttatttatttagtaacaaatctttaatgtccttcatttcattcagcattcataaccctgagacttagttctgttggcgctttggtatgtctttggtactttaaccttgagaaatgttatcaaagaaatgcttccctcccttccccctcccactctgtctccctcctcccctaccccttctgtctctccctttccttgtcctcctacttataaaatttaagcatagagaaaatcttccctctggcccagttaagcaccataagcacctaataataccgcatctgctctcaaggttgtaaatgtagtgtttctaaatgaggtgacgtttactaaaaagtatatttaacctgcctctgaggttttatctttttaaaattcattttgccttccaaaagggtgtgttattttttggaatttacagggcagctataaaacagaatgcacagtatgctctacacagctcgtttcctgtttcttcctggtctcactgccctggtctctcttttcctttatccttctagttcactgatctcctacttgctactctttgattatcctagctaggggtttgagatttcttttttttttttttgagacagagtctcgctctattgcccaggctggagtgcaatggtgcgatcttggctcactgcaacctccgcctcccgggttcaagtgattctcctgcctgagcctctcgagtagctgggattacaggcacccgccaccacgtctggctaatttttgtacttttagtagagatgaggtttcaccaggttggccaggctggtctcgaactcctgacgtcaggtgatccacccacctcggcctcccaaagtgctgggattacaggcgtgagcctccgtgcctggccggggtttgagatttcttagtcactccattgttttatgttttataaaccacgccaacaagattatttcattaatctcatcttactttcctagactagattcttcagtggacttttccagaactccgttgttcactcttctgaaaaataacttgatgttctgtcctgtcatctttattctgttcatactccacttattttgggctttttttttttctttctctcctgcaagaagtcaagacacctcatgatatggtgaaacgatcataggctctaaggctcttgggttctggtgttaggagtgtcacagcctcagcttatgagacgtttaaaaatgactgctatggcccaggcactatgcaagctgcggggatggaaagatgcctaagacctgtctctcccttcagaatgtagtcatttcctcataagaaaatgaagccactggactctgaatgtatcatctggctgtgcagttctgccattctggagcactcatttatttagtcctatagagagagagagagagtgtgtgtgtgtctatgcgtatgtgtgtgtttttaatttgcttaataatggatctttttgattgaattaatccatagactcgtaggatttacaaataagaagacgtttaaagttaatatgatttaatcatctgttttacaggtgaggtaacaggccttggcagtaaagtgactgccctcctgtcacacaattagtggcaaagctgggaaagaacccagatcttcgatttctaattcagcacttttctgtccaagttgaccgtttaaaaatttcttgattctaagacttttgcctgagctatgattcctggtttcatacagaaatctggaagtatcccactggtattggtaatgatcgctgtagcgttttgcaggttaagtcactgactatcagtcagatgcctcctacatactggtctggtttttgctttttggagcatatgaaagaagtatctgacatttttttttttctgtccttaaggattttgagaacttgagttgaatttatgaaaaattaacctgaccagaattttcatttttctttctttattgtttctctttagatcttgtgcactctacctccccattaaaaatatcttgattacttttttttttttttgagacggagtctcgctctgtcgtccagggtggagtgcagtggcgcgatctcggctcactgcaagctccgcctcccggattcacgccattctcctgcctcagcctcccgagtagctgggactacaggtgcccgccaccgtgcctggcgaattttttgtatttttagtagagatggtgtttcactgtgttagccaggatggtctccatctcctgaacttttcttatactactattaggcaaacattaattgatccacagttgtgtccctggcatgggtgttaaggatgtagaaccaatttcagttttccaggaatgtgctgcccatgggttgcagattgaatgatgaaccatccaatgtgctttagtgcggtgattctcaaccaggccaattttgccccccacgggacatgagtcaatgtctgaaaacatttgttgttgtcacaactgggcagggtggggaaggatgggggtggtactgctggcatcctggtgaacagagaccggaggtgctagtggagatcccaccccactacactgacccccgtgacaagaatgatctgactggaaatgtcagtagtgtcaacgtggagaaacctaggtacagggtgtgataattgctatattcaaaacaactaccacgtttttagtgttttctgagcctggctctgttctgtggtcaaggtggacatatattactattgcccctagctaggtttaggggtctgggaaggctgagttgcacccggaggtcaggtagaaggaggagggaacaggcacagacagcagagggggtggtgtgtgccaccacttggaggggacagttagggacatctggggaaatgcaggctgctcattatggtgaaagctagaaggtgagggggcaagaaactcaagaagaggctatggaaattgcacagtggaagctggaaaatggatggcgtcgtacgacattctgaggcacctggtttttgtttaaagggtttagagaaccaaaaatggattttaggtcaggtagttacatgtttgggtttgtctgttttggaagagaacttcagtggtttcaaggagaactaattggaaggaggcaactggagataagttaattaggaggctgttgcagcgatttcatgtaagaattgagccagggaagtgaaagtagggatggaaatataaatagttgaatttcagagatattggtgaggttgattgtttcggacaccaaagaagggaggagttagggtcaggtcattgattgttgacgagggcaaacatagataaagcacatgtgccccttccccaaagggaggtatgtaaatcttgtcagcagtacctgcttctagcttcaagtccagcaaatgaggggatgtctctcttttccgtcaacctatggtctgaaagttaagccagccattgcaacacattggcacacaacgggggagagaagacagggttgctgcaataacatcttataaaaaggaggagagaatggacatattccatagatgctgtgttccatcccattgaatgagaattgcaagacctcctgcacactagctgtggcgtgaactcccgagttggcccggttggctgcttttggttttgttctctgagaagatctcccttgtccattgtcctttgtggctcatctaggatgggtgtatacgtcatatttcagctcagatgtcatctcctcaggcagcttttctctggcgtccgagtagaaagtaggcatccagtttttaatcgccttgctggagctagggatagggcatgtgttagttatctgcagcattcgcttcatttacgtgttgtgctttttgtgcccccttatgctggaatgtaaggtcaggagggtgggaggggccttggctgatgtgttcactctgaatctctaatacctggaatggtatctggctcaggatgttttttgaaagaaagaggaaatgaatgaacgaggagaataaaatgctgaaggaggaaccggtttttaaatttttttgtttgtgttttggtggggaagaggacattgaattcagttttggatatgagttttagaaatattgatattaaatatagacaggaacataggcttgtcaataggccattaaacatacaataggtacagatgtccaattggccattaaacatgcagagtgaagctcagggaaattacagtaaagatagctaacatgtactgagctttgccatgtgccagtctctgttcttagcactttactgatcttagtaaagtggagctatcaatttatggaagcagaagatgaagctattgattggtaatacccagagggggtgcatgataattaaatagggacagaatccagaggcacagcagcatctgagaggtgagtcaagaaagaggcacaagatcctagggaacactggcatttaagggatgagtgaagaaagtggcccctcttagaagaagcaactagagagcaggagggttggggtgagggaaatctgggagagtgtggtgtctctgaatccaaggaagcggttcagggaggagggattcctggatgtctcagagatctgaaaagtggccgtggtcttccagatcaaataaatgatgttgggaagagctgtttcaggaaaaccttgggaaaggaaagaggttgagggtttgagaatttcgggatgctgtcaggaaggagctagtagagagggagagtttggaaatgcagtggagggagaatattgatgctgcctgacttctggggaggtaggagttgattgcaactgaagcgtttgataggagcacgttctcagacgtagattttagttttttttttttttcttttttttcctgtagaaccttctgatttccttgttctgtaattttccaatggatcaagaggcgattgaactgtacatgctgcacattgcttccctggttcattgccagtgaaagagctggggacagtagggtcttgtcagctgcagccactgactcagcagccatcagcagcaaggacagaggttctgctgcattccttactttaccttctttcactggcatcagctgttagttttgtttttccaggttaccttggcttcccatggggttgcattttcactaatttcccctaagcctaaaattctggtggcacaaaagccatctttcacaagtagtcaggctgtcagtagttgagatggctcagtaatgtctgcaaccacacatttaataaagaaaacctaaattacatctgcatgttacgaaattgaaactgcatcaacttttgttttttctagtgacaggaattggctttctgattgcgaaaacaaagctagtgtttttggaatgtgctttccaaatagaaagtgtgtcttagtttcctgataggtggattctgaaactttttatctagctttagattttatgaatttgtatctagcttaaacatgctcatagataatggagccaggtaatatagactaagtacttaaaaacaagtactcttctctttgtcacatttgaaagaaaatatattttatgaaaataatttaaaaaataaactgacttggttatttgagaatagtttctcataattgttattatatactctgaagcctaagatgttatctcatttgataatctgcttaaaaaatatgaatgaattatgatagcattggaaaaatttacagaaatagttttctgtaggtttttgttttataactagcctcctccatcaaagctaatagttatgctttcagtgaagtgaagagtagtcagcaaagtatcttgactagacatttgattcttgctgaagcaaaactggcttgcaaatctgggaaaggctaggtagggaagttggatggtttaggaggagaggcatatttgtacagtctcctgtaaggtagtaaaatttggaactcagattttcagtaactccatagagttacatgactgatacagaagcacatagctccctcagtgattcagcctgttggcatttcttagctttttgttatcaagacttctttacgctcttaaaatttatcaaggaccccaagaaacttaatattagccatgttacaaattaaaagtgataaaattaaaaatataaattcatgaaaaataccaaaaataaattcattataaagagcatatatttatgaaaaataatattttacaaaatcatgaaaaaatatcattgctgtgcatttttgtcaatctcattaacatctggcttgattaaagacagctagattcacaaatgtgcttctgcattcagtctgtcatttggaatatttcactgtaagtcatgagagaatgagagtaaaaaagacaacttatattttagtagtattaagaaaacatttttgaactcctgaactcctgagaggatttcagggacctcttggcaggagttgggtgggagggggtccctggactacactttgagaaccactggatgaaactatatgtatttcttgatgaccattcccttggtttcctttcttctgccccttggggcctggtaaaatattctttatgttgactcctcaaatgtgtttactgatttaaatttcctctataaaattccaggggaaggaaccatcaagtgagtcaggccttcacttccttttcacgaagcctttccccttaattagtcatgctgtaagaatccatctcactcctttgactcagccgccatagaggtgccaccagacgctttttactatgcttgatgacattgtagactggttacaaatcaagataagttgtttaggaaaaaaatactcccttttcagtacaaagaattctaggaagtcttggaggttgctgggagaaagaaagtagaattgtttcctagaaacggagtggaaaagtctttggagaagtttttgggggcctggctggcacatgggatccactctgctctccaggaagcgtatgccatcttctagttcgcatttctgcaccaaggcagtggcaggtggcccgaagagtgagtgggaagcaataatcagctctccaagtaacagcattttcatttgctaaatgttatgttaatgttctccaaactgatggtagaattatacaaacttaggctgaaaatacgcatactgttcatcttaagttttcagacttctgataaaatgtaggtaaataatatcaaaaagtatcttaaaaattacacagtaaattttgtatagaacaaatatgtgtacaacttacaacatttacattggaacaattagctacatcagaaaaatgcctgcatgaatatagtagcataaaaacagttgcttttgcatttaacttgcaaagaaatggaagcaacagcattttaaaaagagcatgggtttatgtgctttatctggatgagtagtggcattttctaactgcttgcctcttgggcacataagtcatcatggtacattcttactaatagactttgaacttctttctctgtccttttcttctgggccgtatattgccgcctttagcgcttcagcatggaagggatctcaaatgtcattcagaatggcctccgccacacctttggaaattcaggtggagagaaacaggtgctcggttatccttattttcctcattctctgctttttcattttctgtgtaagtgaagatcctgaaagctggtagtttactaatttactaagaccattgcttaacgagagaaataaaagtttattataaaagttcattatatttatagtcttgataatgaacagaatttccctttgaggaaaaagcatttttcaaattcgacaatagattaaatgcattcttaagacgtgttttatagctccatttttcactcttagttttaaacaaatattaacattttaacataatgtattgcatgtgtagaaaatctgcttgtgaaaataactaaactaaaatatgtgactctaattctaaaagtctaagtcgcaagatgtcatttttgggggaagaaggccagatgtcggtatgtttgagactagagttctaggtcaaaaatatgtatagagtgtatcttacctcctttaaatgaaattcatgtgtttttaaggtgtattgcatagtcagccaactcagttgtctgccaaacgaggcatgcgacattatttatacaaaattatacacagatatgaatatataatcaagtatctagcaatttgctttttattcacatttttgtataatgattgaaggaatatcatgaacatgggaaacattcacattaatgggtatgcttaaaattacctttcactatatgaaattttcaccttgaaaaagaaaagtctttaagttagctcttctgtgcagattaagaaggtgtacaaaatgtagcttgtaggaagtttagcaaaagaacgcctagatcaaatgcctggagtttttactgcaggtagttaagtgtttctccggaagggagatcattcctattaaagagggaagcctcacactgacatttgcagctcatcaatgagctccatgaagggatgtttgagtttttgttttcattccgttgcctctcacctctctcaacctcaaaagaagacaaggaatcttccagactgtcagtggagcagggaggcctgaagatgcagccaggtagccagagagcgggccagggtgcagccgcctggtgcctctccaggttgcctcacacatgcagagtgaagccaggaggacatcatttctggccttttgttgttgttgttctttacaaagaaacattcgattatacaattgggcatcacctgcaagaagtctacgtcaaaaagacggtgggacacttaacgtgtctcagagattgaactatgcagttttaccacttttctggacttagggatccagttactgtaaagcagctttctttatcctgtttttcagttatgggcaggataagatcactcagtgaggattagccacagagctgagatttagggcacgaggttaaataatgggtggagctaagagattccaggtaaaaaccactggctttctatatgagcatatgtgaaatgcacggaactatttttttggtgggatggtaagaacaggaaaatctggacaatcatttatggattatgctttcatgggattagttaaaagacatggcgctgttacttgtgagcctttacaagtagtgaactaggaagtttatctcaatttcagacattaattttcattattcatttccccttaggccattctctactttaacttttctcctttaatgcctaaaaacgtttacaatgacttacccaataatttaaaataatagtaacgcatttctaaaacgatttaagtgtgtctttgttagcttctgaaagaagctagtgtgtgtttttcaaagttgtcatgttatatatgtggaccatttgttcaaccagaataaaaatggtctgaaacagaattattttgctgttggaaattactttattgtgcagaactgttaaaactatgtttttagtttaaattgctatttttaaaatgtgttgaaaaatatgcaagtagaatgtgagataatacttcactttaaaaatgaacaaattgagtaaaccatcctcagacttagtcctatgaaattttcaataactgaaatgcaaaaaggtggttgtttctgttgacattaggtttgtatgaagcaaatagaggtgggcaaaaaaaaatgagctccatctgagatagtaagataactttattcccatacaatacctgtgttttcattaccaaagtagcttgtgttttatattatcagatagaccttctagtaacagtatcaaattttttgcagataaggtaattccgatttaagtgacactttttttttttaaacttggcagtatttgactacagtcattccttatgagaaaaaaaacggaccaccgtctgttgaagatcttcaaatattaacaaaaagtgagcaaagacaaaatgaaactattacctgatttccttttgctgattggtaaacacctgactttagttggctgattttgttgttagtgttttgtcagtttaggatgtaaatgatgcatataattgtttatttttataagaatgaagccaaaaatggctgtgacattaaatacaacagtaactctagtgttgatttgtactttttctgtttttcttaccttgtgaaatatttatgagctaaaattttgggaaaaagcataacctaaatctccatcatctcttacatgtttaagaacatatccatttatcataaataaaattccttatggatcttatatatctatgattgtcagtaactgaataggaaagatttacggtaaacactttttatttcttatgaatgtagaacccgaggtagtagttataggtagaacataaattgacagtgatgttttaagaacatgcattcattcagcaaatatttagtgaaggcctactctgtaccaggccatgatctgggcacttgggatactttagtgaacaaagcagacaaagataatgcaccttcaaggggcttgccttaaaaaaaaaattgttagatttaaatatacatgatattgagtatctcttatgatggccgcaaatgagccttgaattctggttctatccctgttattttcagggatatccttggaagttacttactctcttttgcttacattgaaaaactaggataaaaaatatttgttctatttacctcacagtaaatagattaatatatgtatgattttggctaagttactatcaattagccgttaaaatggagggattgaatttgctgatctgttaggtctttgttatggtaaatatttatgatacttgctaattaggggggaaccaaatgaaagagcatcacatggatgagtatggatgatgatacttattttggaaatttaagaggaatgggcaaggaaaacctaagagtagaagcaagtgtcttatttcttagctccctgcctgctaacttggagcttttattctttcctttggtgaataattctttaaaaattttatatttaaatatggataaatcaagtgatgccagccagtctgaaataaaaaatcaagagattaactgggtagctagccctcttattttcaggaagaacttaagttatatgtgtccaagatcacacagggggatggttagttacagagctggatctcttaattcccaggcaattatacttttaatgatgctggtttttggtatgtgattttatttagaagttagaaaaaattttaaacatgattggaagcagaaatactgaacatggtagccctctaaagaagggaacataaatattgctcataagccaggaattactggcaggcctcagcttctcagatcaagaacaaatacttcattggtcaaactaaagtcatcataattccagcatcgagatgtctttataggttgtcacagtttggaatctctggacatatttgggtccaaagctccttttctttccaaaagaagagccctgtggagacagtcacagtgtttatggatatatagtcttcctgataaaagctattaggggattttgggtgcaataataatagttaataaaaatttaaataatttgagtagtgttagttacagttaatacatagcatgtactatgtgccaggcactatgatatgacctttatatctgaattagtagcttagtcctcataacaaacctttgagattaaatctaattattattctcatttcacagatgaagagcttggtgcaaaagtggttaagtagcttgctcagcgtcacacaattaggaagtggcagagccagggtttaaacccaggaaggctgatttgacagttacactattttgccttgtcgtattggtggggaaaaacagtgaaatatttttaccaggatgctttggagaaaatttgagttggcaatctctgttaaagtataatatttgtgagtttatctcaacctgaatggtctagcttaaaaaagaaaaacgttatactaggtggctgctttttctattttagtttttacttagaagataaatttgtcaaattagaatgaggctaattctcccaggtttctccctagtgcagaggaggcaacagccaggcagatgcccgatgctgcttcatggaagtctgttcttcatttgggtcttttctttgaaagtttctaaggagtctgacaggatacgcttgttggagggtatagctgtccatttctttaagagtttctctagtttgcttgatctgcagcactgaggttttcttgctgcacagagttcattgaggtgcacattatagtaacccactttccggtattattacagagcgaaggctccttgtaaataacccagttcctctttttttgtctccactgtttggaaattttaaatcagggaagcaactctcaggtaagtgggatattcttaccgaaaataaattcttgtggacttactccactaaaataaattattgggcctttattgttgtatccccttatcaggaaaatcacctataatttgtatgagtcagttatatcctataattaaggaagattaaggccacaatgattgaaattaaataatatttttgatctaaatttttaattgttgtcttttttcccctcttctattttgcagttcttcgtgccatgaaggaggacagtgaaaaagttccgagcttgttaactgattatattctgaaaggtgagttttataatggtataggtgcgatggctgggaggtttggattagtcagtaaatacatcgccttgctaatacattagacagtaacttcccaatgcacaactttcattaatcttattatgcagggtgaggattagctacatgactgacttctaccaacattatatatcatggttttatataatttaagttttattggaggttctgggttggaaataatctccacagttaaactataaacatcaagagaggtagtagaagaaaattagtgagatggcaccataatcatgtgggtatcagatgttggcagattggcactgggaaatttgagaagggtggtctctgtcatcttgaggacagtggaaaggaggacagatcattagtgaggacggatgaaggaaggaagagtcacatctgtgaacagtgccaaagggaatacgaaagggactgatgtaagacacagggagggaagcggggaaataaaaagaatggacttgcataaacccaggaaagtgaaaaagcagccacaaatcttagaggcaaggtgaggctcacacagggtgggaatattgatgaggcaaaagaagagtgagaggttgagttgctttgccgagaaaagagcaaagtttggatgataaagaagggacggaagaacttaattagaggcaaaattaatactttacgatgaaatatttttttaaagtagcaggtattcagggaccagattttgaaagcatcacaaaatgcatctttgtagtgtttgatcaaattttgagagcaatcctcttctagtaacagtcttcttctctgggttctctctcttctccattaaagttagctgagcacaaggaagatgaagatttctgagacattagaaacctctgatggtcttttcttaaaccatagtgtcatgaaaggggaacctcagtagtatacacagggtgctcaaagtgaatcacacatttcacttgtaagagtcttgatgcggtgagagtaagaagcatgagctagacactagtgggttgacactggagtagaacagactgagttgacatcattttaaaaaataagctttttttctgatggaggactttttctccctataaaattctgaaaaattttttttttaatacctgacatctttgtttgcttttgtgttgtgctagcattggtatgaaagctggattgttctgaggttcgttcttctagatgtgaaacaggaatgagacgaacataaagaacatgtcttaaattttaattatatcgggttcctaggcctctatgagggccagagatagaatgagcttctgaagcattctctagctattttagcatttaactgcatggaaggatgttatgacccaaagaacagagtcctctggggaaaaatgatttttaattctttactctgaaaacctaggactataattgtgaacctacctataccgcatgccttagggaagcagcacccatctaattctgctcctcatgctcgggccgctggctcctgtctgtaagcccagttctatctatactgtacctgcttctgatgagctgtctgtgtgcatgtgttgtggttttgtcttggctttgtattgtgaggactgggtggaaaagcagcaaggatttagactacagtggagactgtagtcagagaaaatgaagacgggagtgcaatgtggagatgtatttacccaaatgtgtgtgggaaggtggggaagtcgggtcattgaaaatgctcttttccacccatcctgaaagttcacagctggttaactgttcctcttccttggggaccaataatacgacactttgcccgggagggggatattgctcaaggggagaatactccttccccttttttgggtggtttgttgttgttttaacacagatgagagtgtggcttggctgcctaaatacaccacttagttttaatgcaaatgtcagaagtgaaagaaggtagaaaagtggtctcatttggcctgagaaaagggagtagggtgggcactgtatgggctaattgagcttctctttctcgcacctgcctaatgaccccactgcagcctgccgccactgctgccttgacagtagtacccaaggctgattctgaagtaatgtacgcgtggctgctgccgtgctgctagttaggaataaaaatgtgtgcagaaacttgcacccttctttgacttccctagggatcctgtttgttgtgtcacaagcctcatggtatagggcgaatgttaggggcttctatctccaagtggcaccctaagagacatggccttttggtatctcatttctgggaaattctaatgtgtgttgagagaactcatccttgttgggtatagcctcttaaaacctttaaaaaattgctacatagatctttgcattaacatttagttctcattacttaatggtttttaaatgtacatgtaaaatgtatgttttgtgtaaatgtatacaaaatatacatttgtagctaaaagttctctttttcttctagttctgtgtcctacatagagcagcaactttatctgcggtgggctccaagctagatttccgacagcattattctgagagctggctaccattacccttcttgctattggaaactcagcacatttgaacttgggtttgattcagtattaacagatcttgactacactaattctttatattatagaaccaacggaaatatgggcactattttgaattctagagatggtttttgttaaatctactaataaactgttctcttagtagattaagagagagtaatattaattgtgcatgtgcagttgtatttctcattaactgacagtatgcccatttgtttttatggctttcttatctaaactgcactgatgaactagattaaagccttgggagatttatactataaattcagtgatggcaagaaccaacactgtttttttgtgagaattgtcagtgtaactattacctaccagtattgttcagagagattgaaacagaataaacgggctgttcttgaagaagcaaaaccagaatatgcattactttggtttaatacttagtgctaacattgaaactgttggtggtgatggattttgtagcttgctgcttgtttcaccactggtcaaattttaaccattaaattgccattcacttttagaatcttgtatttaagttttgattttcaaatgttctgcttcatgtgtctgtgaagaattgtactttaagtgtgtgtcctctgaggtgcttgagaaagtgtacactgcagaactgcccattctcattactgtgtcctattttattcatgcctgtgtgtttttcttaagtatgaattctagatacagctacttatggattcatcaatatcatgagcacttttgctggttccagtcaaatcaatggcatttaataaattttttaagaagtaaaaatacatgtttgagagccttatatttgggagttttgtgttgtattttttttttccttacagtgctagattctttcccttaattccacacagaacccatcgctacaatatgtgagcagatgaaaccctgattagtcccagaatgctacgaaggggaagaggaggacgtttattagagtatgctgagctgctgtggaatgacagaagtaagtcctgctctttttctggggctgtgagacatttcaaaaacagccatgcagacccctcccatagacgacatgaatgaattaagagtctatataggacctgctacaggcggctttcacaattccacttaaacacctgtgagcaaaacaaacagggctaacatattcctcactccactcagcaactgagacaccatgactgcaaaggcaggggcgcggtttgaagtttaatgcctgcttggcatttcagccatcatctctaggggtatgagaaactcgagatggtttccttgttttattaatgttcttatttggaacttactggccctttccccagatacatgtacttacacagtaatattaataatttaaattaatttgaatttgtaaaaatgacgccttgtactgaagaaatgtagctttaaagggtatatgatatagtagaaagtccttagggggatatatttttttaaaggagattcaacattggtctgtttatagctcattcttaaattgatgcttctaaaatgtatgaaaatatacctatttattttttcctgtcagctcaaaaagtctctttgcagttaggcttcccctgatcgtgctcggtaaagtctttcttcttcagcatcgaaccactgtaggatttcccaccacagtcctcctgtgcgtagcaagttaattttgataccagctatgagcacgtttctgacagcaggtaggtttcttgtctccctaaaaacagcatcgctattctctgtactctgggagacacttttctttttgcaaggataccttgggaaagacccgcctaatgacaaaagcacgggacttcttgttacaccaggggttcattggactgataaccttaaaagtctttcggatctcagagatggaatctttttgcaagttacactgtgtgatttcaactcaaaatgtttatttcctgccaagaatcaagttgcagataattctcttacagcttttttgaagaaaacaaaaacaaactgtagaactatgatgcactccaagtgccatatatctattttattcttcaggaaattatatttttcttttacaagagcacaacaggaaccaaagtaaaagagtaatagatacagcactcaggataaatcatatctttaaaataataataaaaaaatttacaccttgtcctatatcctgttagtattttcataatatggccatgattgaaaaaacaaaaagcaagcatctacaattttttttgataaagactttttatgccaggaatggattaattaccaacaaaatttatactaatcaggctgatgtcaatctatttttgtaatgtatcattaacaaatttattttggaaaagataaaaatattgccccttgataataaatctttttttcctttgatgcaaacagctagaacacctttttctttttctttttgatattctaagacaaaaaaatggttaatcttcagattaataaattaggtcattataataataaattaattttttttaaagttcagcaacctctgtccaagtatttacaacaatacttgaaagttcctttacaaaacagaacacattttcttttcacgttaagcatactgggtatctgtgtctttcacaacaagcatttttaaaagaaaactcaatgcacaaatgggttaattagtataaaagtgctaagggctgtttgaaaagttaccactatagtatacagtcagttatatttgaggcatactacaacaaacttccagcttattgtggacaatattccagtagttgtttcaaa

SEQ ID NO: 12459 - DNA, 16645 bp, Human
tgaggcactaaatttaaaattgtattaatttaaatccaaatagccatgtgtctagcaaataatttaggagactgttggtatagctcaggtgatagaattaggacagaagggtgagttgatggatagttaagaggcaaaattatgagtctgtaagggtgtgagaaaaggaaatcaagaacaggctcccagattacagactttgtggttaaacagccaccattactcaggacaacagaagagaaagagcaggtctagagtgtatagtgatttcatcaattttgaacatactggtgtctgagagttatcccagtgggaatatttagtagaaagtttagcttagagagctgtctgaactaaagattcagacttcagaggctttgagccatggagtcagattacctagagaagttgaacaaaattagaagcaaacaagaatcacagcaaatatcaacacataaaaaggggctaaggaagaaaaatctactgagactggagaggaacagttacacaaataggaaaagaaacaagtgagagtggtatagaagtcaagggtagagagaatgtcaggaaggaaacatgatcaaatgtcgaatgcctcagaggtcaaataaagtgagaactgtaaagtgcttcctgactttgccagttaggaggttcttggtgacatctgccagaaaagttttggtggtagcagcctgacagaggtagcttgaagagtggggatggggaaagagaatgtgacaaagaattgagatagtaaggataatttcaatttcaggtcttggctgtgcaaggaagccgagagacatgagtctctaagagggcacgatattgagagggttgttatctttctgtcagcggggaaaccaagagaaaagtttaaaaaggtcaaaagggggagaagggaagacagcttccgggtaacagagaaggttgaccaggtcaatagtaaaggatttcctcaaaccgaagggaggacctctagtgaaatgagaaaggaatacacaattgacccagtttgcaggtgggaaatgggaagccagttctgcaaattggcctttctgttctgtgaagtgccatctgtcggtgaggagagattagggtctgcagcgtgaaaatctggaccatactctgggtaatcaagggagaggttatcggctaatgacaaattaaaggcttactttttagctggcaactgaatcaccataacattttatgttaccagttccaaaattttggggggaattcactcaagcttgggagaggagagatcataactttaagagtataagaggtttaaacggtccactacgaaataaatagagaaggaaaagttatcagctggtaaatatcgtagaaggtagagcggtccagggactcacaggtctcactaaagaaaagtctagcgtaggttcacggcacggagagattttaaggctgcctaagactaaagccaaatacgaagtccacatctgcggtccgcaccttatctctccgcgcggcaggcgcgacgagggcgagaaactccctctccagtggtcgcaccacacgacaccagggaaggggcccctctctccagaccctcatatctccaggtccaggccccattttcctccgctgacagctcagcagcgtgcgcttccgctggattcaggccaggaccagcgaagccgcaccttacacccaccgaggaggaaacaagcctggccacccgaggctaccccgctaggccgcgggtagtgggggagggggcgctgaggcaggaggtcagcacccgggcgcgggctcccgccccacgaaaagcgcgcgctccaagccccgccgccggagatgcggttccggtccggacgcctgcgcactacggctctccccgcagcctctggccctccttccccctcccccagtcagggcgcacccttgcgcctgcgctgtgtgtgttcctggtctgcggcagccatgctgaactcgtatggagaggcgagtgggggggacagagtccaggactgcgggataggaagctggggatatggacaagcagcagcgttatagcgctctgggtttcgggacataggcctgggccatgcggcccccttggccccttggcgcgacccccaggaacgttcggaaagctggtcctcgtggctgggggaaaggcggggggtgggggggaagcgggcacgtgaccccggtcagccaatctgggtgctgctgacgtacgcgcgcggccccgatgctctccccacccccccagcccgttcgggaagggaggggctgggggctacgccccatcccccagcacggcttcgttttctgggggggggttgacaccccggattacataccccgtaccaagccgagggcaactttggaggccccctggaaggctttaggatccaggtgagaaggggcccttgtggggcggagatgtcagtcaagtgcttaaccaatggtggggagtccgggaggggattcttggggttcaggaaagaatcctgagagtgggaagatttgtccttcaaaccttttacagccaatgggagcgtggagggggggcgagcgggagagggccatggggggggaggggaatggccagcctcatgcctccgtacccattggagggcaaaggggttagggggcggtgtggccccccctattccattcgtcccctgggggtacagcagccgggagccaggtgagaagggatccatcggcggccgagggaggggtgacctggcggtgggctgaggagtggtggctgtggcccctacccgtggatgtgaatgctttaggagttggccacccatgttgtgaactgaggttgttcccaggcgccaacttcctttctccccagagcctctggagggagcattgctgtgcgccctttgtgtccgcggtaggggagctccagtcgtcacaccgcaggctggaggttacgcttcgagtcgcttaccgaatttgtgtgcattcacgtggacacggcctgtggggccttttgcccctgtagggtctttactgagcacgtgtctactccaggctggggtgcttacaagctgaaagcttgaggtctgcttaggaacagaaaccaggcccaaggtgggtgctggcagtagggggtctagacagcatggtctgagatgcgagggaggctcgggacctggaatgatttcacagctcccaaggtttcgggtttctccagggtggcctcttccatcgcctccctcatcccctcccccagtcctgaacagttctctccttgtgtactgcgggggagggaacggaaaggaggaaagagttactttcccaaattactgagtagcagtagcctccctggtgactcatgtgggggaagggaggatagaggatcgggaggcagtgattttccggaatgcagggaataaacgagagcaatgtctggctgcccttttcctaaggcctagtattttctcagcctcctaagtttttattccatggccggccccctgatgggcctctgtcctggcctgcagagccccggtggagaaaagcagatttgggaggttgggccgctagggggaggggaaaaggcctctgcaaagttgctgtgtcattgccctccatgctgcagccacccaaacggggccgcttgtacttttgggggccagggcctgatccctggctgggggaaggggactctgctctcctgacgctcattttcccccgccctcccggggtttgccctactcggggggtcagaagacaggagattggcggccattttagacgcagtaaccgaggttggagttgaagggctactgcagaggagggagggtggcgtggttgcagctcaaggacctaggcccttacgagcccttcccgggcgagggggaatcttaccgtatatttgttcacctacgttgattatttttcccagatacgtacacaagtttgttttctccctggtagcgaagaaaggggaaacgggggaggggacgccccaccaaagcccaggttttctcgggtgggggagatcctttcactctcttgtaagggggcggggacggccccagagatgctctggagatcctgactctgggctctggttgattcacagagtctgcacccttatttagataaccaagttaggaggaagacttaagagtaagttggggggagggggcgaaactgagctcccaaaatggctcctgcccctcctcggaggcggacggccggggggaggggaggaggggaggagggggagggctagtctgagccgcagccgccgcctcctccgctcgccctcctccctggcgctgaccgatggaccagccgctccgtggggaggactccggaccctggtgggggggcgggggggttctttcgcccccgtggcggagggcccctgagaggcggatacgggtgtgcctttgggggtgatgtggcgtgtggggggaaaggtccgagctcgcctggagggggagggtttttcccttaagtcatccctcccaggacttgctttttctgctctgagccggacgccggaatggagtttgaggaagaggtgaggtgtgttgcattgtatagggtagatggatgcgtttggagattttaatcccacttttagggttgccgaggatttttcgaacgagcagaaatgtattggtaactgtaggtgtgagtggggagggattagaaaggtgcttggacgtgcaaatttgggagacgtattttagcttttgtggtctttgggactaaacagtagtaaataatgttttgctcgtctttccatcgtttggcttgagggagggagtggagtattataagactctggcaacactgttttagactgtggggcatgggaacgttagatcccctcatcgccgttctgaagcccgtagctgttcgccatagaggagcaggccgcggcttctaagatggcgtctttttcctcgtttcagattcttcgctgctgctgccttaccgccgagaaccaccacccgccaggcgtcttgcggccacacccctggcgggttcaggcaggctacgcccacgcgacccctcccgtttccctgctttggccaatggaggagctacgaatggcacgacctgctcgagcttggcagtctccagttgggctgtgcatggaagcttgggaagactttgttggaaggggaggcggggagagagtgctggaggctctggggcgatggcttccgcacctcttccaaccaccctctttccctggagtcggcggaccacagctcagccaattggcttggagatgtggcgggttgccacttccctgtgggtctctgcggcactcttctgcctggtgactgacaccttggaaatgaagtttatgacgtcatcgttgcggctggccaatagaaaaagctcccgcggagaggtgttccttccccttcgactcagcttcttcacccgcgtgagcgagcgcgcgcgcgcggagggggtggggaaaatctcaagcagggtggcgcgcatgagcggcgaagctcctcctccccgcctatatataaagggctggcgcggggctcggcggcgccatttcgtgctggagtggagcagcctctagaacgagctggaggattctgcctaccgatacagagccttcgagtcgtccggggccgccattacaatccacctccatccgcttggaaatggccttcgtcccggcctatgactggtcccagcgggcagtacagaccccctagaagcccctggagctcccctttttcgggccccgcccaatcctcggagtctgtccaccccctctactccgccctcaagaggatttcaaagatggaggcggcggctccctaaaccacttttcgtgttcatccgcctccatccgagatcgaaacgggacctcgtcggccccgtaggggcccgacaagaagagggaatccctgcagaccaacagcgggctatattgacgacggtgtctgagatcggggaccgtcttttgaagagtcagtccctccttagttgcccgcctcagctgaggccgccgccattttcttgctgtccgccgtctgcagagcgcgccaagctgcccggagctctccgagaggccccaaagagactgctttcgtgccggccaggcagggggtttgtcgcctggaggcccaagaggaacggcctccccccaacttagcgggttatgctggaccgggcggtgaggggaaccgaggccacccggactttccgcggctgagggcagcgccggttccttgcggtcaagatgctgcaaaacgtgactccccacaataagtacgtttccgcgagccgcgtgtgggaaggggatgttgcagggcggcggcacaggggtgtggggcgccgtgttgggagtactgagcggccccggcgcgctgctgttgcggcgcagctgtcgactcggtcgcgcggagggaattgagcgacggttttggaacggtggtggcggctcggctactgctcgtggaggggaatacaggttgtcaatttatacgctattaatgccgccgtggcccagtcttaaccgagtcaggcagagctagtttgacggtggagtggagtgaggttgaacagcaggtttggcgtttggtgggtctggtatctagcggcggtctgttagccttttaggggggattcacggacacctctagcgccctgtagggttgccatggtgacggagcgcttaagggactggcaacggggattcccagagaagggtaaagggatcactctcccgtgtgtgcaggttcctaatgcccagggcatgtcattaaatcttttgctttctttgggtgggtgggttgtgtgtggtgtttgttggtgcagggattgttttttcctaacattaaaagtttgattcagggcaggagggtagagctaaggttcctagttcagctctgcgatgtaaacaatgagattcccatatgatgttttaattcttaggtggtaggaaagactgatcggaggagcaccagagggactgtaaatgaaccactgttagcgtttggtgtccggagttggtgctacagggggaactggtagtggaatcgtgttgtgtagtgggtgggtggaagggggctatcacttggtgaccttgactgttttgtacggctttttgacttccttggagtgaggagactctgatttggtgcgaataattttgagggcctggaagttacgggctgtgaagtctgacaaattcttccttgtctgaatttgtttttaagttgatatggttcttcctctgggtttctagtctatgttctgttgtggcgtgaactacccagaccttgtggaagatggtgctctctcttctatctaggtggattattctgtgtcttatcagcattttatggaattttttatagccataatttgttcttttcctccttaccggcgctcaaccaccatggcaaccaccaaacccctagtgaggaggaagcttggggtttgagtttcttaactccacccattttgcttaagccccatccccatagggctgtagttctgagatgtcgtgccttgtcagaaacaatttgggagttttttaaaatatgaaaaagaacagatagagcctatcagacttaagaaggtgggatctagatagtatactaaaaatattaataaaaggaaggcggggccagcaataaaagctccacagattgtttggatattgtttctgcttaagaagcacttggcataagcttaaccacctcactagggccagcacctggattcatcagactattgtgcagatgcactttttcctcatttggacgatattgccctaattttgttcccatctttacaggctccctggggaagggaatgcagggttgctggggctgggcccagaagcagcagcaccagggaagaggattcgaaaaccctctctcttgtatgagggctttgagagccccacaatggcttcggtgcctgctttgcaacttacccctgccaacccaccacccccggaggtgtccaatcccaaaaagccaggacgagttaccaaccagctgcaatacctacacaaggtagtgatgaaggctctgtggaaacatcagttcgcatggccattccggcagcctgtggatgctgtcaaactgggtctaccggtgagtagagacattggagccggggaggtgtgggatgagcaagaatgcgtgtgaatgggggtggtctgcctagtgtagatgctgcggcccctagggagttcccatttctcccctgtagggcagttagctaccagatttctgggtatcttggtcctttgtgattgatccgaccgcttgctgtaactatcttggcatctttccttgtgccctccatgtgtccttccttaacttttgtgccctggctccattttacagattcccacctcgggttgggagaggaccacggtggccaaaattcttagcttcttcctttccctcatgcagcccatggatagccagccccagaggtaatgtcacaggatgggaagtttccagagtgggtgggaggtgggtggttagagaaaggcagcaggggcctccctgtggatgtcaagaatcttttttatttatttatttattttgtcccacagtttaattggggccgcagtttaagtaactgttcctttgatgcatagggggtgtgtgtgtgtgtgtgtgtgtgtgtgagagtcggggatcggtagtctccctataagcatttatttttctgtggttctgacctaacatttctttatttaggattatcacaaaattataaaacagcctatggacatgggtactattaagaggagacttgaaaacaattattattgggctgcttcagagtgtatgcaagattttaataccatgttcaccaactgttacatttacaacaaggtgagtttttctgtgtgttcatttagtaggtggggagaaacagtaacttctattattgctggatatgttgtctacataaagtttaaatcctttgctactgaaggtgttatccaggtagggtagtcggagtcttaaaaacctgactctagatggtactattgaacacagtgatgtgacttcagagctctagttgaaggttatttagaacacttcatacttgggggtggtggtcctgtttcttagaaatcaccagagacctgagtagaccagggatctgttttcttgtcagctctcaagttttttcttctttcgaattttgggagacagttaggagaaagtggaaattagtagtggcctggagtaggaaattttctttaagatttgatgacaagatgactggtgggggtatggtaatggcctagggcctgaatgcctctgagaaagatggtgtgtatctatcttctgttggcattttttaactttctttattgctgtctgtgttctcatagcccactgatgatattgtcctaatggcacaaacgctggaaaagatattcctacagaaggttgcatcaatgccacaagaagaacaagagctggtagtgaccatccctaagaacagccacaagaagggggccaagttggcaggtaggaagagtgggagttttgcaaatggacaactaaagatggggaagagaatcaaactacacttttttccttttttctagcgctccagggcagtgttaccagtgcccatcaggtgcctgccgtctcttctgtgtcacacacagccctgtatactcctccacctgagatacctaccactgtcctcaacattccccacccatcagtcatttcctctccacttctcaagtccttgcactctgctggacccccgctccttgctgttactgcagctcctccagcccagccccttgccaaggtatgatctgtggatttcctctgggcagcagggaggcaagggtcttaagtaaagtgggcttggagtgacaggttccctatcttgtttctttctgcagaaaaaaggcgtaaagcggaaagcagatactaccacccctacacctacagccatcttggctcctggttctccagctagccctcctgggagtcttgagcctaaggcagcacggcttccccctatgcgtagagagagtggtcgccccatcaagcccccacgcaaagacttgcctgactctcagcaacaacaccagagctctaagaaaggaaagctttcagaacagttaaaacattgcaatggcattttgaaggagttactctctaagaagcatgctgcctatgcttggcctttctataaaccagtggatgcttctgcacttggcctgcatgactaccatgacatcattaagcaccccatggacctcagcactgtcaaggtacccactgcatggggcagatgggatgctcaggcagtgatgggagcctaggtgcaaaacaataagtctccttatgtgggcacacagcagtctttggttcttggcattttacttttataaaataatagtggaacagaaggtctggtgttttgagaatttgtatttcttggagtttgaaacagtagggtggggtttctttgtcttgagaaaaatactgtctataattaagtactaatgtggcagtgttgggttaaggaagttatagggtggaaagacaggcataggccacctctctgtcacttagaaatgatttctttttctagacataaatatttcttcaacccacccaaattcctttgacttcaaacttgaaccccagggcacagatccttaaggtcatccccactgtgctctcaagagagggctcttcttgtggtgtctggggttggcagggaaaggtgagtcttcctgcctgtgcagcttctgatgctgcctccttctgcagcggaagatggagaaccgtgattaccgggatgcacaggagtttgctgctgatgtacggcttatgttctccaactgctataagtacaatcccccagatcacgatgttgtggcaatggcacgaaagctacaggtgagtggaaaggttggagtttgaaaaataaatggtatggggagttattttgtcatgtgtgctgcatagcctcaacgtgagggtctcactgttctgtacagttgtaaattggagctatatcacttggtggctgggtatgtagggcactgtttatcagcatagttttgagtttgtgcctctttctaggatgtatttgagttccgttatgccaagatgccagatgaaccactagaaccagggcctttaccagtctctactgccatgccccctggcttggccaaatcgtcttcagagtcctccagtgaggaaagtagcagtgagagctcctctgaggaagaggaggaggaagatgaggaggacgaggaggaagaagagagtgaaagctcagactcagaggaagaaagggctcatcgcttagcagaactacaggaacaggtattttgtcactcttgaaagtttttattgggtaagaggttcatgccctttgtcctcattttttcttcttgttattttatctttatttactttttccacttcatgttttttttcctttagcttcgggcagtacatgaacaactggctgctctgtcccagggtccaatatccaagcccaagaggaaaagagagaaaaaagagaaaaagaagaaacggaaggcagagaagcatcgaggccgagctggggccgatgaagatgacaaggggcctagggcaccccgcccacctcaacctaagaagtccaagaaagcaagtggcagtgggggtggcagtgctgctttaggcccttctggctttggaccttctggaggaagtggcaccaagtgagttagagtaggaagcagagactagtttggctatttctgtctctctgggggatgccatctctctttgcaaagataattctaaatggccagttaacagatacaataggctttgagcagtggtccccaacctttttggcaccagggaccagtttcgtggaagacagattttaccacagacagggtttgaggggatggtttttgggatgaaactgttccacctcagatcattgggccattggattcccataaggagcatgcagcctggatatgtaccatgcgcacttcacagtagggttcatgcttctatgagaatctaatgcttctgctgatgtgacaggcagtgatgcccacatgccggctgttcacctcctgcgtagcccagtaacaggccacggactggtactggtctgggggttgggacccctggctttgggagtcagggtgtttcacagctactctgacagtgaactcaaagtagccataaactagaaacatgaagatggctgtgttccaaaaagactttatttgcaaagacacgtggcgatcagatttgttctctgggccatatagtttgcctgttgctctaaatcaatgagtctagacttgtttttcatggcgtagtagtttttggttttttggtgtggttttgtgttttgtttttttttgttagtttttttttgttttgttttttttaaagactccaggctggagtgcagtggcgtgatctcggcttactgcaacctccacttctcgggttcaagcgattctcctgcctcagcctcccaagtagccaggattacaggcatgcgccaccacgcccagctaatttttgtatttttagtgcgcagctagtttatgtagttttagtggagacggggtttcgccatgttgggcaggctggtcttgaactcctgacctcaagtgatctgcccgccttggcctcccaaagtgctgggattacaaatctgagccactgcagctggcccatggtgtagtttggtagtgtttaagggagcagaaagacccatgtcagtatacctaaacaggtataccttgttttattgtgcttcactttacggagttttttttagatactacttttttttttagttgaagatttgtgacaaccctgtgtggagcaagtctttcaacagtttttccaacatgtttgtgtgtcacatttttagtaatattttttcattaaggtatgtacgtacattgtctttttaaagacatgttattgcctacttacagtcaagagcaaaatgctctgtttcactatacagtgtcccagtagcccacctcttacttggccattgaatggaaaaacagaagctccactctgggcaggaaataggatcactgaattataacagtgggaacatactggaagaggttaatgaagcttcttttgctgacaactctttttgcccttaggctccccaaaaaggccacaaagacagccccacctgccctgcctacaggttatgattcagaggaggaggaagagagcaggcccatgagttacgatgagaagcggcagctgagcctggacatcaacaaattacctggggagaagctgggccgagttgtgcatataatccaagccagggagccctctttacgtgattcaaacccagaagagattgagattgattttgaaacactcaagccatccacacttagagagcttgagcgctatgtcctttcctgcctacgtaagaaaccccggaagccctacagtacgtatgaaatgaggttcatctcatggttctgaggacagttgaggaaagatggtggggtctgtttgcattcaggattgtcagctcccaggataatgggatgtgttggttggcagctgacgttcaagaagggaacttgggaaccttaggggcccataataagatgcttggggcaatcttaatgtatcctgataaatttctttcattagccattaagaagcctgtgggaaagacaaaggaggaactggctttggagaaaaagcgggaattagaaaagcggttacaagatgtcagcggacagctcaattctactaaaaagccccccaagaaaggtgagtatatactttcatgccactacagattgactccatcctgccttcttgactgtcttttattgacaaatgaagattcagacttgaacgtctttaactttcgaatttgttctgcagcgaatgagaaaacagagtcatcctctgcacagcaagtagcagtgtcacgccttagcgcttccagctccagctcagattccagctcctcctcttcctcgtcgtcgtcttcagacaccagtgattcagactcaggctaaggggtcaggccagatggggcaggaaggctccgcaggaccggacccctagaccaccctgccccacctgccccttccccctttgctgtgacacttcttcatctcacccccccctgcccccctctaggagagctggctctgcagtgggggagggatgcagggacatttactgaaggagggacatggacaaaacaacattgaattcccagccccattggggagtgatctcttggacacagagcccccattcaaaatggggcagggcaagggtgggagtgtgcaaagccctgatctggagttacctgaggccatagctgccctattcacttctaagggccctgttttgagattgtttgttctaatttattttaagctaggtaaggctggggggagggtggggccgtggtcccctcagcctccatggggagggaagaagggggagctctttttttacgttgatttttttttttctactctgttttccctttttccttccgctccatttggggccctgggggtttcagtcatctccccatttggtcccctggactgtctttgttgattctaacttgtaaataaagaaaatattattcaagttttgagttaccttaatatttgcttttgtagtgtttcaaaaggaacatcataagaattgtcttgataattttgagggaaatattactgcagtgagaaaaggcaatagctaacctataattggattgtcttaatttttaaaccagtaggcttttgctgtgtttttaataaagtaaatatgacttttgtaaattgagtccttagaagtaatctttaggtctacaatttgctcttgtttaaatgaaaaatagtactgtggctcattcatgctttaaccaagaactcaaaattttgaggtaggctttaggtttttccctgtggcactggatgtgtgaattttctcctgagcagacttaaaatatgagaaaagggtgggaggtagccgaacataagtactttatgcattgagtttattgccttttaaaaggaaattggcctgtaatcccagcactttgggaggccgaggcgggcagatcacgaggtcaggagatcgagaccatggtgaaaccctgtctactaaaaaaaaattagctgggcgaggtggcgggtacctgtagtcccagctactcgggaggctgaggcagcagaatggcgtgaactcgggaggcggggttcagtgagccgagatcgcgccactgcactccagcctgggtggtagacactccgtctcaaaaaaaaaagtaattgggcctactacattgttaaacattgttaaattttgctgccatggtcacacacaaatttacagatagtttattagtagaatactaaagagtattccaacgattaaatcacaaaactgtgctttctgcatacccccttgtcttgctaaggggagagaagggttgtataaaaagtttagggggttgggatgtgtgcattctggaatttggggctttaatactggaaaagtgagacatttgcttagtatagtgtaccatagtaggaaacctggatagagacgtggaaattagaatcaggaatgtagtaaagcaaatggtttattttgctgtaaatgacaccacaaactaagtgtagggcaacaccacaaactaaatgtaggaagcaataaattttactagtgatgctcagccctctttaggaattccggctaaactggggcttgagcaacaattttcaaaagctcgggagatggtaataaaaaattaggtttgtgaaccacctgctactgtttgccaagcacttagagggaaacaaacccttgtttgggctttcttgctaacttgtgtgcaccagtgaaagctcttgagctccctttgagctctggttcccttttgagaataacagatgttgaggattcgtaagtacttaatagagacgcgttgggcaataggtgatgagatacaaattaaagttctgaaaatcggagtaaatagatttaagctaagtgcatgtctatgtcaaggattacatctcatttcagagggaattgaaggatttagttggattagttttgggacaaaatatagaatattttgtctgactgcagccccttctgctcatgtacttttaaggtttgttttctgtagttcggaaaaataaaagtttcaacctgacattggaggcccctgagtacttaattccctgtaaatggaacccagaccgccctaaatgctttaagagagagaagggctggctgacacaggggcttcagacctgccttaaaccaattggactagtctcttaattgactttagtttgaacttatttcaagcctgtctcacttagggattgtaattgtttcaggagtttggttgagttccatcttggttgccaaaggactttattccaaaatagcagtctccagcacaactcaaaggactagtggagtcctgtgggcattatttccccctatgctcctctcagctcttggaatcatgggttctattgctgctgctttttccctctcccctcatgctgccatttactgccttttattgcgtccataggaagccttttgttgggttgtggggg

SEQ ID NO: 12460 - DNA, 3919 bp, Human
cagcaatagttcttggtggcatattagctggttaagatttagctaggcccacctaagaaggactaaatgatctaggatgtgtgacttgtggaagagaaaaagggatgttccttttctctcatttggcatcctaaccatttgcctcttttctttctccacactacccccatgccctatattcacacaacctgtggctctggaccaggtggagagatggaaccgccatgatcagaagctgctggaggcagtgcacaggggggatgtgggacgcgtggctgccctggcctccaggaaatctgcccgacccaccaagcttgactcgaatggccagtccccgtaagtcagtcctcctgcccctgccccttacatgtggctcccttttgaagcccccaaatccaatataacataggaccagggaatgcctacaacttcagagctcttttcattgtcttaattagcaagtatatcaatagttttttgctacatataagttctacacaaagtgaggaaagaaaatattgttcctgagctccatccattgcacaacccagattgacaccactgacttgtaaagtacataaagcccattaaacaaacagaaaatgaatatatacactaagtagagtgtttcttcattgcacaagtaggagggtgtgtatgcatgggaaatttgaaatgaagtggtagcatgggagtcacatggctagagggagtagtgattaagtcaaaggaaatgttatcccttgtctctacccaaagccttcgaatgtccagccttcactctgctctggctgactctttctgtgacacttccacttccgctaaggttctgtgctcagagaggcaggtaattatgtgttccctagacacccctgcaatagtctgagattccttgagacctgtagctcttatttcttccttgcttttagcatcctttgtgattggaggccatatagacttctctttctcagaaattcaagctaggggagcttcttttcctgcttttaggattggctttggggtagggagcatagcaagaagggcttatcaagattctcccattcctcatccctggtccctttatcctttggcctctcggccttgattctggcaggtttcatctggcagcctccaaaggcctgacagaatgtctgactatcctgcttgcaaatggggctgacatcaacagcaagaatgaggatggtgagtgagccggagcactgggccacgctgcttgcttgcccctggtacagcagcagtcgggggcggtgctgggccctgctggacattcctactgtggccccttgcttctctccttagtaagttctggccagcatccttccaggagttcccctccccgtaagctgggcacacctcacccccactcccaccttcatcacaggtaccaggcacttggggaacaggaatttctggccccgtgtggctgaaagcttctctccctaatctcctgattatctgtgcgtctcttgccttccctccctgtgagtcatcagcatgcatggggccacctaccctccttctccccttctttctgttccaggaagcactgccctacacttggccaccatctcctgccagccacagtgtgttaaggttctgcttcaggtaagagcagtcccttgataccactcttatgaagggaagaagtggtcccagagttttctaacttcatttcatacttaaaaggaatagttggccaaatgtactcgcctcatccccaataggagggctgataatcatttgtttgccaacatttatttaactactatgtgcaggcaccatgtttgatagtgcctttgagggcaggttataaagcagagttgccaggcactatcgattttgtcattagcagagccactgcagagacttcctgctatgatgaggggcaagaggaaggaggacagagatgttcaaattaaaccaaagccctactgtctgtttctgaagagtttatagtctagtagtataaagagaaatatacatgtaaaatgacatgtggatcatttataaatgagtctccaaaagcacaaaaggcagttactggccgggtgcggtggctcatgcctgtaatcccagactttgggagatggaggtgggcagatcacaagatcaggagatcgagaccatcctggctaacacagtgaaaccccatctctaataaaaatacaaaagattagctgggtgtggtggcacgtgcctgtagtcccagttactcgggaggctgaggcaggagaatcgcttcaacccaggaggcggaggttgcagtgatccaagatcgcaccactgcactccagtctgggcaacagagagagactctgtctcaaaaaaaaaaaaaaaaatcagttatcttaaccggccatcaggcaaatggatgttctactttcgttcttcctaatcctttccaaatttcacaattatgtttctaaagtaccagccacggggacattgggtgtcattttccctaacacgtttattaccatctgatttttcttagccccttggtttagaaaccagggctgatattcaaggctgcctatcatcagcaatggatgaactgggcttgcctagtagatagccttctccaaagtggacctcctgcccctcctcatattaccatggaaattggtgacccaatgggggtatgggatgaggatgttaacaccaagctccatgctgcttccctttgtggccatttgcagcatggtgctaatgaagatgctgtggatgcagaaaaccgtagtccattgcactgggcaggtgtgtgcaggggactcatgggaacagggctgcagagactacagggtgggaaaggggaggcgtgaggagggaagggcagccagggccaaccaatgaaatggtcggaggggatgttgggtcatagtctgagtaggctttcttcatgcttccccttaacccaaacatcttctccccagcctcctctggctgtgcctcaagtgtgctcctgctgtgtgaccacgaagccttcctggacgtgttggataatgtgagtgtcagatgggcaagtgggcagtgtcctacacagaagggctgctgctgtctctcagcttgactggccaacttccatgacctagggctgtgttagcaccacccttctcttccttctcctcctgcttctcctcttcttcctcacagagaggttaagccttatcttctggagagcttctaaccctccaaaagggagtgttcagacccaagatctgggcttttattttttttggacaggtgtgaggggaggggagccggtaggattgtcaagcctctgcagtccctggctgctcatgaacctcttcctacaatctgtgcaggatggacgtacacccctgatgatcgcatcgctgggtgggcacgcagctatctgctcacagctgctgcagcgaggcgcccgagttaatgttacagacaagaatgacaagtgagcccccctcgtctatgcaccccaattcccatgcctgaccaatttagaaagaagccagtgggcaacgtgtgtgtgtgtgtgtttgtgtgtgttggggaagaagtcaggttggtctttgtgttcttgggaacctcattccttcccagtggaggttctgaagagctctgcctgctgccaccaccatcttcatagatagatgaccccagaagtagaatcgacacttctggacccgttggctgaatttactggttgtcaaattatcttttatgcaagaggatccttttttccaataaaaaatgtatgtagaatccctgtgatcccagcactttgggaggccaaggcgggtggatcacgaggtcaagagattgagaccatcctagctaaaatggtgaaaccccatctctactaaaaatacaaaaaattggtcgggcatggtggtgggtgcctgtagtcccagctact

SEQ ID NO: 12461 - DNA, 93920 bp, Human
gcgcccagccaagcattcttaaagataggggtaatttcggaaaagaagaagttacaggtaaagtcataaatcaatacacagaggttatacattggtttgacctaaaaaggggggacatctccaagcaggagcccacaggtcataggtggattcaaagattttctgatttgcgattgataaaagaggtgaagctttgtctaaaaatttcggatcagtagaaaagaatgttagctacagcttgtgggcatgaccttcttcaggaagaagaaacttagagaaaaaacaaaccaccagtcagagttcagtccttagctccccattctctgaggtctatgtgccagcagatccatttggtgggggtctgggtttctaaaaaacaactcagggacatgtgttgatgttatctttagtttttatagggaaccaaacatccagttattttagtttctttggctaatgtttaaagttattactgccctcttgcttatcaaggggttcattaacttttcaaggctagctaagtgccgggaatttctcttgaagtaactcaagattttcctttatttccatggttgagggcctgcaggccctaaaaggggtccctgctccgtctcagctgggcctaggtgaaggtctcttcctttttctgagacggtgtctccgtctgttgcccagactggagtgcagtggcatgctctcgggtcactgcaaccttcgcctcctgcttcagcctccctagtagctgggattacaggcgccagccaccacgcccagcgatttttctgtattttagtagagagggagtttcaccatgttggtcaggatggtctcgaactcctgacctcaggtggtccgcccgcctccgcctcccaaagtgttgggattacaggcgtgagccaccgcacccggcctaaggtctcttccttaaagactgccgttggactgaaaggtgtccaacctagaacagtttcgcacctagccctatccctgttggatgctcattattttttaaaatccaatttaccaagcgtgttcagtcttcagctcgctaatttctctaacggccgtacgtagtcaaactgagaaaactgttcagtgggggcgacaaaagccaacgcccgtgagacaacccccaaatccgtgggtcgatctcacttgtttaataccccaagccctgtccggggggaagaaagacaacctcccgagtccctcaaggcaggtgcttatttgagcttcagatctaaagctgcgaatggacagaacccgcccagtgcagggtggacccgcgagagacagcgccgcgacaagcgttagagagaacgtccgccttgaaaaaaatgtcaccaggcaaacttccagtttcactccgaccagtggcccaaggccttttatcctagttggcagtggtccacacccaaaggctaccccacccagccgctccctcagggtttctccacaccctgtagagcctttcgcacgtctcgagggtgtgacggttacgccgtgacgtcactccagaggaagtggtaagacgagcgcggtaacggagctcttgaagggctgcagccctaacacggagaagcgcgctaagagcctggaggcgggaccaatttatgactgacgtctacccacacccattgcttttctgattccttctcaaacaaaccaatgaatgcgacgacggagacagcagcgtgccccaggcgctagaagtggctctgccccttctactttgctgccctttggtcgccatgcttagtgtggctactgcctctgtgctacttgaggctctcctacggcttttcgatgccttcgatgaacctctacctaagcacttcttccctttcaccgcgaactcctaccttctcgggtttctagcttgctcactttacatccagccacactggagatggcggccggaggcgggcccgaggtggggcgtgaccagcgcagtgacgtcagcgcgctgcgtgtcggcaggtggaggaagaggggaaagtttggcccgtgcgtggggctggggtggagggcgggacagaggggctgggcccaggcaaagcttctgtcgctgctgctgcggaggccgaggacaggacgtgggctgggccgggcagtgccggactcggaggagcaggaggcgaggtccgccggagctctgagcccccgctgctctgccgcgcggtgaccccgcgccccggcgccgtccgacccgtggctgttccgagacgattggtgggggcgcggcggcggcggcggcggctgttgggggtggggagacgcgcggcgaggagacgagcgaggtcagcgagtttgagggaggaccgcgagccgctgccgccgtcatgtccgaggactcgagcgccctgccctggtccatcaacagggacgattacgagctgcaggaggtgatcggtgagagcaggcgctgcggaggggggaggcgcggcgctgggaggcgggggacacgggaacgtggggagccgcgggagctcggggagcgcagccctcataggaattcgtggggcgcttgtggggctgggggcttgtaggacgcttgtgtcgaggagcgcgtgtgagacgggaagggggttttgaggcgcgcgcctgtgaggtggcgtggggtggggtgaggcttgagggggctcaggagagatttgtgtacaggattctcaaatgtgtggacaggagcggcccatgtgtcttgtagagaaagaaagtgcaggtgtgggacaggcctttccgaggctgtgtgagaaatgggatcttgaagtgggcacagccatcgatttctgggattgtgggatagatagggagctttaagtttttcctccatccgtgctggggcgaactggggatcctccaggtgaagctgcaggaaccgcgctgagcaaccgagacccaacttacgactccttccaactgactttccagtcggggaggtagacattaaataagaagacaaaaagaagtaagaagggctgggcgtggtggctcacgcctgtaatcccaccactttgggaggccgaggcgggcggatcacgaggtcgggggttcgagaccagcctggccaatatggtgaaaccccgtctctactaaaaatacaaaaattagttgggtgtggtggtgcgcgcctgtaatcccagctactcgggaggctgaggcagaagaatccttgaacccgggaggcggagcttgcagtgagctgagatcgcgccactgcactccagcctgggcgacaaaccctgactctgactcaaaaaaaaaaaaaaaaaaaaaaaaatttgaagaggctttggcaagtgccatgaaggagataaacaagatgttctgatagagaataacctggagatctacttagggtgatttcaaggaaaattctttttctgaggcgataacatttcagttgagccctgaagcatgagaagtgaggattaagagcctcgggaagatttttccttacagagggatatagagatgcagtggccttgagtaagggaagagcttgatttgttttaggacctgaaggaaggctggcaaggatagagagggaagggaggagccagatcttagggatcttctcagctttggtacagattttggaattttaagtatcactggaggccctcaaatagtgccttgacgtgatccgataaattgggctggtgtgtgaaaagatttgaagggggtccaggaataccagttggcagagaccaaaacttgcacatagattgtaattctcacagaagcctagggattgggaggaggctggggactggggatgaggggagtatttgttggacaacaataacccagtgaccttggaaatcaaaatgtttagctatacaggctcaatccaacggacatgagcagacacctgtgtattggaggaaggcgaattatctgctttgccagcatcctgccctaaaattagttttataacaaagaccaactgaagacttcctagctgccttgggggtgtcagtgtttatttcactgtgggtttaaaaagaacttcgtgaaataatttttgtttttacttgcctcttgttttaagacaatctgggcttaaagcaatattggttcgtataggaaaaacaaaaacaaaacaaaacaactcggactaaataaagacatcacatctttgcttaagccacttcatgggcctgtgtccttgctacatattgggtctttgacatgtattcgttggttctaaagacagctagttcccggtctggactgattgcttctggttcccccagtcagagtttcatattgaaggaaaggattaaatggaagattccaaaatgatgtcagagaagtaaagaggaggttccctatcatcattttaaaagaagagtttttttttttttttctggtagtgtatccatctttctagggtgaagaggatggttgtagtcattctcaaagcctttgctgttaaggtggcagagaatttcagagttgcaaaggcgctagagatttcgtgatttgttaatttggtgtcctcagacccataggatgtctgtgagtgggcaaaagggagtctctcagtcttctggatagggttagtgttcctcacattcacaaagtggtccatggtttttaaaaggttaggaactccaatgtgatttgaccatctttcatagatttaaaacaactttactgaggtataatttaatataaaattcacccattttaagtgtaacatttagtggtttttagtaaattccctgtgtcgtacaactatcaccataatccagttttagaatatttccatcatccccgtgagatctcttgtgctttcttacgagttaatccctttttccacctccagccttagacaaccacaaatctactttttgtctctatggacttgccttttttggacatttatataaatgggatcatataacatgtggtctttcatgtttggtttcttccacttagcataaatattttttcatttaaaaaaacaattttgagatataatttacgtaccataagatttacctgattaaaatgtacaattcaataatcttttagtaaatttacataattgttcagtcatcaccacaatccaattttagaacatttccatcattccagaaagatgcctcatgtccatttgcagttactccctgttcccacccccagccccaggcaatcacaaatatactttctgtctctatagatttgtcctttctggacattttatgtaaatgtaatcatataatatgtggtcctttgtgtttggcttcttttactttccataatgctttttgaggttcatccatctgccatgtagtacatggttcctttttattggataccagttaatgggcattggattgtttctgctttttggctgtttggaacaaggctgctttgagtattcacatcaagtcaccccatgaatatgtttcatttttcttggatgtatacccaggagtggaattgctgggttatatcacaaattcaactgtttaagaaactgccaaactgattttcaaagtaactgtaccattttatgttcctactagtaattataagagttcttgtttctctaaatttgttgtctttttgcgtgtaaccatcctagtgactatgaagtggtatctcattgtggttttgatttgcattgccctaatgactaatgatgatgaacatcctttcatgtccttatttattagactttcatggatcttctttggtgaaatatctattcaaatcttttgtccacttggactgcccattgggttgtttttttttttgtttgtttgtttgttttgagatggagtcttgctctgttgcccaggctggggtgcagtggtgccatctcggctcactgcaacctctgtctcttgagttcaagcaactctcctgcctcagcctcctgagtagctggggttataggtgcctgccaccatgcccagctaatttttgtgtttttagtaatgatggggtttcaccatattgggcaggctggtctcaaactcctgacctcaggtgatccgcctgcttggcctcccaaagtgctgggattacaggggtgagccactgcgcctggctgttcgttttttttttgagttatagaagtgtgtgtatgtgtgtttgtatgtgtattcattctgggtatgcgtcgttcatctgatatatgatttaatttaaatattttcctgtctgtagttttttttttcttctcattttctttctttttttttgagacagtcttactctgtcacctagggtggagtgcagtgtcatgatcagggctcactccacctcctgggctcaagtgatcctcccacccctgcctcccaggtagctgggactacaggtacatgccaccacgtttggctaatttttgtgttttttgtagaaactgggtttcgccacatttcccaggatggtctcaaattcctgatcgctcaagcgatctgcctgcctcagccttccagagtgctaggattacaggcgtgagccactgcgcttagccttctttaattttattattattatttttttttgagttggagtcttactctgtcgcccaggctggagtgcagtggcatgatcttggctcactgcaacctccgcttcctgggttcaagcaattctcctgtctcagcctcccaagtaggtgggattacacatgcgtgccaccacaccaggctaagtttttgtatttttagtagagactgggtttcaccatgttggccaggctggtctcgaactccttacctcagatgatctgcctgcctcggcctcccaaagtgttggggttacaggtgtgagcccccgcgcctggcctctttcattttcttaatggagtcttttaaagtacaaaagttttgaattttgatgtttatcatttttttcttttattgattttgcttttggtgttgtatctaagaaatctttactaacccaacattgtgaagatttttttttcctgtttttttttaagtgttagttttagctcttgcatttaagcctctgatacatactgagttaatttttgtgtatggtgtgaagtaaggtgaaccaccttgttttacagttgaagacacagagacagaaaggtaacatgactgcttaaagccatgtagctaattagaggcagagccaatactggcatctgtgtctcctgtagcctaattcgggatccttgttcctgtatctacattgattcgttcttggatataaactggaagatgggggtcattgtctcacagattaagggaatgatctcccctgcttttttctgagaagggtctcactctgtcacccaggctggaatgtaatcacagctcactgtctcactgtatgaactcctggctcgagtgatcctcttgcctcgtcctccccagtagctggactacaggcatgtgccaccatgcccgcctcattgttttatttttttgtagagacagggtctcatatgttgtccaggctggtctctacttctgggctcaagtgatcctcccaccttagcctcctaaagtgttggggtttacaggtatgaagcactgtgcctggccaagggaagtatctatccttagagtgaaaaaaatctgatggatgttccacacctgtcacgtccttccagtctgctcctgacagcctctctccattttcccaacagggagaaaaaaaattttttttctttgagctacagcctagtataagtagcaagtttcagtaaagcattgtattcttattctaactttgcttccataccaaaatgtttgttacatagtattttataataagctatagtcttcaaaatgaatctttatgatttcagattacactcaactttttcaggaaacacatgattaaaatctagaaaaaagggtttgggatcatttaaattttgttttcaaaggattgtattctagagaaatcagtgtaatggtgtcatctccatcaaaacacgtacatttatttgaactgtaacatgtttatttgaactgtaatttttttcacatttgcttctcagcagtatactatttatgggattgtttctcacattctgttttgttcttcgtctttctggtaaaatcctacagagaacagaatctcctcttaggaacatattaaaagcctatagattgaaaattcaaaggacttttttttttttttaaagaattgtatcaccttaagcatgctttggcaagatttgaagttctttaagtatgattatgtgtaaaagatgttagtatcattctcacaattaatcattgatctttcagtatttttgagcccttagtcttagattagaatttctgagcatgtgttatactgtatttggcatgtgttgaagcagctgtaaaaatttgggctttggggttagactgacccagattcaaatcctgacattgcctcttactagttatgtgatcttagacaaattatatgattagtttccgtgtcagctttttgtctgtatagtggggagaatagtacctatgtcactggggccgttatatagattgagtgtaattatttgtgggaagtgtttagcttgtataaaatgatagttgttattatctctgacttttttttacccttccccttgtcctcatatttcccaatttttggtattgccatgaaatatgaaatactatgtgatgtgaaagcttgtgacacttaaaatagtttgaatctgtttttaatgcttagtggaacattattgcatttattttattttcgcatctttttttttcttagtccaggcctcattcaggtttagatggatttagggatttatgttggacatcgtagtataactgtaaggaccatcaccatgatattgctaataatacaatatgatggcagagagggctgtgccagttaggttttattgccctgcatcttgaaaagtctcaataagtatttactatttacctcagactagaaaattgaaaacttaatactaggtttaaggtgtgattcacctagctttgacactttgaaggcagtgcaatatatttctattcttgactttcccttctttttattttcattgattgtttactagccacacattttgagtttaaagttgtggttttcaaatacagattccagggccttacctttagcgcctccataaatgtgaaggacttcgtgctttcaatagagtggtgcttaatagtgtatttttccattgattgggagactcagctaaggtgacattttctatgaggccagcattgggccaacaacctcatagtgttgtatcaaataaggcttacatttctctgcatgtggggaaaatggaaataatagtggcttaataaaatcctttttcccccttatataacaagaagactggaggtggcagcctaggtgctgtcaggcacccaggctcctagttttttcatgcgaccacacttagcaggtgactctccttctcatagttggaagatggttgttccacctctagactcatgcttgtgttcttgtccagaagaatatggcaaaaggacaaagacacatgacagctgagttggttctcttttaaaaggctttctttcctagatgccttactcagtgacttccacttctattttactggccagaactgtataatttggtcatttgcaaggcagactgcaaaatgaagctttagctggacacattattacttcaaacaaaataggtcaggattatcttactaaagaaggggaaattgtatgtttgctaagcaactaagaatattggcctcatttttttttaaaatgaaaatagtcaaatagggtattgcaagtaaataatttaacctgatgcatagtaatcagttaataaatgttagctttaatctgaagaggtagttgcctactgattaagagcataatgttgaaactcaggtagttcttatttctaggccctactctgcctaactaactgtatgacctaagttttaccttaattacattgctttacttacattgtcttgtaagaccatgaatacctatcacatggaattattgtaatgattagatgaaaagaagaaatgtaagtaaagaaagtgctcagcatagacttggcacacagaatggatgctcagtgaatgttaatgtacatgatggtaacgatgaaataacacccatgaagactgggctatttctgtgtgtgttctgccccaaacaagattttttttccttgaaaatataccccactatgtgattaattcattcagcaaatatttcttgaactcctgttatgtgccaggcactgttctggatgctggagataaaacaatgaagcaaacacaaaaaatgcctgctttcacagagtttataatctagaaactctaaagaagaaaaagcagggaaaggggttagggactgctaggggtggaggtggggtttcagttttaggtcagggaaaacctcactgagaaggtgacagttgaggaaagacctgaagaaggtgaagaagtgaatgatgtggttatctgcaggaagtttgttccaagcagaggacaacaagaacaaaggttctgaagcagaagcatgctaatgtgattaaggaatgctaaggaggtttgagggcagctagagcagagtaaatcagaaggtgaagagacagataggtgaagaggttagaaaggtaaggtggtatggatgcttggtcctgattgtcaggttgtaagttgttgtaggaacttggcttttgctttgagtaagactgaaaatcattgcagggttttgaacagagatttaacgtgacctgactttcgttttaaaactcaggctgcaggctgggcgaggtgcctcacctgtaatcccagcactttgggaggcggaggcaggtggatcacatgaggccaggagtttgagaccagcctggccaacacggtgaaaccccatctctactaaaaatacaaaaattagctgggtttggtggtgcatgtctgtaatcccagctactcgggaggttgaggcatgagaatcgcttgaacccgagtgacagaggttgcagtgagccgagatggcgccactgcactccagcctgggtgacagaatgagacactgtctcaaaaacaaacaaacaaacacctcaggctgcaatatgaagaatagttttataagggcacaagggtggaaggaggttatccaggggagagaagtagtagtggagatggtgagaagtggtcagattctggatatagcatattttttgaagttaggaggatttgctgttggattagatgtgagagaaagggaagataagatgattccaagatttttggctagagcatctggaagaatggagttgccatccgctcagatgggagatcaccagagtgaacaggagagcgagtgatgattcattgcaaaaccatcaggctgcttgaatacttacttgaagcatatggcagtgtctttattttcatctttgtatggagagaatagcatgatttttatgatgatgactattcttacagatgttttgccagttaattttcaacatgactctgacaagagaccttatttagaaaaggggttaacaaaattgtaaattcttatgttttgtgtggttcaggtgacaatactttagtcatctttcaaaacagcctgggctagtgcttttcttcagtgaatgcaaaaccttactaaaatatactttaaaatctttagactataagcctattatagtgatggctgggcacaatttaggagaaaatgtgttcatttgatttgattcatttaattcattttttcctgacaggaatatctacttttacattatctctctcttttttaaaaaatttatttttgaggtggggtctcgctctgttgcccaggctggagtgcagcagtatgatcatggctcacctctgcctcccaggttcaagccatcctcccaccttagcctcccaagtagctgggactacaggcgtgtgccaccacacccggctaatttttgtatttttttgtagagacggggttttactgtgttggccaggctggtctcaaacttgtcagctcaagtgatctgcctgccttggcctcccaaagtgctgagactacaggtgggagccacaatgcccggccctacgttctctctcttaaatttctaagtttagtaaagcggagagaaactgaaattttttcttagtcctgctcatgcttgggcagatccttctctgtctcaagaagtagagttacccagtttgaaagatttaaggagaagtttcatccatattttctgcacattaatttattctgctgtgtgacgtaggctaacgttggttgcagttaaagaactaactaggagaggacagaagaagagtggaagaagtgaggatgtaggatggggcattgaggaggcgtgccaatgtgaagtagtgaaaggctgaattaggatgttttattgcaaattgttttaaattttccatggtgttggtattcagattaggccaatgcttagtcgagggcattagggaagtagctatcacactttgactaaaccattccttttgttctttaaaaaattttttttttctaaaacatcctattatagcagactaaaccattcctaacagataccttttacccgtatgtatgaatatttatactgaagtaacagttttacaaataacttttgtttttgttatgtgcagtgtatactgatattttctatttgatcctatttacatcaagaagaatgatggtaaacccagtaaatggttaaacaactgtattaaggaaccctgctttgaagaagagatgaaatattttttatttgtatctctaatccttctgtattattagattattgcaaaatattggtgaatagttaaaataattatgataaaacttttagatattcttccatatcgtatttacattattaattgctattttctgtgaagtaaatttttttctaatgagagaacgtcattgattattctgaattactgttaaaagtagtgagtttttaccgcattaccataatcttctatgttagaaccttaaaatacttttcaattgctgaagattattttgacatttgttttgggaagataatatgaagatggatgaaagtgactgttagcatagaagaactggagcctgcaaatccctttttatcaatgggtgtgggaaacattagcatcttgtcatttgaccatttgttaaatcacaccagagcataatatcttgctcatgagaagatttgttcattaagtgaatgaatctttgagtgaaagaaagatactttagtatctaaacaattatgattgataatacatatgtttggtgtattgttattagtgaaattgattctgtgtttactgatgactagaaaataataactaaagttaaaatcaaacatttctttatctacatttttaaccccagcatggttttggtttacataggacatgctattaatatatttcaggttttatgtatataagataaatcaatcagtgttagattatccaggggtagaatagctgctttgagaactaatactggttaaaaagaacaccactggatagtacatttgtaaaaatattgcaaagaatcagtgaacacatctgcatattagaagatgtctgttatctgggaccaaaggtaccttgcagaggccatgttatgtctcctgtgacttgagaaatgcctttcttgtagatttgtgaccagcatgattagcttccttctcctattccgtggtgtttccaagagtcagccagtggcctctcactgaaggcaagagaaagcagttaaactttcttcagggcttctatgcagaaataattaagagaggatgggatctgagagggagggaacttaatggcaaacactaccattctgcctctctgtcttacacacataacaaagggagctcagccaagaagcagatcaactgcaaactatttcaatagtagcctgttgaatgatttttatcaagtaataagttaatgttcctaaactgttgtcaaaattgtttatgtacactaggggatgatgttattgaatgctaaatatgttcttttcttttctttttgatttccttcctttcgttctctttctttcttttttgtttttttaggcaaggtctcactctttcacccaggctggagtgcagtggtgtgaacatggctcactgcagcattgacctcctgggcccaagcaatcttcccatctcagcctccccagtagctgggactacaggtgtgcaccaccatgcctggctaatttttttatttttcattttagagacggggtcttgccatgttgcccaggctggtcttgaactcctggccccaaatgatcctcctgcctcagcttcccaaagtgctgagattacacatgtgagccacaacccccagaagtgtgttcttaaatattggattttattttaaattttgcattatgtgagttttgtgccattacttgtttgtttggtttttgagacagagccttgttctgttgcccaggctggagggcagtggtgcaatctcagctcactgcaacctctgcctcccagcttcaagcaattcttgtgtctcggcctcctgagtaacggggattacagatgtgtgcgacgacacccagctaatttttgtattgttttaatagagacagggattcgccatgttggccaggctggtctcgaactccttggctcaagtgacctgcccacctcggcctcccaaagtgctgggattacaggtgtgagccactgtgcccagccccgtgcagagtttttacttagtttgtcagaactgtgatttggatttattcatgttggtgttgtatgtatggttgtatttatccatgttggtgttgcctatggttgtgtttattgagagattttcaaatggatttaaatgtaacaaacaaattctgtcgaattatatagttatatgtgtaaatcatatatgtatattttttattttggagacaagagtcttgctctgtcacccaggcggagtgtggtggggtggtctcggctcactacaacctctgcctcctgggttcaagcgattctcctgcctcagcctcccaagtagctgggactgcaggcctgcatcaccatatccagctatatatatatatatatatatattttttttttttttttttctttttttgtattttttgtagagatgaggtttcaccatgtggccctggctggtctcaaactcctgagctcaagtgatctgcctgccatgacctcctgaagtgctaggtctataggcatgagccaccatacccggcctcatgttaaatttttaatgtttgtagcacattagtattagaaatgtgttggcacacttgaaaggatttttaaataacagctttattttattttcttttacttttgagatggagtctctctctgtcattcaggctggagtgcagtggtgtgatcatggcccactgcagcctcagactcccaggctcaagtgatcctccccgcctcaggctctatactaggtgggactacagacgtgcaccaccacacctggcttttttttttttttttttttgagacagggtcctgctttgtcatccaggatggagtgcagtggcatgaccacagctcactgcagcctcaacctcccaggctcaagcgatcctcctacctcacgctccctagtagctgggactacacatgtgtgccataacgcctgggtaaattttgtatttttgtagggacggagtcccactatattgcccaggctgatcttgaactcttgggctcaagcgatccatccaccttggcctcccgaagtgctgggattacagacatgagctcccgccctggcctggctaatttttttatttttcatagacagggtcttgccatgttgcccatgcgggtctcgaattcctggactcaagcagtcctcccgccttggcctcccaaagtgttaggactacaggcgtgagtcattatttctggcctataacagctttattgagatataattcacacaccataaaatttatccttttaaagtgtacaattcagcatacttacagagttgtacaaccatcaccattaattccagaatgttttcataactccaaaagaaacaatgtacaattgtccctcagtatatgtgggggactggttccaggactcccaaattcatgcatactcaagtatacccaaattcatgcatactcaagtcctgcagttagtcctgcaggaccctcattgtgtgaaaagtcagccctccatatatgtgagtttctcatcctgtgaatactgtattttccatctgcatttgattggaaataatcttttttttttttttccccaaaatagaatcttgctctgttgcccaggctggaggaaagtggcgcaatctcagctcactgtaacctccaccttccgggttcaagtgattctcctgcttcaccctcccaagtagcagggactacaggcgtgtgcccccatgcccggctaatttttgtatttttagtagagacagggtttcactatgttggccagatggtgttgatctcctgaccccctgtgatctgcccaccttggcttcccaaagtgttgggattacaggcgtgagccactgtgcccagcctgatttttgtatttttagtagaggcagggtttctccatgttggccagcctggtctcgaactctggtttcaagtgatccaccagcctcagccgcctaaagtgctgggattacaggcgtgaaacactgttcctggcggaaaaaatctttaagtggactcgtgcagttcaagttcacattgttcatgggtcaactgtactcattagctgtactccccatttctccctcttcagaccctggtaaccactaatctactttctgcttcaatggatttttataatcttggtatttcatataactggaatcatactatatacagacttttgtgcctggcatcccttagtatgttttcataatgcaaacagtgtttttaggcatgtgtccgtatttgctccctggctcatgtctgtatagctccaacttttttttttttttttttttttttgagacagagtatcactgtgtctcccaggctggagtgcagtggcgtgttcttggctcactgcaacctctgcctcccaggctcaaatgatctcccacctcagcctcccaagtagctaggactataagtgcacaccaccacgcccagctaattatttttgtattttttgtagagacagggttttgccatgtcgcccaggctggtcttgaacttctggactcaggcgatctgctcaccttggcctcccaaagtgctgggattataggcatgagccactgtgcctggctataactctgactacttccattgtctcatctcctctgactgaccctcctgcttccctctttcacttacgaggtcccttatgattacattgggcccacccagacaatttaggataatcttcccatctcaagatccttaacatctgcaaagtccttttttgccacatatggtaacattcacaggctttggggattaagatgtacatttttgggaggcccgttattctacctaacgcatggattttagatcttttatcattatcccaccattccctaaggctttgttctttttttttttttccctagtctgttttctctctgttgtttagatagagcaaactgttaatcttgtcttcaagttcaccaaatttatcttctgtcatttccactctgctattgagtctgtccagcaaatgttttattttgataattgtatgtttcagttgtataatttccatgtggtactttaaaaagtaagttctacttctttgctgagattttctgttttttatttgtttcaaaagtttttttttttttttttttgagacagagtctcactctgtcacccaggctggagtgcaagggtgcaatctcagctcactgcaacctccgcctcccaggttcaagtcattctcgtgcctcagcctcccgagtagctgggattacaggcacccaccaccacacccagctaatttttgtatttttagtagagatggggttttaaaccatgttggccaagatggtcgcgatctcctgacctcgtgatccgcctgcctcccaaagtgctgggattacaggcgtgagccaccatgcccggcctgtttcaaaagattttgtagtcgtttgtagaagcacttttatgacggctgctttaaaattcttgtcaggtaattccaacatctgatttatcttggtgttggcatcagtacgatcgtgtggtcatcttttttcttttctcattcacgtgtgcttttcctggttcttggtatgacatgtcatttttttttttttattgtaccttggacatttaggttattatgttaggagactttttttgttttatttttctttaatgagacaggttcttgctatgtttcccaggctggtctctaactcctggccttagatgatcctcttgcctcagcctcctgattagctaggattacaggtgcatgccactgcacctggctgagactcttgatcctatttaattcttctcttttaataggtagttaccctatttaagtttagtgtatagctcttgtcctacttttgtgagctgtaatcctatggtaattcagttttcagatctcttggaatgctatttttttctgttttattcttctggcacctctagaactcccgttctatctctgcagctgcctgggctgacctgtggatgtggggccctggctttgctgctgctaagggcagattggcttgacattgccgcacgtgtggggtagacacctggctggcgctgtggagaatctggcctgctactgtttcaggcatagtgtggagaccctgctgatgctggggaggactgggttcaccactgtcctggatggggactggaaaatgtatctctctgctaggtctctgctgagctgcccctttcatagactgttggccagagagagcagagttttctcatttatttatttgtctttatctgccttatccatccatttttggtgttcattccagtttacaagcctctctggtgtccagtctgggatatttgggagataaagggaaaacccagtgaacttactgtggtgttttcttgaagtcttgagatccctaactagtctacctctctcttttctacctttcagagccctcttatgattgtttgttgaattatttttaggctatttagttgtatttggaggagaggagtgaggaaatgtgagcctatgccattgtatcctggaactggaatactagcagtttagatattttttttgcactggtatttattggcagtacatatgaaatggttgaggcttttgttttaactgacactctttagagcatttttctctatctgttatgcgctgtaggaacaagataaggattactcttgtttaaattgtatgggaattagaaatgtcatgtttttatatatccatctacttatttactcttttatgtatttgtttttagggagtggagcaactgctgtagtccaagcagcttattgtgcccctaaaaaggagaaagtggcaatcaaacggataaaccttgagaaatgtcaaactagcatggatgaactcctggtatgcacatcttatacttctgaaatggagagatatactcatatattcacattacaatgggaaataacttgaagtttttgatttgtttctttttaaaaaagtttatgatttcttcattaataaataatattcattgtaaaatttataaagtctggataagtagaaaaaaattagttataatattcttactctgagactaacatttaatatgtaacctttcagagtgaacatttgaatatatttgtatttttatgataatgtagtcagattcttgctcttttcatttaataatttatcatagaactttttctgtgtctgtaaatatggatcagtatcatttacagtgtgtttatagtattctgttgaatagaccacactttattaactatgatatttgctaattactttgtttcctcttttttattgttataaacaatgcttgcttttctattcccttaaaataataccatggaattgtgattcctgggtcaagtggaatatcctttgaaaggctctggccttttaaactttcattctaatgctggatataagacaagagatagaatgacccccaggcagcattagcttcttcaaaggctagggaaaggaagaagaaagggaagtcccaagcaatagctgtaagaatgttctgtgacattaaaatgtaaccatacagggattgtattgtattttttttaggcattgtgctacccagaatagttttaagtatatagtaagtgctcagcaagggaaattagtttttaaaattacttattattgtttcaaaattttcagtttctttggcttaatgaaaataataatacttgctttggataccttttgaggtttttcttgaggctcaaatgatacagtatttgaagactctaaactgccatacaaatgtgaactaatattgttactttattaagtaatttctttaagagcatatacagctagtgctagaaaggtcgggtattagaactggaatgacctgcccatccagaagtttttttcactgtcccaaattgtattttatttctggtggtgtctgtactgagtattagggaataattggaattaaagaaaaagaggtaatggaattatatattgcataatatataattatatatgagatggacgagacaaatgtatttctttaggaattggtaatgtacgagcaggagctgaaggagtgggctgctggaatgatcttgagccatctttggtgagagaatgcatacttcgaaggaaatgctgatcgaaatcttattttaagatcttggattgatacatacaataatactttagagcaccatttggacacttgaactgcagtgatgataaaagaagtcgataaactgcgaactaattctgttaaagaaaaacaaaaatgttaacctacatattaagactagaatttgggaagtccaatatgaagacctataatttgccagttagttaatccataaggatagagtaaaatgaatgaaagtcttattatttactgcttcatgattaagctgaggctcaaagtttaaataacttaagttcacttgatgataatagcaaacatctttcagtgctaggtacttcagtgtactttaacctcacacacatctccatgagctaagtagtagctgttttctagatgaaggaagtaaatcatataataagtgatagagtctggattaaaaatcaggtctttctgacttaagtctattattgtctgcttagtatagtactaacaaaatgattataatcttagttcaaaagtagaaagaacattctgggttttcttgctttgagatggagtctcgctctgtctcccaggctggaatgcagtggcgcgatctcggctcactctgacctccgcctcccaggttcaagcaattctcctaccattgcttgaacattgatcgcaccattgcattccagcctgggcaacagagtaagactccatctctgaaaaaaaaattgaatacgacttacacatataactatataattcgacagaatttgtcttcattacatttaaatccatttggaaatctctcactaaagcgacacaaagacaaccataggcaacaccaacatggataaatccaaatcacagttataacaaactaagtaaaaactctgcacagggccaggcacagtggcttacgcctgtaatcccaccactttgggaggccaaggcgggtggatcacttgagccaaggagtttgagaccagcttggccaacatggcaaaaccctgtctctattaaaacaatcaaaaattagttgaatgtggtggtgcacgcctgtaattccagttactcaggaggccaaggcacaagaatcacttgaacctgggaggcagaggttgcagtgggccaagattgtgccactgcactccagcttgggtgacagagcaagactctgtctcaaaaaacaaacaagaaacggcacaaaacttatataatgcaagatttaaaataaaatccaatatttaagaacctgctgctaggggtggttgctcacgcctgtaatcccaccactttgggaggctgaggcaggaggatcacttgaggctaggagttcgaggttagccggggcaacgtggtgagaccccatctctaaaatgaaaaataaaaaattagcttggcatggtggtatgcacctgttattgcagctacttgggaggctgaggtggcaagattgcttgagcccaggatgttgatgctgcagtgagtcacgttcatgccactgcatgccagcctgggtgacacagagtgaggccctgtctcaaaaaaaaaaaaaaaaaaaaaaaaaaaaaagtcatgtgaaagaaaggggaggaagagagcttctaattgtgaaaatggaggactttgtggaaatgtttgtggcctgggccaccagggctgtgtagactttaaacaggcatagatagcaagtctgcttggcaggggtttaaaatcaggaaagaatagtagacagcctagaaaccataaagaagaaataataagtgaaaaaattaggattttatttgataggaaatattgattagctacagaaatagaggcaagtgtctttgaagattttttttttaaagggaaatgacttcattagaactgagttttaggaagtttagttttataatactttttaaaacataacagctttattgatataaaattcatgtatcataaatctaccctttaaaaatatataatgctatggtttttagtttattcgcaaagttgtgcaaccatcaccactatcaccccaaaaagaaactccatacccatgaccactcattctttattctttcctcccctcagccctaggcaatcactaatctactgtctgtctgcatagatttgcctattctggacatttcatataaataggttcatacaatatgtggccttttgtgtctggctttcatttagcatgtttccaaagttcatccatattgtagcatgtatcagttcttttttccttttttattggtgaataacagtccattatatagatataccacatattgtttgtcctttcatcagttgttgggcatttgggctgtttctacttcttggcttttatcagtaatattgtgatgaacatctgtgtgcaagtcttcatatgtacatttgtgttttattatcttgagtatatacctaagagtggaattgctgggtaatatggtaactctgtgtttaactttttgaaaaactgccaagctattttccaaagtagccgtaccattttacattcccaccagcaatatatgagcttttcagtttctctatatcctcaccaatacttgttattgttcatctttttttgtcatagccatcctagtagattagttctgtaatatttggcaaagtgaattgcaaaggagtaagacatcagtggcaaagagactagttggtaggctttgctgtggtctagaccaacaactttataaaactttgaaaataagaccctcactaagagagatacattctatcattacctggtatttaaagatatatattcataaatattataactgaaacattttcatattatatagaatatactctcattttctatcctatttattcatctttttaaaatacaatccactaaatttatttcatgacccacatagattacaacacatagtttgaggtacactgtgctatacagagatatcgagactctaaattcaggcagtgatggtggtaatggaaaggaaaacacagatttcctggatggaaaatacattagtagtagaatgagcactcagttaaggcagagactttattttgtttatcctatatgaatgaatgaataaattaacattatttgggtgtgtgaaatggaggaaaactgactacatttagggaattagaaaaccagaaagtaatggtagaaatgatggtgagtgagtttcacgaaggaataaaaagttaccattagaaaaaaaaggcttcagaaagcttgaggtggagaactaaatagttcaaacaaaaaatctggctctagcagacaataaaagattttcaagaaagcagtttcattagaaggggtggaattcactttatttatttattttattaatttattttttaaatagaggcggagtctcactctgttgcccaggctggtctcaaactcctgggcttaagggatcctcctacctcggcctcccaaagtgctgggattataggtgtgagccactgtacctggcctataaaggaattcactttataggtggttgaggaagctgctgggtaatttaagtcagtattcatataccactcttgtgaatcatttatatatttatttttctttttgaaaggaggaaaggataactctactggtagttaaggtacaagaagattcccccttccccctttaaaggaatagaaggcaagaaaaagaatatttaagccccttttcatctttggattttgtgtttttttgatagtcttttgctagaaaaccctttgtagtactccccttttcagattaaagctcaaaacccttagcttaacatttaagaccttccacaatttgaccctaactctttacattgtcactctctcatgtgatttttctttccttcaccttccctatcagttagtcaccaaatcctattgtttgtacctctctattattatctcgactcttcccttttcattcatactgtcactaacttttttaaccttttcttttgaaatagcttaaaacttacagaagaattgcaaaagtagtacagagtttccttatgctatccacccaacttgcgctaatattaatataactgtagtacagtaatcagaactgataaattagctgtttatcatttctccatcatctctcactcacatggtggcaacagcttaaacagaagctttgtctccagtcttgtcttcttcattgattttctatgtggtatccaagggtaatttatgaaaatgtataatatagttaaacctttgatatctttccgttgctgttaggatgaagcctgatttttaaatatactttcaaagtcctttatgatctagtcccaggtaattaaacaatcaacaatcttaaaaacctacttacctttcctgttgcagtgttaatgcaggaaacttccaagccttccatgttatgactcctattttttaatgtgcctctccaatgaaatcatgtagtgtctagtacttcccctgtcaagctgtttattattctgtattgtaaagtagtatttgtctaacttctttaccaaactgtaagtttcatgaggactccccatgttgatcgagtacctagcactatacctggcacgtagtagggattatagtaggtgcttagtattgttaatatgtgttgaaaacatgaacttcttatcctagacagatttactcattggatgtcttaggtatgtcatcatttatgaaaatcatatgtacctatcatcttgtactgttatttctccctatcctatagaattaaacatggttcccacctattctgtaaaggctttttttgatcacacttgcctaccttaattgttctttcctatagattcttataacatttatctttttttccttcatgctgtttctcagcagaatcatcttgcaacattaacatctttactactcatttggtacctatatgctctcttatctgtttcctcttatgtgtacttacctttccttgaaattctgtataactatgttagtagcaaggtgcttactttagttctttcttccttttctttcatatttacttagcttttagtacagaagaccgtgctggtgactttggggttgcaagatatgtatggcaagatccttgccataaaggaagttgcattcaagtaaagatgatgagaaattgaaagttagcatttattgagtactccttatcagtcagggattatggacgactttcacacagttgatcttattgaacaaatcccaagggcatagggcaggtacattaataggtgaaaagccttataaagtgctgtagtatttcattcattcaacaaatatttattgaaggtgtactctgtgccaggcacaatgatatgtgctaagaacagttttagttctcactgagcttacagttttgtgggggatgtcaaaagaaataggcaattatagtatagtcagataagttccacagtgattgagaatctacttttgagtacttgccttcatggagctctcagcctagaagggagagacagacagataagcacacaatgtactatccagtattttatgtaccatgatgggaggagacatacagggtgcttggaagctaagagaaggagcatctaactaaacctgggaagctgggaggaaattttgtctagactgagatcagaaggaagaattggagttagctaagcagagatgataggggaagtgtatttgaggctgaggcacaatagggttaaatgtccagagttaaaagaaggtaaacagggccctgatcacacatggctttataaggcattttgtcataccaaatctagtttaaaatcataagctgagatagagtaagcttagatttttggctcagatttctactctggatttagtttttgacgttgtcctgtttcagtttgtttctctttagtgtgagaattatttcacaaaaatggaatgaagtaatattttgcaaagaaaaaaaaatccctacacaaactataaaaaaaccctgtttattagttaatatcttttatagctataaaaccagatttcccaagatggttcttcaagggcaccttgaagcaaaaatatatgtcccaaaggaggcctcctggagtgttgtgccagggtgtgttaaatagtgtgcttctagtttgaaagattactagtgtaatgagtgaaggaaattgagtcagaatggactgagggagacaaagtggttttattggtttaacccttcttgaagaaatcagagccatggagatcccagaaaggtgtgacacagtcttgagatttcaaaatctggatttgctaactcacaacatttgttttaggcttgcatataatgaattattatgttttctcttctttgtagaaagaaattcaagccatgagtcaatgccatcatcctaatattgtatcttactacacatcttttgtggtaaaagatgagctgtggcttgtcatgaagctgctaagtggaggtgagtagagtacaaggaaatgctataagtaccatggtttgaaaagttagtaaaagtttccttcttttctatcctgatttcgttttcatggacatttgcatttgaggagatactgaaaatatagtatttgctgaagatgctaatctatgagccaagacagttttcacacattgcatttgattcattttgttgtcatgctgcttaaatctctcttaattctttttagagactgtctggctctgtcacccaggctggagtgcagtggtgcaatcatagctcactgcagcctcaaaactcctgggttcaagtgatcctcccatctcagcctcccaagtagctgagactacaggcatgtaccaccatgctcagttacttttatcatttaatttaatataattttttttttttggagatggggtctcactatgttgcccaggttcatgtcttaactcctgtcttcaagcgatccttcctacttggcctcccaaagtgctgggattacaggtgtgagccattgtgcctggtctaaatctctcttaatttaggatgcttccttcttgcttcctcccttccatgatgtaaacttactgaagagtctagtccagttatcttgtagaatatgccatattctggatttatctaagtatttcttcttggtggtatttaacttgatctgtagtcctctatttcttgtatattgaaaattagatctaaaggcttgattaaattcaggttaaatattttgtaggaggatacttcttggtgatgctgtgtatttcatattgtattacatcaggaaatatttgctatctggttgaatctttaatagtgatgttagttttgtttgcttaagattaggacagccagggctctccatggaaaaggtaacatttccccctttgtagctagcaagtaatcttactttgtaagtatccagttctccataagtcttttatcttaatgattttcacattcgttgtttgaatccttgtttgagtcagttatttcatcaggggttgtaaaacggtgatttttcttacggcatcatttcttttatatttataaactgacatccttctatgaagaacttttcgttatcaactgggacgctgattaatctgtactctagttcctactgaaaaggcaagataaataatggagtcttttttaaggatcaagttttagtgtaaaatgttggtttagtaatcatctccagtggtagcaactgagagggtttaaaaattttcctttttccagttgggtagggccttcactttttcaagtattattatagacccaaggatttttatgtattcagtgtctttccatcagttatactctattctttttgatatgcaggttgtccaaaatttgtcagggggagcccttttaaagtcactcttgtgtcctcttgacgtgaacccatcagtctttcattacatccttaactttataattcaagattcccgagggttatatttgtattcattttcccagaccctgaatcagccaatactctaatgagctttggtattttttcctcgggaatggtacttagaaagcataacttggatgcttggagtgctcattactacttcattgcttccagagcttggaaatatattaaaaataaaattataatttgacatcaatacaagtttccaatacaagtttaatatcatggactttttaagcttgaatctcttttcctttacacacaaaatcttggtacgcaatattaacataattacttaagtgctttatcttgcagtatatatacaagtatttctactttattcttagaataaaatataaatattgctgattgcaaactgtgaaaccttggcatgtatagatcgaacattttgttttggttacccaaaagctcatgccatttggtaaattagtcattttgccaaggcatggatttgaatcacatggcaagactttgtaggactagttagtgatggagccacactggccttcctatcactgtgctggttggtttttgcttgcatgtgtattttgtgggggagtatgatttttcatcttagaatgtagagttacagaaaagataatccacatttgtttagtttgcagttttattgctgtatctcactgaacaccatacttccccagagagactataaacaacataaggctttagaattaaatttcagtttttctacttagcaattgtatgtcattgggaaaactctttcagctctttgaaactttttacttgtctgttaaatgtggggttacctttctgcatttcagggtattgatgaggagtaaatgagatgatacatgtaaatcatccaccactgtgctgacatttaataggtgcacaagaaattttagtcattaatagtaataagcccttgttatttgatgcttttcagtgtagccagaatcacctttttgtttcaatcccattagtgacacactggagaaactggattgctttgttaaaggccctgttcatatgatggttggaagctttgctaacaccaaccacctttcaagatggtggtcaagcatggttctttcagtatggagagatatgggagtattaggtaatactgtatctttcgttattgatcacctatagcataattttctttatttgtaatttacgagaatatgtaatacaacatttttaatgttttgcaaaaaagtcctctgatgaatgggaataaattgtctgcttaattctctcgtccatatctgtatgccagcctatgctttctgctactcctaagcagaacgacttttttttttttttttttaagaattcctgttcctctctcagtgagtatatgtcttgatcatagaaggggcaggacatgtagatggatggaatgtcttttaaatgtagctctttgtccctcttggtcttaagttttctgggacattacccaatttttctagcctagcactcagcagatttcctggaggataattttcaaatatgttccagttagtcataactctttttataagtgcctatatttttatgagtcaacatgatcattacatctaaaccttttaaatattaaaaattttgcatttttttaggaaaatgaaatcttttgttgttataaaatgaataaacatttaaactgagatgaaacgttaggcaacatttagaaaacaaaagttagaactaagcacagcttaaattttttttttaaacaggaggaagatgtgtcaggattatagcttaattaaaatgccattcatcaaatacttattgatctccagtacattggtgaataaagctatcagattcttgctcttgtgggctatgggaacaaattccaggagaacttaaccttattgagggagaacagttgcagtgagattaactaaaacttgcctctggaggtgaagtccaactgagatctaaagaataagtaataattggctgggtgaggtggctcatgcctgctgtcccagtgctttgggaggctgaggcggaaggattgctttaggccaggagttcaacagcccagcctgggcaacatggcaagaccctgtctctaccaaaaataaaacaattagctaagctcgtacatgtagccctggctacttgggaggctggaggatagcttgaggccaggagtttaaggttacggcaagccatgatcttgccactacagtctagcctgggtgacagagtgagactctgtctctaaaaaaaaattaaaaattaaaaagaataataattagccaggtgaaatggaggctggagttagtactggggaaagatgggagatgtgatccagctagagagaatactgtggaaacggggatggagacaggatggagtgtgtatgtcttgagaactgacagattcacagctggagcagagagaatgagagaagaggactattggtagaggcttactgataagcaaagactcccaaaattaaaaaatataaataaccagagttaacagaaatatgtatagggtaccttctttcatatcacctttttagtcagaatattgaaaacaaaagcacagttttgatttaggaacgttgtactgttgtagaatttaataaggtaattaaatcataaaatgaatagtgagtgtcactcttaccccaccaaccaggtgtacatcctggttaaaataagtttaattgtgtcaatattataatcatttaatgatgcttcattataactgtaatattcctatctttgctagttaaaactgtcatgttgaatgttgggatttattactgcaggaagttaagctttagaagttagaagcacttttggtataaatagctatttccagtttattagcactaaactgcaaatgtaagctttttagaaatcaaagtaattaagaaaacttctgagaggaaaaaaaaggtacctgtagtacttaaagggagtaagtgtagaaatgtagaaatctaatgtaaattcactgtcttagatggttgtttaaggatgccctcaactttgtctttttctaagagataaaatgcatggggacttccttgatctaaaggaggatccaggtaaaatgtctgatactaatagtgaccagctttggatgttcaagcaacaatgcagggttttaaaatttctgtaacatcttttggtctaaaatggaatactcagaccaagcaaattttggcctctttgaaaccttctgaggcttaggaagacataagcaataactgtagtagctaaagatttattaaaacttcctagtagagataccagtaactaagttgaatgaattgattttatatttaaagagtatcttttcatactagtaaggtgaggaaattaacttgttgatggggtcattactttgattgagttataattttcagacttatcaagtgtctgaagccagcagctgcttcactactttgtcaatattattttgatattctgtaatgattttattgtacaattaaagttttgcattgctttttaaatgttccatgccacaggctatgaagcctgacaggggattattttttgggaatagatgatctacatttaaactttttgctttgttacaaaatttgtaccaaataccctgtttcccattatttgatttatttacttttattctgaaaaatgtttggattttaacggacagctttcatcaaaataagttgttaaatgccttttaaaatccagcttcttgggccctacctcagttctcttgaatgactgtcttatagggcctgggaatatgcatttttactagcttgccaagtaattccttcacacattaaagtttgagaacagattatccctatatactatttcttacaagttgtgcgtgaggacaaaatactacatacgcggttataactttccctcattattcctactttaggtattaattgggttattcagtgataatctacttcttccttttgcttagcatattttctcttcacctttctcttagctgacctgcattctttataattttgatatttgaggatggaggattataaacaccgtcatcgagttagaggctacaagaggcttagaaaaccaaatggataagaagcgggggagcttacaggaccagtatctctcagttaaggatgaaggtcttagtgacgattagtgtcttagtgacgattcctccacccataagaattatcttgttgggaggagtttgaaactgaagataaattgttatgccaaagaagaagggtttcttctataaactttgttcaaaatgtctgttctggacatagactagagatgtgcattgctttaatcttcccattgatcattggatgatgtgaaatcaatacaaatctaaaagtttgaaaaggagttcctgcttcaaactctttgcagacttagtcactttttatgtgccccaagatatttgatgctgcatttgtttcatctaccagactagaagttcccttaaagttagcaatcatgtcatgtatatcttgccatatttggtggcacccagtcttagatctcacatgtaatgtaatagggcttaattgttaagtgaataagttgtgttaatttttcatttccagtaggaattggttttcctttgcattccctattttaggtattatgttataaacagtgtttacgataattttaggtattacattgtaaacagtgtttatgatcattgttaatataattgttttcttactaagcagtacttatgtggcctggatttcctgaacggtgaaacatgtggccctttggtataatcactttgctttggggattaatgtgtggttgattaagcagaacaaacttcttccttaggtctctccccttctggatcacaagcttatgaattccagcaatggagaggggaaagaaccagtgtaataatgtgttaggaaaacctgtctggaagctatctggagagtgagtctctttggttcactcttcagagaataaactgcctatctcctattggaggtgaagagttagtaggcaagcctccggggaggaataggaatctgagaatcttactctgtcttatctgaactttcaaccagtttttctgttttcaaccctttccttcacttcttcctcacttggtgtggggaagtatggtacttggtgtgtgtagttctgagactttctggagctctgggtagggatcacgttgtcctaaatggcatagctcctctgcaagcactgaagttcagatttctccactgtgcttagttactttttctttttctgctatcttccagaatattgttgccatctctcttctgttatctttcctgttctctttttaaattatgggtttatgcctttttaatcaagtttaccaagttagtggattttaagtaggagctaaaataaacttgcgttcagtccttcatgtttttgagaattccatcttctttctatgtatttggaagtatattttttcttgttaaagtgtgtgaagtaaaagtacccagtagggcaagtttttaagataactatgtaagcagttgttttgattttagtcttgatcattgaggtgttgtacaaagaaatgggtattgaatcttttctttgcagtctatgtaatgttctagacttcttggcacagttgctaatattgttttgttttggttctgtgattgttatgggccattatgtggccagaaatcttacaaatttccaccaaactttttactgattataatcttcagttttggtagtcagcactgtgcttttaattactatataggtgtcttttcctcctctgccttcaacctttagtaggagcattatttcttatcctgggaagtttaggattgataatacagctggactgttacttaaaaagaactgttatttttattctttttgtatttgtctttgccttagctcttttatttctataatttattaacctgaaaaataattttagtcctaagttagtttgtgtatgtatgtgatccttaccctccaagtatttcgctcctgatttgattggcatttcaattgtatttttatatctttagtcatacagcagtgcatattctaatctgatcttaaaagcctatattggtttgtggtatcttataatagtactgacgagcctggtttacctagggattatttaggggcagttaaatatcctctactacctcactagacatccaaaggagatgctggcataacatactatttgaatatcagccagctactttttgttttagattggaattgaaaataagttattaattttaaacttctgtatttcctcatatttgctgtttttttcatttctgcacagttaagtttatgagaaggttcacatgtgttttgattctaaaatggatctgaattatattgaatgatttagagatttttagaaaattatgtcttctgttttcaggttctgttctggatattattaagcacattgtggcaaaaggggaacacaaaagtggagtcctagatgaatctaccattgctacgatactccgagaagtactggaagggctggaatatctgcataaaaatggacagatccacaggtatgtaaaagacaatactcttgtgttacatcatctcattaaggccattcccactcttttacagaatcgtgatctctgactgttatcatagctctttgtatcactagttttagtacactgtggttagagtcttaattatacagctagtaaacattaaacaagtactgtagtaaaaccagacaatataaaaacaggaaaaattcataatttcgtaccaagaggcaactacttgataacattttggaatatcgctttccattttcttttatatggttaaaaaatatctaaaacaatactgtatatgtaattttgtctgttgctttttaaattttacattatattttcagtatttccctaaattattaaaagctttttataaaataacatttttaaaattatagccttttttctttttttttttttgaaacagggtctctcttagtcacccaggctggagtagcatgatcataactcactgcaacctcgaactcctgggctcaagtgatcctcccacctcagcctcctcaggctaatttttaattttcataaagatggggtcttgctatgttgcccaggctgtccttgaactcctggcctcaaagcgatcttcctgccatggccttctaaagtgctgggattacaggcataagccactgtgcccagccctttttttcttttttaataaataagagcattttaatatttcatgatcctatctaaataatctatcttagtagttaagtgccctgtttaggttttgtgtataggtcctggcgtactattgtgagctatggttccaatgataatttgatttttagagcccttgcagtgcttttctagtctgattttttttctcctggcactgtggggactcccattcaatccttgatcatgccatctatgggagtggagtggatttccttgggccggttgctgccaagtggagaatacgtggtagatgctggactcaggactcacgggtctgtgagcactctcctagtcccatcatgtggactcccacctggtgccagtggggcttccattcagtccctgttgatattgcctgtggggatggaaggctcttcccttgggcccctctttgctcctgggtggggagtggggaaacactggacctgcatagtcctttgctgctgggtggagggctaagagatgccagctgtgctgactggtgctgctggtgtgggtgatgtgggcctaccggctgtactgcatatgggggaggggatgaagtccccctgtctgctctttattggcactgctcgttaggcatggtgggctctcctgcaactccaagtatggagtcagggatgggaccacctattagatttctgctgggctgccccttttctgcttctttaggcagagagagagagagagcaggcttggggctctttttgatatatgtctgtcagttgttctgggtttcagggctgtgtaatgcccagtctgagttatagcagattaaaggaaagctcaggaaacttttttttaaacctttcctatgatgttgaaaaactcaggaaacataatgccatgttgtccttcaagttctgaggcccctagccactctgctttcctcttttctcctttcagagttcttttatgattgtctgttggattatttctgggaattttagatacatttaaaggggaggaacagggaatatttaaaggggaggaacagggaagcgtaaacctacaccatttggtttgggaccagaactagtccctggatttggaatggagacaattttatttaaatctattttgttcctgagttcagattctgagtgtgtagtgtgacatgttgttatgtgatacatggaaccattctccaaatattttatgtttatattgcttttaacattgtgatgaacacttttctctgtgatttttataattttaaaaaatctaggtttccataaaacacattttgaagaatcttaaaagatattgccaaattgcttttcagaaatgtagtgatttatgcgtctattagcagtacataagaatggtagattcattggtcccatgctagccttgcctattaaaatttttaatttacatgtttcgatacatgaagaatagtatcgattttgacatcttggattattagtgaggttggacacagatttatatgaagccattggtatttcctgttgtgacgcatctgcttgtgatttttgcctatttttcttttattttgaaatggggtcgtgctgtgtcgcccaggctggtcttgagctcctgggctcaagcattcctcccacctcaatctcacaagtagcagggattacaggcatgtgctgctgagcccagctcaacttttgcctatttttctgctggtatcttcctgcctttttttatcctgagctttttatatattaaaaattactcttttggcttggcatggtggctcacgcctataatcccagcactttgagaggcgggcggattgcttgagcccaggagtttaataccagcctgggcaacatagtgagaccttgtctctacaaaaaaattttttaaaattatccagatacgggccaggcatggtgactcacgcctgtaatcccagcactttgggaggctgaggcgggcggatcatgaggtcagaagattgagaccatcctggctaacacggtgaaaccccctctctactaaaaatacaaaaaattagctgggtgtggtggtgggtgcctgtagtcctagctactcaggaggctgaggcaggagaatggtgtgaacctgggagacggagcttgtggtgagccgagattgcgccactgcactccagcttaggcgacagagcgagagtgtctcaaaaaaaaaatccagatatggtggtgcttgcctgtggtctcagctactcaggaggctgaggcaggaggatcagttgagccccagaggttgaggctgcagtgagctgtgatcatgccattacactccagcctgggcaacagagcaagactctgtgtcgaaaagaaaaaaaaattactctttctccatttttgtcttttagttttgctaaagatgtgcagtttgggacttgggctccaaacaggcaacttgtagaacaaagggacaagagggagtcaggttattagagcatgattaaaatcttgaaaactggatgaggctgatggaaaatcaagacaggtcagtggattagtgatctttgaagttagagtagtcatagtagagtagttgaatagttatctcgaaagataggagagtggggtgtctgaattagtaatttcataattgggtcagttttggtgataataagataaaaaactgaggaagcagatgacccaggtagagtggaggacggggtctttagagatggcatcagtgaactcaggcagggattgtctctgtgattgttaaagtttcttgggataaggcaagatgacttggaaagcaagacttaatgaacaacaaagagagagagaaagtataatattaaagctggatggcatgagtttgaagggaaatgactttttttttctttttagagacagattctctgtcacccagactggagtgtagtggcatgattgtagctcacttgcagctcaaactcctgagctcaagcagtcctcctgcccaagcctctctagtagctggaactacaggcatgtgccaccatgcctggttgtgggcgaaagattacctaggtgccgaggcaagagactgaaggcacaaactgtttcagtataataaagaaaatagaataagaatagtcataatacaaattagatatagagatgatcatggacaattatcaatcattattataaacattattaatcattagcttttaatattactctttgttgcattactaatataacttaggaataaccagtgggtatagggtcaggtgctgaagggacattgtgagaagtgacctagaaggcaagaggtgagccctctgtcacacccgcataagggccacttgagggctccttggtaagcggtaatgtcagtgtctgggaagacacccattacttagcagaccacgaaagggagtctcctttccttggaggagtcagggaacactcttttccaccagcttcttgtagaaggctggatattatccaggcctgcctgcagtcatccggaggcctaaacccctccccgtggtgctgtgcttcagtggtcacgctccttgtccacttccgtgttcctcccgtacccctggttcctctttgaagttcgtagtagatagcggtagaaggaatagtgaaagtcttgaagtctttgatctttcttataagtgcgtagaagaaaacgctgacgtatgctactgtctctctctgcttcggctacctaaaagggaagggccccctgtcctatgatcacgggacttgcttcaccttatcacttagaagattcaccctccttaccctgccccccttgtcttgtatgcaataaatatcagcgcgcccagccgttccgggccactactggtctccgtgtcttgatggtagtggtcccccgggcccagctgttttctctttatctctttgtcttgtgtctttatttattacagcctctcttctccgcacacagggagaacacccgctaagccccatagggctggaccctacacctggttaatttaaaaaaaattttttttgtagagattgggtcttcttatgttgcccagactagtcttggactcttatagactcatagtggtaccaccttggtggtcttggataagatcctggggaattctctgattaccaggcagagactctttttctctttccttactttctcctgagcaaatggagtctctctgtctctgggcggagctgtctggagctgggggtgggatgacacaagcacccctgtggctaccagcactgggactgtcctggatcagacttgaagacatcacagcactgagtcttccccagggcccatggtaaccactacccagctattgcctgtgttgttcaaggtcctagggctctgcaatcagcagatggcaaagccagccaggcctgtgttcctcctttcatggcagtcattttaccccaccctgggtgggtgcagagatgccatcagagagccagggcctggagtcggaaaccttaggaatctacctggtcctctagtctactgcagctaagctggcatccaaaccacaagacagggtccttcccactcttcccccccctttccacaagtagaggagtctctccccgtggccaccactgccccaagctcatggcaggtactgcctggctacccccagtgttcagctggggcccaagggctcttcagtcagcttggggtgaatgctgccagtcctaggactctcccttcagggcagctggctgtcctctggcccagggcacgtccagaaatgccatccaagagccaaggcctggaattggggaccccaagcgcctgcttggtgctctacccaaccgtggtccagctggtaactaagctgcaagacaaagtcccctttacttttccctcttctcaaacagaaggagtccctccctgtagccaccatagcttggaatgtgctgggtcacacctgaagccagcacgtctctgagtctcacctaaggtccacagcaagtacagcttggctgccactgccaattatgcagggaccaaaggctccttagttagcagatgatgaatcctaccagaactaggtccttttctttaaggcaatgagttcccttctggcccagggtgtgtctagaaatgtcatctaggagctagactccgcctggtaccctgttccactgtggctgagctgatattcaagttgcaaaacaaagtcctctactcttccctctcctctcttcaagcagaagaaaggaatctctcccagagctgcaagctgtgctgcctggggtggggggaaggggtggcacaagcagtcccttggctgccccattggtgtctcactgggttgtgtgctctgcaagtctactggctccaagtccagtacagcaccagaacttgcccaggaattgcattctttgtagccttgactgccttgcaaatttatttaggaccccagagcactttagcctgcagaggcacggcttgacagaactcaggttctgactgctgagatgggcaattccccctggctagagctggtctaagtgcttcctccatgggtgctggctgcgttctgcctggtgttgcgttctgctgtggcagagcagcactgagttccaatgcaagcacagattctctctctgtgccctgcagctacttctgggaaatggggaaggggtggcattgacaattcaagactgtctttcctatcaccattagtgtctctaacagtgatgtgaagttgaaatcaggtactgtgatcactcacctgagttttggttcttatgaaggtgctttttcatgtaggtagttgttcagtttggtgtttctgtggggaagatgatcagtggagggttctgtttggctatcttccattggatctttctgtgggtttagaaatgaacattttctaagttcagtttctgttttccagtttgcctgggtttcatttttggataggcccttttgtctcctatgctcatgtgcacatcctcagggttggccaggagtgtgtgaatagcaggggcctctttgtctccactgtgtacctttggccaagaatatgttcgtctctatctagactgctacaacaggctagtagagccactgatgaccttctcctgctggtccgccttcagaatgtcactttagttgacagtgtcactgggtgtaggtgttgcctaccatgtccaatcaaaggagcctcttttaactgtggcagagaagctgccagtcatcgtggtctgtctgccttagaacctccatgctgactgagctggggccagaaagtgatggggctagtcccagagcagaaccccatagagtctcagtgttcttacctgaagtgcagctgtttttcaagcataaaaggtttctcaggttgatttccagagcactgaaatggttgttttgtcatatttgtccagctttaagattgctttttaagggggaagatttatctatttcttcactcagctgtagctggaagaccccactcttcatgtgcatttggttgccttgagattatcgtaagaaataaatacatttttgttctatctaaagaaattcctaaagtaaatctctaaagaaaaaaagttattatattttgtattcttaaaattaattttgacacaagaaactttgtatattgtcacatgcatgggtaatatgttactattattaatcttactttgctggtgaaaaaaagaggctttattaggggatttgctcaagcttatacaatgggtctagagtttttcagtggcttataagctaactttgagggcaattctgaatgagaattcccaggacatttttaacaatgacattatgtcaaggtaatgcttttgaaatggcagcattttaggccacttttaaaaaggatgttactcacttagttaagtgagagttgatacattatgcaaagtagatgttatagtcatacaaaataaagcagaaactgaatttctttgtgcctgaaattgatatgaatccacttattgcattcttaaaaaaaaaaaaaaaagagacaatgaccctaaatgtatacttcagtggatgttttgggttaattttgctattcgctatagaaactctagatatgtaaaggtttaggaaaaagaagatactttcatcggtgttctgaagtaaaaactttgacttgaaaaaatagatatatggatatgctaagtaaaagaggacaacacaatatatttaaaattaatctcagtggcagactaaaattctattgagttagcaaccaaaaaaatgtaactgatattaagtcgatggatactcagcttcattgattagcacagtctttcttagcaggctttagaagcagactgcctagattcagatcccagctctgtcactaattgggtgacctctggcaagttatttaatctctcttttgccttattttctcatgtataacatagggatgagatagtatctatctcataaagtagttgtgaagattaaatgaggtaatatttgcaatgcacttagaatagtatttagcacacaagaatcagtgaacggtcattgtcattattttgtacaccagaggctgacaaaccttttctgtaaagggccagatagcaaatattttagactttgtgggtgagatgttctctgtcaccactactttgtttttcttgtatgaaagcagctatagacaatctgtagctgaataggcatggttgcatcttttacagaaacaggcaatggactggattcagtttgtggactgtagtttgccaatctctgatttacagggctgtagaagataattttgtttttctttcacataatagtctgggcataaatgacatcagtccagtatgatgactccatggagtcagggactcaggctctgattttattgctgtaccagctctaagttcttgcttcatggcccaagttgatttccaccacatccacatttcagcggaaggaaggaaggaaaggggaaatagaggttatgccatttcctattagcagtggttctcaggacatttagcaatacctggagccatttttggttgtcacaacaggggctggagttggggagtggaatgtgctactgacatgtaatgggtggaggccagggatgctgctaaatttatcctatcatgtccaggaagccccttacaacagaattacccagcccaaatatcagtagtgctgggacaagaacacctatgttaagggaacaactaggaagttgtagaaaccacttttgttcgcatcacagtggctagaactttagtcacatggttatatctagcctgcatggaaggctgtgaaatgttgcctttcttcgggatggtcatgtccccagtaaaaatttcttgcttgctttctttgctttcttctccttccctccccacccccgtccttcctccctcccccctccccctcccctcccctcccctccctttccttccttccttccttccttccttcctttcttccttccatccagacattgagggccaattagtagtctgtggcacttttttcccacaagattatttgatgaacatggaatcagaactgaggtaattaattgaattatgttaattgctaatatcaaggtatgcatacatacaattatcataatacagaggactagaattttcagtttttcagtacattttttctacttaacagtgccggaaaaatattcacaaatgtttcctctttggccgtaccccatttttagcgatttgttaacatgttaaccaggtataggaacaattgattaggtacagttttagatggaaattcatattgttttaagagtacagatgcttctcgacttaggatgggtttattgggacacaactccattgcaagtagaaaatatcattaagtcaaaactgaacgatcataaattggggaccctcggtgtttccaagattccttagagtttatacattattcattagagtcagttgttctcattcatcctcataaaaagaagtttctttttctttgtaagactgaagcaggttagaaaatttaggcaactagaaatactcattttttcctagagtggaatggttctgtagatgactgatttttacctatcatgtatggagtttttaaaaatgctgatattctaggccgggcgcagtggctcacgcctgtaatcccagcactttgggaggttgaggttggtggatcatgaggtcaggagatcgagaccatcctggctaacatggtgaaaccctgtctctactaaaaatacaaaaagttagctgggtgtggtggcacgcacctgtagtcccagctacttgggaggctaaggcaggagaatggcctgaacgtgggaggcggaggttgcagtgagctgagattgcgtcactgcactccagcctgggcgacagagcaagactccatctcaaaaaataaaaataaaaataaaaaaatgctgttattctaagagtaacccagttaaggagtgtgtgtgtgtgtgtgtgtgtgtgtgtgcgcgcgcgcgtgcgcgcatgtgcatgtttggtggggtatggtaccttgcttttttctccatgttgtgattactcattgaaacctcagctttacaatttgtagtagtctgattttttttttcttttgttagttacttttctgggtctttgctttcctatttgctcaaggattagggttaaatagttgatttttaagattacatctttttgtgtctttctttttcagccttatttggttattgattgattgattgacaggggctcactctgtcactcaggctggagtgcaacagcatgaacacggctcactgcagccttgacctcttgggctcaagtaattctcctgcctcagactcccaaatagctggcccacaggtgctcactactatgcctggctatttttttttttatttttatagagacagggtcctacactttggcattgggacctttttaaaagttcccccaggtaattctaatgttgcctaggctggtctcgaactcctgggttcaagcaatccttctgcctcggccttccaaagtgctggaattacaggcatgagctgccacgtccggcctcttctttggtttcaattgagcatttcatatgattccatttcgtttcctctcttaggatatcaattatactttttttttttttttttttgagacggagtctcgctctgtcgcccaggctggagtgcagtggcgcaatctcggctcactgtaagttctgcctcctgggttcatgcgtcagcctcccgagtagctgggactacaggcgcctgccactacgcctggctaattttttgtatttttggtagagacggggtttcacccgttagccaggatggtctcaatctcctgacctcgtgatccacccgcctcagcctcccaaagtgctgggattacaggcgtgagccaccgtgccccggccaagaagttcttttaacatttcttgcaaggcaggtctgctcactgcaaagtccctcagtttttatttgtctgagagaagtacttctttacttttgaaggataattttgctggatacaggattctaggttggttttttttttttcctcttgacactttaaacagttcactccactctgcttgattgcatggtttctgagatgtgggatgttaattcatacctttgttcctctataggtaaggtgttctttttcctctgacatctatcaatatttttgtctcccttacccagctcagtctttttagtgagcctgtgctcctgggctatcaactgcacaagtgcttctcagttcccccccaaggtgagacaggaaggcttgatgggactgagactgggtatttcccttcccgtagatgggttaggttctggtaaaaccaaggtggttaagctctgataaaatagtttcccttgagggtaggtttttgtttaggagaatagaatgcttagggcatatttcaaattggttacttttttcttcctcctgtgggaaattaggggaattttctcctgtctataccccgagaatctcatggggctgtaggaggtaaagctcatccagctcatccaagtgtatgagtctcccttagactgggtctgcttggggtttttaactctcaagctgttccacactgagcctccagacatttgtcaactacaatttaagtttttataccccagtactgactccagcaatagtcttctgctgctgggcatctgctccattaaactgtaattctatcttcctgtctacatttttggaggcaggtgtttgccctgtgacctcagtctctgatggatctaagaagagttgttgattttcagacttttttcctgttgtgaagacagaagtgacaagctcattacatattgaactggataagattaaatcttaaaattcttttaccttctgatgtccaaagcttttcctgtataggtgatctcttgatgtcctgtttattaacaagatagtggccctgatttgcactattattacatctttgccagcaggggtagttgatagatgcaacaaaattcaaaggcctgcttgccaaataaactttcatgggactatttgggcagattcacaatgtttagtccctttgacagttgaggaaaaactgctgtctctttgaccctctgctaccctcaccacaccaccaaaaaggaggcctagcactatttgggctcgttgggcattagacagtatgtacctcacttgggcattctgtctggtccttcatatcagctaacctgcaaatcagcatcctttgagcgggactctaagtatcaggttgcattggaacctgtccagctctctgtggcacggtcccaggaacccctataaccctaatgactcctttgaacactgtgatagatgttataggtacatacaggttcaggattgttattttcctggtgaattattccttttgttcctataaaatgacttttttactcctataaagtgacctttttactcctagaaatgtttttgttttaaagatagatcttatttgttgtaaagacaattaggtcttaaatgttttataaagataattaagatcttattttaatatagctatcctgtctaacctttggtaagcatatctttcattgtggcctagtctttcaagggtcttggttttatttagggagttttagttttagctcctaaccttatatcagcccagtgccatgttttctattacctgtggatttgaaaacctgagccccctagccatttggccagtttccctcttctgtctcccaggtcttcttacctactgctctgcctcttaagtgtctctttcatttctgaaccttgagaattttttccttactttgcatctagctgtgtggtattttccccctaatttatccagcatctctttgtgtttgtagcaagggaagggtgtgttttgggtcaagggcctgtatagtagtgatgaaagtttgttttccaacgcagcattcgccatttagctggaatgggaattctctgacactttaaatcgtagactttcagcctgggctgcatattggaatatgggaagctttaagaagttttgatacctgggtccactgtcagaaatttatttaattggtttggaatgaggccttggcattgggacttttaaaagttccctgggtaattctaatatgcagccaagtctgagactattacttagactttagcagtaaccagctctgtaatacactgagacctaggcttaggagaaagttgtttcattgggaagcagaggcagatatttttaggatgtcttgctacttctcgtatcttcaaagtccatttgtgatttcaagtggatttgtatgtcagcctagtggattaggtaaagtaattttcctctgtctctactgtgtttcctctttgacttctaggatttagaggttttgagtaggatgaatgggtctctaaatcagacttttctctctgtatctacccaaatatttttcccattagagaggctggctgtgacagaaatgttggatattttgtcagtttaagatatttaaatgtagtgtatttacagctttggttttgattcattgcttttcttgacctttttcaagttttccataaatggtgcctattgatgagtaataaaaatgttatgggcagaaacttgtgttctgtattaatgaaaagtcaagcgtgtctgtgatattctttttaattttagaaggagtgtgtaactttggggcaacagtgacatgtgagaaatgacattaagcagtaaaaaacaaaactcttcttgctacttaagagtggatagaggatttagcttttggagctgctgacttgcttgatattctttgtggcagagtaaaaaagttctttaactggggactatattgatttccagatatttagttacaaatcttttccttgaaaggtttgttgtcctgtttgagggcagactgtggtgttttttattgtccagtgaattgtgctattctgcttttactcctggaagctattctacagattgtacttttggtttcaaaagggaaacatggattgattatctggggcattgatcaggaaaagtagtcactcaaagtgcaggctctgctgagaatggattattgtctcttcacttatgaaagactaaaacttataaaacaggatttgagtgagtaatatgtatatatggctttaaaaattcaaacagcacaaaatggtgtatggtacaaaataagtcttctcagcatcactgatgttaaattatttgatagtatgtctttcctgtgatgtcatgaaaatggcaccttacttttatggttttccttacaaaatcccctgacaccaatctaaccatgaaaaaaacattgtatacattccagtagagtggcattctacaaaatgcttgaccattactcctcaaaactgtcaagattctcaaaaacaaagaaaacgtgaaaaactgtcacaaccaaaaggagcctaaggagacattgcagctgaatatagtataatatggtatcctgggcaggatcctgggactgaaaaaggacattagttaaaaagtaaagaaatctgaataaactgtggactttatctaatcatgatatgtgaatactggttcatttattgtagcaaaagtactgaactaatataagatgttaataataggggaaactaagtgtgaggtgtgtaggaactcctgtgcactaacttctcaacttttacgtaaatctgaaactgtcctaaaacataaactattaagtcttcttctttttatgaatccacaataccctggtccaaagggaatcacttgttgccattttcttgtgactcctttgagagatattttatgtcaatataagcataatgtatgtctctgtgtcatgtttttcttttaaagaaaatacaaatggccacatactttatttagcattcatttttcccttaataatgtatttggagatagttccatgtcaacatgtatgttcattagtattcaaagtattttatggtttagatacaccacagcttaactggtctccttttgatggataattagattgttcccatttttgactgtaacatattagtttataaccccgacgtttggaacagagttaggaggtggggagtagggattggggaagcagggagggaacagtgtgtggttggcattttttcttttttattttatacactactttttttttttttttcccaggaagaggatttgaggcaggtcatctcctcaatggttatgtaatagttgttaaaaatttaaatagttatttaaatctatttgaagaatatctcttcctatttgcagaatgcttcctgtatactaataataatgctaagtaagtacaggtgactatagtagtatattaagatacaggcccagatctagctcatggtgaaataaggaagggagacagacctagaaatatgatcatataatactccttgctaacattatagtacagccttctgcaaaaacacagagaagggagtgactaaactatacttttcttccctcattgggttttaggtgagctcagaaaagggagttggaagttagtggttgactcagttggatgatctttgtcacaaaggaaagagaatgtcctctattctctcctgtttgtagtgactagaatctgagactagattcatggagtaaagcaggctggcctgcactctactaagtcagcctctgggagaactacctataaattgcttgggattataagcagtacaaaatactcaggaacatgatttccttatgtttcagtgtatactcaggaaaggcattgtatactgtagtatgatgctgcttctgcacacagttgtgaaactcttgttcattgtttgccaaggaatggttatatctaaacatggaggaaaaaggggaccagggataggatgaagtgctgcgcttttcactggctccttttcatgacaaataagacgttcttccatgagcaggccttgcttttctttcttgtgtagcttcaagggctacctttcttttgcttatttgattatatttacttttaattacaaaatgactgtatttccacaagttattcagacactgttccctagacttcaattccattaatctccacaaaaattgcatttggcaagggaaaggggtgtgtttgtgcaacattaatggtgtcatgaaatgcactggtctcttatttgatttgttcatttaataatgtatgttagcatttcatgtcacaacatgttgattgacattatttcatggatgtaatagaaataatttaacctttctactgttgctggctgttactagtttttgttttttattacaaacaatgctgcagtagaacccccttgtactttccctgtaaattgtgagagttcctctaggttatcaagaaatggttttgctactcttaggatttggggattttaaattttgccaaaaacttgtttttgctaaaaaaaaactaagttgtagatttgaatggatagtataatattgtttacattgggagaaaagcccagatatgtcatcggtatatagtctgttaaccagactgataatagttgaaaactttggagagagtacttagacttgagaatgatggtcaaagggattttggcttttttagttgtgtttaggtttttaaaacaagaatatttttctatattacgtgttataaatagttaaaactatagagatgcctgagtaatttccatctttttgttacaggcaaagaatgttccctgttttcagttgcatactgatgattttaaaaatttgataattcattggggtatagaaaaaaatatatttcaaaatgtagaattaggtgagggtcacattctttggccacttttatcccgatcaagaatatttgatcacttgtgttttctagatattatagtaagaacctttctagctttctttttaatgtgtgggtttctagtaccagtgacaacaattttactattagtcttaatatcctttaatataaaataggacatttaaatattgctagtattacatgaatatagtaaacaattgcttaaattatgttactccaaagaatagatgttttttgatacataactttttttttttttttaaagagatgtgaaagctggaaacattcttcttggagaagatggctcagtacagattgcaggtaatgattagtatttctttttatttgatttaatggtcagtagaaccacattacttatcttttatgtttccttaatcagcattctctcctgttccctggaccatctctattcaagcatcctctgttggcatgtcataggatgccaccgactctcaagatatcttctcatactcatccttcatttctgctcttagacatttttttctgaccattacttgtttccttccagctatccactccttacttccattagggtcttctgctatgggttctcatagcattctgtactttcctttaaaggaaaagtagttgaggatcttcattgtgtttaagaataagtacgttatatagaggctatacagagcttcttctgtcctgggggaaatggagtatttgtcaattaggaaaaagtgcctgagaagtagaagtgcacttttggcagtttcagagctgaagggataagagttgcagtccagggcctaccaaaagtggctatcctgatgaaacaccccctcctccaggctgagactccagaacgactgtacccagggattgtctagcaagcagatcatctgagaaaacctcagcttggtcccagactgctagaacagtcaggtgtttggcaggaggaagataatcacccaaatcttaaattatttcttcatctttaagaagataatttaggcgaacatcttcatgtccgtgaggtaaggaaatattttaaccaagtcacataaagctctaatataaagggaaagattgataaatttgactcctttaaaatgagcaacttctactcatcaaaagaggaacaaatggtttattactattaacagagtaaaagggtaaaccacagagtagagaagatatttgcagcatgaataattgttaaagggctcaagtgtaaagcgtataaaaaactcactgagagaaaaaaaaactctaaaaaagtgggcagaaaactggcataggcacttcccaaatgaagacatccaaatataaatgtagtaaaagatgttcaagcttacactagtaatttgttaaatgcaaagtaaaatcacattgtgataacacgttaaattgattggcctggcaaaaacatcttgacagtactaattgttggtgtgggtataaagcaaggaaaaaaatctcatttctgatgatgggaatataaattggtacaaccatttcattacagttgaagatatgcatactgttagacttttgctcctaggtgtatagcccagagaaactcgtccgtatctgtgccacagtgttcatagtcattacaagtttgaaataatcccaatgccagtagaatggataaataaattgtggttaattatatactggaataccgggtttttgtttgtttgtttgtttgtttgttttttttgagacagtctcgctctgttgcccaggctggagtgcagtggtgcactcttggctcactgcaacctgtgccttccaggttcaaaagattcttgtgcctcagcctcccaagtagttgggattacaggcgtgcacccctccaccgactaatttttgtatttgtagtagagacagtgtttctccatgttggccaggctggtcctgaactgtacccactaaaaaataattcctcattccacctctcaccccagccatgggtgaccaccattctcctttctgtctccatgaatttgactactttaagtacctaagtgaactcatacaatatttgtccttttgtgattgactttatttcattttgtataatgtctttaaggttcatgttgtagtgtcagaatttcattactttttaaagctgaataataattccattgtatttacgtgctgcattttgtttatccattcattcatcaatgggcatttgaattgcttccaccttttggtcattatgaataatgctgctgtgaacacgagtgtccaaatatctgtctgagtttcttgctttcatttcttttgggtatatcctcataagtagaattgctggatcgtatagttattctgtgtttaagtttttgaggaattgctgtattatttttcatagcagctgtaccattttacattcccaccaagagtgcacaagaatccaatttctccacattcccaccaagagtgcacaagaatccaatttctccacatcctcaccaacgcttgttagtttctgggttttttgttttttcaggtggtagccattctaagggatgtaaggtgttatctatctcattgtggttttgatttgtatttccctattgattagtgatggtgaacatcttttcatgtgcttattggccatttgtatatcttctttggagaaatgactccttaattcctttgcccatttttaaattggagtgtttattttatttttgttgttgttgttgaattgtaggagttctttacatattttggatgccaatcccttatcagatgtatgatttgcaaaatattttctcccagtctgtgggttgcctttcactgtgttgatagtgacctttgatgcacaaaagttttaaaattttgattatctactttttcttttgttgcctgaaatttggtattatatctcagaaatcattgctaacgccagtgtcatgaagcttttctcctatgttttaagagtttttatagtttaggggcttctaactttttcataccttattacagataacacttattataatgtattataattgcctgattccaccttctatattagaagttgcacaaagggggggaccttgtcttccttgatcattacttttaatcctgtcacataataggcaccaaagtccatcttgaactttaattgaaattttgttaatgaaggaactaaattatttttttcacatctaagttactctttctctttagttggcaatttaaaacgaaaggcaaatggcatttttgctctttggtttctgtttttaactttatggttggattgattatgtttccttagcattgtagctgtgcaggttatttaacaagaatattttggtaaagggggtattatcacttacattccttagctaaatgttttaactagtcttcagggttcacttggaaacaagcagaggtataccagctgaagatacaaaaattctggatcattattaagttctgggtttaaaattctgaatattttaaagctacttgaaggtttttagtaggttttaaaaagtaaaaactcttcataattcaacctaaaaaatatgttgtatatacataagttgtttgagtctttatcatatttaagtattttaaggcacgactttgtctctctggttagtgataagaatacctagtacttattgagtgtttagtattaaaatatattacagggactgttctaagtatattattaagtcatttaatccttaacaacgaccttgttaagtaagtactgttactgcctcctttttacagatgaagaaattgtagcacaaagattgaaaatacctgcccaagttcagctgactagtggcagagctgaatgcactaaatgtactttttccccttcatatgcacttcaaattgtttactttgttattgttgttacaaatggaacattttaaagtttttagatatttcccggtttaggagtattgaaaactgttaagatgatgatgatgatgatgatgatgatgatgatgatgatgatgattttagagaaagcgtcttgctctgtcacccaggccagagtgcagtggtgcaaatgtagttcactgcagcctcaaactcgtaggctcaagcagtcctcctacctcagcctcccaagtagctagggctacaggtgcctgccacaatgcccagctaattttctattttttgtacagatggggtctcactgtgttgcccaggctggtcttgatctcttggcctcaagtggtccttctgcctcagcttcccaaagtgttgggattacagaaatgagccactgtgcccagccaagattattgtgtgttttttttttataattctaagtgcattcagacaagattattgtttttaaaactgtactatatagacttgctatttttaaactgtactgtatagacaagcaattatttcaaataattgtttgaaaatggcagaattcatagacttctgaatctggaattttaaagtttgccatgctaaaattagccttctcacaatcgggttttctgtaatttattgtattttcaaatttatttctattttcataatttctattttataattctgttttcaatttgaaaatagaacaaattatggacaaatacagactcatttaacataatgcagagtattctggaatggacacaaaacaaaaggggagtcagaaaaggtgtataaaagttggataaggtgtgtaagagcctcactatattagttaaagttcttttggttgtattggaaattatcactggctgacttaacaaagcagaaatttttgaaatacactaggaaatacacagaataaaacaaatctagcctcagaatgggcaggaacccagttgtgctggtgaccttcaggatgctgttagcatggctcagctccagtgacccttaatttctttgtctttccattcaagcttcacatttctaggagactaatataggcctactttggattaaggtgtctaaccctggctcaaatcaggtatgcccagggatcaaggtgagggagtacagatacacaaccagggctatttacagaaaaggggggatcatggtgaggcaggcagtcctcctcatcagtgactggtactttggcttcagtattgtgggacaaaatctttgtagagaaaatcctgaggcttagagaggtgaactaagtttaccaatgtcatacatctaccaagaggtgaagttaggatatgtgtttagaattacgaactctgatttatttggggctgagttcttgagagctctttgaatactaagctaaaaaggttggatttcattctgtaggagtttctgaactgaaagggccatgtcaaagtgataatttaaaaatgaatggataaatgaatctgatagtggtatgtagagtggattagagcaagggggaaaatctgagaagatgatgatatgtgggggtggagaggaatggagtgaggtacctgctaagctatgtcttttttgttttttttgttttgtaaagatgaggtctccctatgttgcttaggctgttcttgaactcctgagctcaagtgagcctcctgccttggcctcccagagtgttgggattataggtgtgagccactgttcctagtctaagctatgtcttaatttagtcaagaagttcagcaaaaagataagaaactatcatgctttttatttatatataggatgttcactacattgtattgttttcctattcatttatgatagttgatgcactttaaataccttgctgttgtattctatttcagactttggggttagtgcttttttagcaactggtggtgatattacccgaaataaagtgagaaagacctttgttggcaccccttgttggatggcacctgaagttatggaacaggtaccgtgtctttttttctgttttaaatgggttagggctttgttttgaaactgaaaaaacttaatagtgcttgcttttctttggcataccaggttagctttgggaaacatgtccctgttccttggttaggattttagtccacccttgaaaagaaaacaacaaaaactctctagaactttgcaaaggatatatgaaactcaggaataatataattgaggtttgttttaataattttattagtacaaattataccaaattttacatatagatttattggtttaatgatttctaaattatgtccagttttgtttcctaagcctccatatagttatttctagttcttaatagatgcttcacataaatgccttataggtatatcaaactcagtatgctgcgaaccgaattcatttttactctgttttaatcacctgtattcaccctgttggtgagggaaggattcccactgtaaagttatgggaatggctgaacatacaacacctgacactggacagatgagattgacagctgtctattagtcacatatactcacagcctaggggaggaggataactgcatgctgtgcaggaccagcagagttgcactgagtaacagaatgaacgagaaggggctttggagacaggctttgtagtaccagcagattgcgatgccccttggtttccttgagaagataagattggctgacacggaaccgaaatctgcttctcaggggcaagcaggaactgtacctggtcgtttgataaggaggattgttgggctaggagacattatctgcaagagcagagtggggaggggaacttctgcttaggtctctagaggcccttcagttttaccagatggcagggcagcacatactattgatccttaattttaggtcttacacactacacactccccaaacctatttctcctatattgcttaggatagaaaattaaaatttataaccatgtaatgtgctggtgacagtgtataagtagagaaatttggcaacatattcactctaaaaagtttaaaagtattcacaaccttcctaactttttcattatagaaattaaggtgataataccataatacagatcctttggaaaacaaaaaagctaccccactacaaaacattttgttttgattctttctagtattttactgtttgtaaaagtttcaggacgtatgagcaattttgtgtttttttcctcatgttttatcacaaatgttttttatatgttcacatagaattaataaatattgcttttaattgactgtaattttaaaaatataccatacttaacagtttcttcactgttggtgaacattcagtttgtgtctttattttttgtattaccaaatatatttagattttgcctactttattttattggtttaaagcttatgaacactttcattgttcttggtacacattagaggtagcttttttgtttgtttatttttagagacagagtcttgctctgtctcccagtctggagtgcagtggtgccatcatggcttactgcagccttgaactcctgggctcaagctagcctcccgagcagctggactgtaggcatacgtcaccactcctagctaattaaaacaatttttttttgtggagatggggtctcaccatgttgcccaggctggtcttgaactcttggcctcaagcccacctcatcctcccacctcagcctctcaaagtgttgggattacaggcaagagccaccgtgccccacctcagaagctaacttttttttttttttttgaggtggaatttcactcttgttgcccaggctggagtgcaatggcatgatctcagttcaccgcaacctctacctcctgggttcaagcgattctcctgcctcagccttccgaatagctgagattacaggcatgcgccaccgtgcccggctaattttgtatttttttttttttagtagtgatggagtttctccatgttggtcaggccggtcttgaactcccaacctcaggtgattcgcctgcctcagcctcccaaagtgctgggattacaggtgtgagcctccaccctggccagaagctaacttttaaaagtccttttatgctggtaaaaataatcatgcaaatctgttttgcaggtccgtggttatgatttcaaagctgatatttggagttttggaattacagcaattgaattggctacaggggcggctccttatcataaatatccaccaatgaaggtgaggcttgtattccaaatactaccccagctcaagtcccaattccttttcagagccatttgccagtcttttaattttttttttattgtggtaaaatacacataacataaaattgaccatcatctttaaccattttgaatatatagttcaatggtattaaatgcgttcatcacgttgtgcagttgtcaccaccatctgtatccaaactcttcattttaaaactggaactctatacccattaaatagtaactcttgattcccattcttagccccttggcaatcactttttgtctctatgattttgactactctcaatacctcatataagtagaatcacacagtgtttatctttgcatggctagcgtaatgtccccaagtttcatccatgttgtagcatgttgaagaattttcttgctttttaaggctgaataatatccattgcgtgtgtgtgttgagaagctaaccatctacagcagattatttacgtgaaatacacgtaataactctgggttttaaacaactgattcagatatgaacttacagaaaataaaatgtttgtatgttggtcggggggtgcctgtattgaaaaatcttgaccacaatagttaaactttactgagtcatcacaagtttatagtatattgaaaattcttgcaggttttaatgctgacactgcagaacgatcctccttctttggaaactggtgttcaagataaagaaatgctgaaaaaatatggaaaatcatttagaaaaatgatttcattgtgccttcaaaaagatccagaaaaaaggtaaaatatgagaaaaagtctacttttctctctaataaaacattgtgagaagtctaagaatcacatactcatatgtacaggaaattattttcaaaagaactaaatataaactttaaaaaagtatacagagaccattatactggattggaaatgaattgatttctgccttctttgtagtatacagtgtaccctaaatagttcagctttttccttgttaatttcttacaaagttgtacattgtgaattctgtattaataaatgccaagttagtggagagatttgtttttaatttgcatttaaaatttataaatgaatgtcttaatgccatttacagtattaataaaggaaagacacatagaaaatttatatttagtgtaataatcatacttatttccatgttagaaagatattttagtaagtggaccaaaaattcaaatagcttccttatcaatgttagacagattgaatgacaagtgagcaaataaataagaacatccgatatgtgtaacttcatgaattaagcagaatcgtagaatgttggggatcattgagtacaaccttttatttttgaggtcacttgatacttagtcataggagtaggacttgaatctcaaagtcctgattcctaacttagggctctgttccttctgaatcttatctgtctgtttcacatatatattccactcagcttcttagcactgagttctttaatttttgtttctctaaagatcattaaaagggaaagactttgatgttcttgatcacatctctagtgtatgtaatagggtttcagaatttattgttggaaatattggaaagggtaagaaaaacaggtagcaaaatttatacctgtgtttttataatttttttttttctgtttctgagtaaacagttaaaaaagacaggaaacacttttcttttatcaaattagttggttaaaggaacaaaattatcctgttacaaatacctagaaatgccagataaaatctatccaacttaaagattctcagatgccagaaataatgaggaagccctaagttaaagaagaaatattgtgaactaatcccatggctgttttcagtgggtcactattcattctggtaacctactgatttggatttataactcccatgtgaaaactggaagtgagatcttgggtccacccagtggggagtttgaactgagattcttcttaaagctaagaacttcagatgtcagtatccttagtaaaaggatagacaagaataaaaattgtcatcaccaagagacaacaaaaacctctcctgaataatcaagcccttcaacctggacattccacaggtttagagtctatactccctatgttatccaggaacccacaggattagaaagttaaaaaagctttaccaaatcagtttttatttttgacggaagtagtcacagagctgcactggaagaacactttcaaactctagctcccattggattcctgaacataatgccccactgtaataaggtcacaatccaaaattaagaaacacacagtgaaacaatgcattatgaactagttagcagacacaagcagaaggattagtgctccagaagatttaggtaatgcagtgaaaatctgaaaagatacaaaattaagtatattgaaaataattaaaattagaagaaatcagacccacaagagaagactgtgactatgacagaagaaccaaatagcaatgccagaaatgaaaaatacagtgattaatgtttaaaactttccatgagtgtgagctggacttgttgactcacttctgatgagtagagtatgaaaaaggaaaaatagcaactttacaatgcacctcctctacccaatgaccaaggttaacatcactattaataatacattgataagactgatatgtgcctcttgatatggtgcaatgagaagggcatatatataacctgtgaggtattcttcctccaaatccgtaacttcggtctataatgagaaaacatcagacaaacccaaatcgaggaatatgcagcaagatacctgaccagcactcttcaaaactgtcaaggaagagagactaagaaactgtcacagattggaggaaattaagaagacgtgaagacggaaagcaagagtatcctatactagatcctgggacagaaaaaggacattagtggaaaaactggagaaatggaatgaagtctgtagtttagttaatagtattgtaccagtgttgatattttagttgatttctttattattatactgtggttatgtaaaaggttcacaatagcagaaggtggtgaatggcatgtaggaactctgtactagctttgcagctcttctgtaagtctaaaattattataaaactttaagaaaactggaagctatagaaaatctattccagtttgtaaaccaaaattaaactttgtttagaacattgctaagttaaaataacacgcacaatggactggttaaacagaacaaccaataaaacaaaaaagagattatttactcatcaagtaccaggcactgtggtaaacacttaacatatattgtttaattctcacagtaatcctttgaggatagcactgttattttctttattttacaaatgaagaaactgaatcacagagaggttaagtaaccttctccaaagtcacacagctaataaatggtggaatcagaattctgacccatgcaattggactagagttaacctgttttaatcagactacactatactgaggaaattgctcagaatgtggcacagaaagatcaaagagggaatatgaaagaaatattaacatttggagggtagactgagaaggttcagtatgtttgtgtgtatgcacatccacacacacacacacacacacacacacacacacacacacacaaatgtacgtatacatatacatgaacttaccaggaaagactagagagagtataggagaagcgatattcaaagaaataatggctgagaattttcgagagttgatgaaagacctatattctcagagtaaagaaccatccccccagaattccaagcagtgtcccccttcttccacttgtacaagttgctgtgaaactactggacacgaagcaaagacaaactcctacaggcaacctcggggaacagattacctactgaggattagcaggtagacttgacagctacttccccaataacacaacagttgaggccagcgtttagtgaaatgctcagagaaaatgcagtcatgtgtcacttaaaatgatgaggatacattctgtaatatgtgtattaggcagttttgtcattgtttgaacatcgtggagtgtacttacacaaactttgatggtacagcctactgcatgcctaggctatttagtgtagcctgttgctctgactactgtcagatacacagtatattgttggccaaagcattaagaggctcatgactgtgactttaacccagagttctccagctagtcagactatcattcaagaatgagcatgaaattattttgcacacagaaattgagttttccagtcacgttctgtcacttaaagaacccataagttgtactttagaaagaaggaaatgaagtcagaagaaaggaatgaataataagaagcaatgttgagcaatcacattgttgagcatattgagaagcaattgttgagcatatgaaaaaataagagtgataatgtaggatttcagtttgcatagcactttcacatttattcagctttttaatctttataataatcatctgaggtgctggttcttaaacttgaatgcctattggaattacctggggagttttaaacattactaaagccaattaaagattctgctttaattggtttgaggtacagcctggtcattggttttgtttgttcgtttgtttgtttttgagacagtcttgctttgtcgcccaggctggagtacagtggcacaatcttggctcactgcaacctccgcctcatgggttcaagcaattctcctgcctcagcctcccaagtagctgggactacaggcgcacgccaccatgccctgctaatttttgtggtttttttagcagagactgggtgtcaccatattggccaggctggtcttgaactcctgatatcgtgatccacccactttggcctcccaaagttctgggattacaagcatgagccatggtgccctctggtcattgggatttttacattcttcccagatagttcaatgcacagcagtgtttaagaacttaggggcttggccaagtaatactgaaccttagagaggttgtgatttgctcaggatcaggtaggtgtgtggcaaaatcaggtccagtctcttaaatgttaaattctttattctgaatgatactcttttaaaagcttgtaaaattgacagtcgtgtctttacttaaaaggaaataagaccatgaagaaatgagttaaacactgagttttgttaaatttggggaatatacttttagaattttcatttttaaagggagattgtgaaatctgtttttagggatctgtggttacctaaattgaaggctggcaggctaccatgtggcaagaagtggaggtcttgatttggtccatttcctctttgtgtgtttaaatatatttttatgccttgctaaaaatgttagatagatattttctagcttacttattgggaaataatattaaatattaaattaatattattaaatagcaaatatattagactctattaagaaatcatgcttccagaaaaaacatttcactaatgattttttcaaagaatctacaataattatcagaatatttgttttgagttttttattttattcaatgtcctgtatcaagtttattttacttttgctttttagcagtttaaggaaagtagagtatactgagtttttattttgctgttgaaaaaaattttttctcatttttgatgatggaatctgacattacacttgaattaattataaaaacttttcttccctcccttcctggttttagaccaacagcagcagaactattaaggcacaaatttttccagaaagcaaaggtaggaaattccagcttttgattatgtgtgttcataggatgctcctcaattactcagattatgttcagtgcttagaagttggatgattatgtttggaaaaatgatggtagataaaataattgcagaaagcactatgtatacagtctttgataattaagataattgcttcagaatttagtaaatccgtttttaaatattaggttaaactgatcataggaacaatgattattaaattttgccattataaatataatttgtgaaaaataccgaactctggttttaaggtttactactgaatttgtaaacatctcatttcccaaatatatcagatagtaggatgttactgtagttggaaatgtaggaccatgatctcaaagaacatacagtacagcaaactcttcatagacagtggttcatacagtgtactacatcttaattttctgcctcaatttatgaaactgtggtagtaacatactaaaggagcttcagagtgaaagaatgaaagtttttctcacacttcattacagaacagttactatatcacattttgattatggtgaacttttttgtgggttttttttggtaccttaaaaacttgtaagaacaaaatacttacttttcctctccagaataaagaatttcttcaagaaaaaacattgcagagagcaccaaccatttctgaaagagcaaaaaaggtaaatcagaatttaactcagttttcctgaagaatttactttatttttgcattttgaaaacatgttaagtaatacattgttaatagtatatgagaattactggttttctgtcgatcctttctaaagcattctttgatacattcattcagcaaatatctttggtctaccatatgccttggtattactctgctatcttttaggatgaaaagggatgctagacagtaattggtaaattaattctaaactctgtttgataactgtttccagctaccagagtgagttgtgattttacatgacatttatagctttgggtataagtcacagtaccctctttggaactccaaattttctactgcctttacagaaagactgaaagaactttattacgcatatgtaatttctaagaagtttggtcatgatgtgagcatacagaatgctttaatatctcagtttgggcagaatatattaatcttcctgtccatgatacttttatgaacctctgtgagagcagggagaagaaaatcctcccttttcctcactcttacttctctgctcaagcagacttatccaatgtgaaggaaaggaggcagtttgggcttctgctgatgatagacttgaagaaggtaaaggtcttacaccttgtataatatagtggtaggcctgtccaagaagttagaagcattatgtctagcagtggcttattctcttccgtagatctcactgcttgggaattttgatacattccaagaatttaacacaatgaagaaccagaaatgtatattaaatacttggaaatgatattcttaataagcactggtaaaacagttaacttgtctctattttagagatatatctttttcagtggctataatgcatcgttacatatcagaatcacttggggacttaaaaaaaaaaagaaagaaacatggacaatgtcatcccaaaccaattaaagtcatgactctagtggatgagacctggacaattattctcatggatagctactaggttaaaaactcacttggctcattccttcactttatgtcaagtctactcaattggcctttcctcagaataatattctctgattactaaaacagtaccctcccatgactctctatccctttaccctacttatcaccatctgacattttacagtgtttctttaccattagaataacagcttaatgagaacagggactttttttcattgctgtatcttcagtgtgcctagaatagttcctgacacacaggatattcttaaataatatgtatatatttttatgcttattaataatatgtataaaatttctatgcttattattgtttataataaatcccatctgagatacgtgttgatttatatctgaaatctgattaatttaagaagagtaagttgggtgcagtggctcatgcctgtaatcccagcactttgggaagccaaggcaggtggatcacttgaggccaggagttcaagaccagcctggccaacatggtgaaacctcgtctctactaaaaatacaaaacttagcctggtgtggtagtacatgtctgtaattccagctactcggaaggctgaggcatgagaatcatttgaatgcagaagagggaggttgcagtgagctgagattgtgccactgtactccagcctgggcgacagagcaagactctgtctcaaaaaaaacaaaagaagagcgagcctcagaccggggatatggtgactcacgcttgtaatcccagcacctgtgggaggctgaggtgggaggatagcttgatcgcaggagttcaaggctagcctgagcaacatagtgagaccccatatctataaaaagaatttaaaaattaatgagctatggtggcatacacctctggtcccggctattcaggatgttgaggtgggaggatcgcttgagcctgggaggttgaaggcacagtcaactgtgatcataccactgtacttcagcctgggtgaatacctgcatatatttccaccctcctgccaaaaattacctactaaaagaactgttaagagaataaaaagagatcaagcacggtggctcacgcctgtaatcccagcactttgggaggctgaggcggatggattgcttgagctcaggagttcaaaaccagcctgggcaacatggcagaccctatctctactaaaaatacaaaaattaaaattagccaggcatggtggtgcgtgcctgtggtcccagctactcaggaggctgaggtgggaggattgtttgagcctgcagggcagaggttgtagtgagccaagatcatgccactgcactccagcccgggtgacagagtgagactgtgtctcaaaacgaaaagaaaaaagagaataaaaagaaaaggcataaacctctagtggacaaaaaatgagagaagtgaaagctgcaaccaaattttcaaaactttgatgcccataaattagtggtaaaggacttggcaaatcagcagactataattgctaagccagtattaagaaaagcttgaaagctaccatatacaacagaaccctgaaaggtaagggaattaatagtgccaggtacctccagaaatgagagtgaaagtagggctaaaaacaggaagattggttgacaatcttaagatagagttagactctggtccctcccccactccatgctgcactccaggagatgtctggaggtttattctgcagaagggtaaaagaaatggtctctgaactgaaggacaccaggcacagttaaacatgggaataacttactgaaaagggcatttaagtaattgtttacacattgaatgttaagaatctatccatatcacttcattcaactcctggaacataaacattaaggcttattaccccatagacaagacgttgaaaaatccttatttgatcaatctgactagcctaagaggaaaaacagaagtattgacattggaggtgggaaatgctcacccacatcactctgcagtgaagcaaactccacccacttaaaagctcagtgtttccaatcagtgctttagttccttgctcttaaatatgagcatagatctaggatcacaggatacctcagggaaacctcttaatgtgaaaaatagaggtcaaaataaacagaaaaaaagagaaacttacaggaaacagactatataggaagataatttaaataaaatcatgactgtctttagagataagagtttatatttgccaggagtggtagcccatgcctgtaaatcccaacacattaggaggagaagtcaggaggattgcttgagctcaggagttctagaccatcctgggtaacaaggcaagacccagactctaccaaaaaaaaaaattagctgggcatggtggcatgtgcctgtggttccagctgctcaggaggctgaggcaggaggatcgcttgagcccaggaggtagaggctgcagggagctgtgttcgtgccactgcacttcagcctgggtgacagagcaagaccctgtctcaaaagaaaaaaaaaaaagagtttacattcacaaaaagtgaacatgacactgttaaagaagctttcgtgccatgacaattcagtgaagactaaagaatcatcatcttcaaatggccttggtacaactgaatattcacatgcagaagaatgaagttgggtcttttactctcgtcctacaaaaaattaactcaaaatggattgttgacctaaatataagagctaaagttataatactgttggaagaaaatatagctataaacctttgggaatttgagctaggcaaagcttccttagatatgataccaaaaatacaagcaataaaaggaaaaagtaggtaaattgattttatcaaaaattaagacttttgtgcttcaatagacgctggcaagaaagtgaaaagacaacctacagaatgggaataattatttgcaaatcatatatatgataagggacttgtatctagaatatataaagaacttttgcaactcaataataaaaagacaacacatttttaaaaatgggcaaaggatctgaatagaaacttcttgaagatacataaatggccaataaacacatgaaaagatactcagtattattagccatcagagaaatgcaaatcaaaataacaaagagataccacttcacacccactaggatggctataatcaaaaagacagtaacaactgttggtaaagatgtggagagattggaacacttctgcactggtgatgggaatgtgaaatggtgcagccactttggaaagcagtctggcagttcctcagaagcctaaacaaagtcaccaggtgacccagcagttctactcctaggcacacgccagagaattgaaaacgtaagtccacacaaaaatgtgtacgctgctcatagcagcattattcgtaataaccaaaaagtgtaaacaacccacatgctcatcagctgatgattagatttataaaatgtggtatattcatgcagtagaatattatttgacaataaaaaggaatgaagtactgatacatgctatagcatggatgaccctttcaaacattatgctagtttaaaaagcccatcacaaaagaccacatgttgtgtgattcaatttatgtgaaatgttgaaaataggcaaatgtaaagagacagaaagtagattagtggtaacttaggactgggggttttggagagaaatgggcagttactgctaaagagtatggcatgtcttgtagggagtgataaaaatgttctaaatttgatggtagtgatggttgcacaactttgaatatactaaaaatcattgaactgtatactttgagtggttcagttgtatggtatatgaattataagggagcttttagagaaccaggaccagtaccaacaaaaagcttttggaaattgaaaacagaagaaatgaaaaattcaatataaaggttgaggaaatttcccagaaaagagttcaaaaggcccagatatagataacaaaaaagctgagattagaggaccatttgagaaggtacagcatttgagtaaagagaattccagaaaaggagaactgagaaaaacagaagaaagtaaatcattgacaaaataattcaagaaaaatgtccaaaactggatggtcaggaatttccagattgaaagagtcttgagtactcagcacaattaatgaaaatagactaatgctgacatacattaccatgataagtcagaatactggaggcaaaaagaagactctgtagtcttccagggaggggggaaatgtcacagacaggatcaggagtcatgatgacctcagcagcacttctggaagccaaacaatgaggcagttttcttcaaaggtatgaaagaaaataattactgatgcagccttttcttttttaaccaaacaatgaatgaagtgtgaagatggaatcaagataagttcagaaatgcatgactttaatacatgctaatagtggagatggtgcttaaactaaaaacagaagtcatgtgatccaggacgcacaatcctctggctgatggtagaatttgatctgaaataggagacatgctgtgaaaccagtctaggatggaacagatcaggaggttctggtgagagtcttcttcaagaagatgataccgacagaatacccatttgaatgtggtaaaaggagttataaacagctgagagaataaatactaactacaggggaaatagaagtggtaatgtatgataaggttcagctctgaatatgatatatataatcatgttatgtaaacattgaatattgatctaaccaaaattatagtgtatcttgagaaaagaatagagatttcataacagagttaaattttcatcttctattgtgggaagtcctacagataactcctaaaaccaaaaaatcagtgaataatgataggaacacatgttcaagagatgaatgtccaaaaaagattagctaaaatgagttgaaagtggttgccagtggagatgaagctgaaggttaggaggttgctgtttttcttaacaaaacatgcacagctctagtgctcttgaaatcatatgcaagtataattttgacttaacaaaaagaaaaaataacagattttaaatcttgggtttattcattttgagcacccaaaacctcttttttttttttccttaaatgtctcaggacatttaaaatcagattttacctgtgattttacataaaaaggattttgatgtttgggctcagagtatagaagtacagcggttgttactaaagacaggtagtagagattgtcaacagagagcaggtgatggttggaggatatgaatttgtatgggaacatttatggggaaaatgattatctacttaatggattgaagtgatagaagaagagagaaatatggagttttctacttagtaagcatgaaataccaccataacccacttctctttctaatgagcaggttcggagagtaccaggttccagtgggcgtcttcataagacagaggatggaggctgggagtggagtgatgatgaatttgatgaagaaagtgaggaagggaaagcagcaatttcacaactcagggtaaattttattaaactgtgtactttagctagaactttttgtagttcttgttcagcttaaccagctaaaatataaagaatacaattgtaacaggattttcttgaacagcttattaataataggagcccagttaattctgcatggaaagttggacttagatatctgtttgaatatgataatatttagagtatataaaaatgacccaaatctaccaaatctagagacgaaagctgcaaatgtctgagatgcaaaatacactggataggattaatggccaattagacattgcagaagaaaagttagtgaacttgaaggcccagcaatggaagcttttcccctgaagtctgttatccttctactaaggaggaatggtgtatctcttattcagttggtatatcctagatatctgtcgtgcacacgtgtgtgtgtttcctaaaaacagtgaagacaagagtcttccttttggttcatttcatcactcttgcctaaaagcactgcctcaagttgtcaggactcattcattcctaagactggaagtgtttataaggaaatataaatgtttgagggtattatacctttgactgcttaggactgtttttgtgggatgaatagtgagtatactggtatattgcttcctgcttttaggatctgctttggtgaaagcacttaagactctcttgataaacactgaatatttgttgaccttgtttatctaatgaggtatttgagtctagtccttctgcagagctaagtttgtaaagtccttgccaatggaagttggcaaaaatcgattaagctctaagcttggaaacactgtttagaaggtaaatgcaaatattcgtttacatacaattgtgagtttaaggtttctttataaatgtgagactatggcatcctttcttccttactttttcatgtgactcctgtttgaattgatactctcatgtattgttatattaaagctaccagaggaagctaaagctgcatgaattttatagttctaccttcctgtgaaagggatgatgatgctatttttcttctgactaacaaatatttggagagatacattatagcttttcagtatctaattattactctctagctatctatagataaatttggtagttctgaaatagttatagtagctttcttataacctaatacattggtatctaaacaacacagaaacttatatactttggccacagaataagtagttttctgtccagtatttttcatgttatctttatagcatttttgagaccatgaattctttttaagaacatgagtcttttaaaactaaattgaactatgttaagaaaataatataccatgaccaaacgggtagggtgcaatgatggttcagtattaggaaatctcataatattgatagatctaaggagaaaaatcttatttttattttcatagattctgaaaaaggctttgacaaaattccgcccatattcataatgctcttatgtagatccagatttccatctttatattattttccttatgcctgaaaaactttccttaatattttttgtgttgtaagtcttttggtgatgattttatgtctgaaaatgtctttgttttgagaatgtgtgtttgtagggtatagaattccaggttgacaggcttttttctttcagcattttaaagatgtttcttcaccatcttcttgcttgcatctttccactgagaaattttgtgacattcttattcttgttcctttataagtaacatgtcttttttccctggctgcttttaagatttcctctttacaaatggttttggaaaatttgattgtgatatgcctaggtatatttttcttcatgtttcttgtgcttggggtttgttgagcttcttggatctgtgggtttataggtttttatcaagtttggaaatttttcagccattatattttcaaacattttttttctgtcccccagtaacatatatattaggcagctcgaagttgtctcacagcccactgtttctcttaatttttttaaaattctttttttctgtctattttgtgtagtttttatggtagctttcaagtttatttatcttctgcaatatctaatcttctgctaatcccatccagttcctgtttcatctcaggcattgtagtagtctagaagtttaatttttttcccatcttctatgtctctacttaactttttggagatatgtaatacagctatgataactattttaacatccttctcttctaattctaacatccatgtcaattctgaattggttttgttttgttagttattctcttcattatggcttgaggagtattttcctgcctctccacatctagtaatctgattagatgccaaacattgtaattttcaccttattgcttgctgacaattttgtatttctgtaagtcttcttgagctttgttcggggatacattaaagttagttggaaatagtttaatgcttttagatcttgcttttatgatttgttagttgggtctgtagtagtgttcagcctacagccatttattccccattactgagacaagacctttttgagaacactacccaatcacctgtgagttattagtttttccagtcgggctggtggaaataggcactgttcctggccctgtgtgagtgctatgcactcttacctctcatcgtttttgatgttttcccccctattctcaggcatttcctcacatgcactcgttgataagtattctgtcaaacattcaaaagtgaccgtctgcagctatctagggttcactctctttgtagctttctccttccttgtactgttttatcagcttaatctgccttggtctcccggtctcttagctctgtttcctcaactcaggcagttccttggatttcatctaggttccacctccctgtgccacagcttggaagctttcaaggcagtatgtagggacaaggcccaccactttttttccctgtcttccaggaatcactgtttttctttgcccagtgcccaatgtcttgaaaatttttgcttcatatattttgtctttttttgcagaggtggggttgtttcaggcagaaagataaatctggtccctgtttattcatcatggcctgaagtggaagtctacaattatattttaagtgaatgtgtaactgtactgaaggggaatataaaaagaaagaatccaagtaacctatgaatatagtatttgactatgtgttctcaggtggagttgatgggggaaagaaaacttaagacaaaccttgagctccttttattaggattatttttcatagttgtatatgcaaaacagttcagaaactcttgtaggattgaggaaatgagtaaatgtctcaatgttcttgggagccaagattctcactatagaagaagatatacgcaggtacggaacagggcaaagtgagaaagaatcctgtggcaatgggtttgaattggaggcattggtgtgaattcaagctttgtaaagtatgtgtgtgaatgtgtgtgtgcgtgtatgtatatacgtgtgtctgtacttgcatatatttctcagctttgtccactgaatggcctgaaagcaaagaaaccccaataatgacatgccttgtatccagataatggtctctaataccattccccactaaagggaagcagagctcctttgagaaatggttgattccagggcttgggcagggaaaatataaggggaatcttgaatattatgttcctttgccagaaggaaaagatacttaaaaaaaaaaaaaacaactcataaggacacaagcgccagctcgaagttactcctactggcaaaatctgggacaatttaaccaccaaaataaagtgcaataattaattttaaacaatttagaaaatagctatctatgagtctataccaataacaaatacatatataaacaaatgggggaaaaggaatggttcttcattgcggtaggctaccaagtgctgaccagtaaatatggacgagtgttggagatggaaaatcatcattttacaatcatcgtcgcaaggataggattaggcaggaatcatcaatgaagctaaatatagggggaagttttgataagcaggatattttcaaggtcttaaagtgtgcccccacatattacctattcaccacaagggaaaaaaataaggtttttttatactggagaagtaggaaaattccttgactaggtgattaaaattaacatcaccaatgaggggcagatgaacatgggatacagtaagaaggacacgtcagtatgtagaattccaagtgggaattcatgtaaatataataataaggaaacattagataaaccccatgtatgtggtgggagtggagggactgtattctccaaaaatgttgatgttccagattttaaaaatctaagaaacgtgaaaactacctgcaatacatgatcctagactgcattttatactggaggaaaaacaaaaggctacaaaggacattagtgttgacatttacgctataaattagataaaagtattatatcatgttaaatttaatgagaactatagtgtgaagttatataagaaaatatctcattcttaggaaatgtacactctgattattaagtggtaaacagccatgatatatgcaacttattctcaaatggtgtaggaaaaatatatttagaaagagaaagtgagcacccaaatgataaagcagatgaggggaaaaaaggttaataataaatgaattggggtaaagagtatacttacgttcttgtattgttattctagcaccttttctgtaagtttgaaattatttacaaaagtttttttttcttgtagtctggatgaattcattatttacaaagttgtttgtttttttttttaaaaaaaaggttttgggttggtcacttacttggtatgctacattagctattacctgaactttgattactccttaatgaaatggtgataaaagtgttaaaaaaaaaaaaccatcaattgatctttgacatattctgactaagtccatcattgtcagaatttaccataaattgttattcgtttagaggtaagttttttggtaaactacagtgcctgtatccagaattactgctaacttttattatttaccaaataaacagcttaaattttcatatggcagattgtaattggtcatttcctaataaatgtggtttacaccagatatttgagacctcacctcaagtatcagtttatttccactacctttatttttgctagtggtccatgctttatttttggaccacccgtgtttctttagataccagattcccaaatatccaacaccaagaataagggtagtagactctttacatgcagctttcagatcatttttggctcaagagttttctccattaaagcttgtaaacagaattactctgctttgagaatgtgttggataattagcttaaaagtttaggtttggtctgggatcttatatacataatatgttcacgattagtagaaagaattttactttggagaatgtgacagtcccattatgtatgcttataaagctcacaattttaaaatacggaattttaaaattgataagtacattgatgtatttgttacaggctacctggacaaaaaatacaatactatcatgacagttattttttccagaaaactttcagtagacttgctggtgagttaatatatggatcagaattaaatggagttgatttgcatttaacatcacttgcagtttgggactgactacaagtaacctgagttgtgagttaacaatcatcctttttgtatttcgtttagtctccccgagtgaaagaatcaatatcaaattctgaggtaagtaattgtgattattgaatccttgttaaagtaaatgtgcttttgttttggtttcaattcgaagtgcttttgtttgtgcatatgtatgcttaaatgggaatgcaactttataccaatcgaattttaaaagttggcgtaagggctcagaatgttcttccttgcctctttgattttgtgaattttttatttttatttttggcttgggctgctggaagtgaaaagttatttatttatttatttatttatttatttatttatttatttatttattttgagacagggtcttactctgtcacccatgctggagtgcagtggtgtgatcacggctcactgcagccttgacctcctggggctcaagtgatccttccacctcagcctcctgggtaggtggaaccacaggcacacaccaccatgcctaatttttgtattttttttagagatagggtctcaccatgttgccctggctggtctcaagctcctgggctcaggcagtctccctgccttggcctcccaaagtgctgtaattacaggcatgtgccaatgtgccctgctgaaaagtagtgtttttgcattaatttgtttgcgaatttgtcaaatgccacctgtcctttttgaattctttctttcagcctcagcctcttctcttgtgaaataaattctattttccgtggttactgtgtcagtatgataggaaatcttgttaaacagattcttattgggctggttttccctattctcattaccggagaaagacaatcatttctgtggtctgttctgtcatacagtcttatttccggcagcatcttcattctgagctcagtatttggttttaacacatctcttactcttaaaccaattctattcttgcctctttgctaaaaagtaacctttgttttttcatttattttgtatataaagtacatttgtgtatgtgattatgtacatttgtttacatagaactgtattaagagtaaaaacaaatactgttccttcacatattaacaggccgatatctgttaacttgtattagaactgttgttcacttatatgtgtggctcctcttcttggtaggggaattgcgttttcctgccccttgaaattacatatgccatgtcagttactctggccagtggcatgttagcagaagtgagaaccactcatgattccccttgtctccttattcctgctaccatgacctgcattcctgagtgaggatgataccgagcttgttagcccccgctggcgagagatagacttgaagtgtgtccaataaacaactgttgttttaatccactgacacttcaggattatttgttacttctaatttaacctatgttgactgatacttgatttctcagaaattgaatgagaggctattttacagattatctagtttttatttttagtcttctccttgttcctttgcctaaatatcatctccacatgaactcttgcatactcatattctcatgctcattactttgtttttaaatttgcgataaaattcacataatgtaaaatttaccatcctaatcattttcaagtatatagtccagtggtattaagtatattcacactgtagtacaaccatcactaccatccatcttcagaactattttatcttcccatactaaaactctggctattaaacagtaactgcattctccccagtcgctggcaaccaccattctattttctgtctatgaatttgcctactctaggtacctcatataagtggaattatacagtatttgtcattttgtgaccggcctatttcacttagcataatgttctcaggttcgtcagtgttgtagcatatgtcagaatgtccttactttttaagggtcagtaatattcctctgtgtgtgtgtgtgtgtgtgtgtgtgtgtgcgcgcgcgcgcatgtaccacattttattcatctgtcagtggacacttggtttgcttctaccttttagctgtggtcaattatgccattgtcaacataggtgtacaagtatctctttgagaccctgctttcaattctttggggtgtatacctagaagtggaattgctgggtgtatggtacttctatttgtaattttttgagggaccatcatactgttttccatagaggctgcaccattttacgtgctcatcaacgagggttccaatttctgtgcatcctctcattacttttaaaaatatatcctttccatctttactatagataaatgtaagtacatacaatttggaagctaatagtcttttgaaatagtattaataattaacattttcaaaagtagtcttaaaggcctacttttttgtaaaaatctagaaccaatgagtaatttatgacttcttatgtatgaagttaaatgaacacaaaattttattccttgtctccttgattttgcttatgtaatatcacctattcagcctgtactattactctttgaattttttctctttcaactttacattttggctattgcatcgttttttctcccccagtaactgcataattttgaatatgtttaacttgtttttatactcagtatcagtcatttcccccaaactacataattaaaatttatgaactatttcagacatacaaaataacatatataaaatatctttttttagttttaaagcatcacattcacttttaaaatgcatttcagatatgttaaggaattattggttgattgtctttgtaagaaatacaaagtcctcatgcatggaaaaatatagcttctgtaattttgtattacatacttaaatctgtattttggaggtgctgttttgctgggcaaaggaatggaatagattttgttaaagataaatataatgcaaactgaagacagacacaaaagactatatattatatgattccatttatatgaaatatccagaaaagcaaatttatagaaattaggatcagttgttgcctatggctgggtgtggaagcaggaactaactataggcatgagaggactttttgggggtgatggaagtgttctaaaacgattgtggtgatggttgcacaattctatatatggtacaaaaatcgccaaattgtacagttacagtgggtaaatgtagagaaatataaattatacctcacagagttgttaaaagtttaaaagcctagaaatatttgacttccgtttggaatagatatattcggagtagacacaaaacctgtacactacccaaaaactactttgaaaatatcaccctgaaaggctgaacttgctgtcagcagacctgcctccctttccacacaacttaagcaacactgtgtgtgtttttgttacagctctttccaacaactgatcctgtgggtactttgctccaagttccagaacagatctctgctcatctacctcagccagctgggcagattgctacacagccaactcaagtctctctcccacccaccgcagagccagcaaaaacagctcaggtaaagccggggatatggtttcatggtcactcctttggatagatgaaaagagcagatattaacgtggaatataacctaatgtaatcaggttaatgtcttggtagattttgaaacaagttagaaattctgtcttcacatttttaagcatgtacaggtaagagaattttacaaggatcacatgcaggtttttaagcaacagaataagttaatgatggaaatatttcaaacatcaaaaattttgggctaatttcttgtcagctttgtattagataattacatttaacttcagaatgcagctcatgaagttcaacagagactaggagaatcgatggctgtactgtttttgttgttgttgttcactcaggcttatactttttattaatactctttgttttctgtggtttttctctattactctttttaagttatttgtcaattttgtgagggttggtttgttaagtccgggtattataatctgtaaatcatttatccaggtgcacacaaactttattaaatcatacttcattgagagcagccaagtgaatgaaggccccgtagtgggctgctacatgctgtgtaactccttctctcccttcaataaacctcagacactgcatacaacatgtggccctatggtacatggttaaagtaagactttcaacgtccatttattaaatattagaagttccattttcttgtctaacgttttagatgaaaagaaatataaattaaaggtctgatttttttttttttcttttgcaccccagtagatcatctcgtgttctgcctttggagatcactgctttgagcatttccaattagtcatggcacttacttcatttaactttgcatccctcaagctttccatttctgcttggcatatgggaaaagatacagttgtcttaggaaaattgatggaaaaattagattcattttataaacaacttaaatcgaatgcatgtcctcccataagcaagcgctgtacaattttcagagaggattagtttagccataaaaagactggaacctatgtatgggttggatggatttctgaagggcagctggttcagggtctaccttttgtactgccatatggtgcactggcagattttttaaaaatgagaaacctagctttgtgtttttcagtcttgtagaggggaacaggggtctcagaaatataaaatgtaaatgtggctatatgtgaaatttcatctgggcttgagagttttctttctcattgtgttggacttaaactgacattcagcttttgttgctgccttggagtgcatgtcctcctccagcagggaatgtcctggggattagtatgacctcagctggagatgaagaaaattgctgccaagtaaatgattcctctgccagtgaccattagtcacctccccacttaatgtttcaggcaatgactgtatacctttcaatgctttttaggctttgtcttcaggatcaggttcacaagaaaccaagatcccaatcagtctagtactaagattaaggtaagtagacattttttgttttgttttcttttgttttctgaatattctgcatgtgctgtaatagtctgtgcctgagagtaactggataggattgtatgtcctccagcatcaagctctgtttgcttggtggtgtattatttttccccagaaataatagcaacagtgtgaggacctgcatgttagcaggtgttgtgactaactgatgcacatgttctctcagttgtttctgtgctaattggtgatgagtttgtgtatttacagtgtagctagtttgggttaggaggtgtagcctgtaattgaggaacagtttttaggggagcagcactaactggcttatctgaagatcagtcttataattgtgacgaggtaaactctgagatcaactaacccaagaggggagcactttttgattgtggtagatcaaataaaggccttgtttttagaaggttaaaaggaaacttctaaatgtttttgtagtctgtttctgttttgcagcaagtaccctaaattggtggttcttggtgggaacatatagagaggtcctgacagattgctcagcaggaagtgccataggtagcagtctgttcattttaactccctgccccgccccccccgcccctagcactagtagctggattcaaattccagagctttcttgtcagaatcactatggctgttgtattgctctagttaggtctctttctactcataaatgcatttgaaaaaaaattagtattaaagtatcacttgaggcaactcaggccttttaaaactattactaacattttaaaaaagagttccactgaattaccattaactcattccccttgcacatataaattcctagtcatctttctgtaaggtcctaattggagatagaggcagcaagagctatttaagagaatgtggtaaggagaatctcattgctccttgccactaggagcaatgcatttatgccataaatgtgaaaaacatatttggttacctttcctttacagaagcctacttagtatacctggtctcatctcaaaaattctgagttactaggatgtcttgacaacttcatgctgttttaaatctacataaagaataacactttaagaaaattattgtgaaatgtattaagcacagactatgtatagcactcttcggtactgtggaaaggtggatactgagaaaagagaaaattaaatgactcccttaataatcaagtctaggttggaagttgatttgaactatgtacttacacagctaaaagcaaatttcaggtagtatatacatgcagaagtataagtttgtatgtacctgtgtagaaagaacgcaatgcaagggaaaatcatttggggcatgttatatttgagatgggtagttctattttaagcacaatttcagtaacatcctcaagtatattattcatcaaatagaagtaaaccctctccattatttatataaaatagatttgagtcctaagtgagcaggcatatctgcccttagatatagtgttctcatttctctgtctttaaacaaaacctccagggatcctgcttaatctcagtgcatggtgtgatcatcactgtaactgtacctcaccagtcaggtttgaatttctggagtcatatagtaactctgctaccagtatggacccaattcctttccctatcctctctgcctacctaaatcctgcatatctgttaagtcctatataaaaactacctctaaaatttttccttattatccccatctctcatatattctttgaattcctatggaatttgagggagtatcatgtatttcattttatgagtctgccaagactgatcaccagaggtaggcaatgaattgtgggcatgtaggagtggggataaggatgaaaaaggcatcctgtatcattttaatcacacctccctgtgctcatacaattttcctcttagttttatatgttcttggtgtgggaataaggatgggagtgggcatataagaatctactcaaaggcatgaaatttttatattgatcagtaagggacatagattcaaagggttgtaggacaattagatggtcattccgaattggttttgctctgagctctgcagtgtgaacatatctgaatacatcatatgatctatgggaacaaaacagactttcttgaggcacagctttcttaatatatgttggcagaatctctttgcataaatttagaaattcttattttatgcattctgctttctttcataggaattccaaaaaagaactaaatgatattcgatttgaatttactcctgggagaggtgaggcatcaaatggattgaaaacaaaatagcttccaatttgtgattcaatgaaatgtgttgtgaagtttctgtcctttgtgaagttttgcttttaaaggataataaaaattttcctggttttggcgagtatatgagtgagataaaaatgcagttcgttgactactaaacacatttagaaaaccttgtataataatacaaacagtaataaatatatgatagctctttacagcttactataggccaggcattgtcttaagcgttatcttattaaattctcacagcagtctactaaggaaaaattattatccccatagtatcgatgatgaaatcaagacttaaaggcaaagtaacttgttcaaggtcacacagctggaaagaggtatagctggaattcaaaccagatctgtcagaatccaaagttcattctttatacatggttgttctccatgatggtaaagaaacaaggtctgcagtctcctctctcctcagacagaagctgaggtctgtcatgtactgtttctggctgttgaacttcaccttgaacaaggtgtgttttgtttcttgcctttattactcagtgttctaatttggggagtagccagcaagtatctgttctgtgtatcatgcttattcttcttgctgtctcactatcatgagcaactaaccactaaagagaaaagatgcaggtgtacagaggtgtcacctgttttactttttaaacaccaggcaacatcacattttcaggaattaattcaaattgctggttgcctgtgtgaatgtgtggacactgtctccaccgcagtcctcctgttccctctgaggggctcattttcaagcccttggcaaccaataccactgagttggttgaagatgaggttaattggggatattctgtcctcatctttttagtttctggttatacccattgctcagattgtaccacctggaataactagataagaagaaaagcccaccagaataaaaaagtaaatgattttagcaaaaaacttggagtatgattcccaaagagaagagacaaaaattttttgagacaaaaattgttgccttagtttttgagaataaatcattctggttttttagccctagagatgttcagtattcaacatcatgtctcagatatttgctacctggtttatacagattctgccctctagctagatctgtgagaattccacttgagataatctcagtggtaggaaaagtctttgtatggaaggaaggccctgcctgccttcttggttctgtggatttagcatccagcttgggcctagcatggcacactgacacccacatgagctgtgagagttaacagtggcaagcacgcacaaaaaacagagcactgtcttctttgtccttgcagatacagcagagggtgtctctcaggaactcatttctgctggcctggtcgacggaagggatttagtaataggtaactccattgcgttctgctcatgtgctcctgtgtctctgtctgtatacttagtacatagaaaagcaggttttttattccactgagtaggtctgatggttcttgaaatggttcttggctttcctgaaattataggtaatgggacagttccttacacacacacaaaatttcacctctgagtttgctttgtgacctccaatgatggtaagtgaaagcacacccaaggtctttaggagattaatagaaattatggcaaaagtcacaagttaaagtaagcttggccatatctgatctgttttggatacctaatttttgtggcccaagttgagcaaaagtcattagagatttagtactagaaaagcaggaaggaagagagaaggcccagtgaggccacaggtccatgttactgaaggaaaagaccatgtccttagacacagttttccgtgaaaaaccagataataaatagtttaggccttgcgggccatgtacagtgtctgtcacttttaaaccactcttagcttgccggagaacaaaaacagaccacaggctggtttgttgacttctggccttgggctttctgatccataaatcaggaaatcatacctcttttacctgcatgtttttcctaggttaatacaacattttaaagaaagttaatttgacagtggttcaaggtgtactactcagaaatgagtttaaaagacactttcattaggggagtgattatttgatctgtctgcttccattttgattgtacggagcatattcttaactaccatttaagcttttaaaatatggttgaaagtggatttatgtaacttctcattcattaccttctctgtttgtatgattacagtggcagctaatttgcagaaaattgtggaagaacctcagtcaaatcgatctgtcactttcaaactggtactcatcccttcttccttgtgaaaacatcttgccttttatacactggcagcttctccagaccagcttctatatcccctgagtgatgagaatattaaaatgtggtggattgtgttcatttagcctccccagtgccctgggctgatgtttccctttgagtggccactcttcctctgtccatgccaggaaacctctgaccccagagacccttggctattcataagagaaactattagccagtctgactctagctgtttacccagcccccctcttttctggaataaacaccttcgtcagtctcctatttgtatcctagggacctgttgcccactgcctaccttcccactatcccatgtctgttttatttgctacctgcaagtttgtttataaataatcacagtttctcattttgtttggttcttaggcatctggtgtcgaaggctcagatattcctgatgatggtaaactgataggatttgcccagctcagcatcagctaaaccacaaccctggaagaggcggcctaaggagattccacacatgcgtatctctgttgcttctattggcctaaacccactactgccaaagaacccagcaacaaacctcccggctaggagctttagaagtctttatgttcttcctgccatcattcctccttttcccacagggaaagaaaagttggatcactagtggccagcatccccagagttccgttagtaaacttacttcatatgtcccctgtcttcctccatctgagaagtggcccatgtgcttcaaggcccaggagggagatctgtcagctcattcttgccttactccaatgatggcccaggtggaaaagtagcagctgtatcgggcttcctcatcctgcctgttcccccacacctgccaggatatggacatcttgggatatctctttaccactgaagtagaattgattgttcagctggagcccagagaatttaatttaatgttttttctttgtacctgatgtgaattctagcaacctttgttaggaaaaagcacagcctcagatggaggcagcctaaactgtgttcttgttttgttcatggtgtttctaagcgttttgctgaagctgctctcaggcacccccttcttcattgctctctccagaaagggttgctagccttaacttcagctggtgcaaaacatctgactgtagccgaacttcagccatcagatccttcaaagtggaactttggattgtttttacagacaacatcgagtaatggcttgtaaatgtgaattttgccagaggtggtttttgaacaggaaaatcataattcatatcattggagaagtatttattttcaaatatcaaattgaagaaaaactcaatcctcccatgaaaatcagttcgcctggcctccaagtcgtgaggaaatgggtatgcaaggctgagatttctacagcaataaaggagacacacactgggccagagaggcctgccttctgcctgctctcctgcactgaccctttggagggggtctctgtgtgctgaagctaactcaagatggaaagtgaaaccacatgtgccgtgacctttaggttttatgagtagacagtgttcatttgattttctacagaaataatataaattattctttaggtttaaaaaagagcactcataatgcaatatgtgaataatcagtgaggttgatttttcttttttcctaccgtttcatagtctttgtctaactgctagtaaccctaccgagttttatatatgagtgggatactcaatctggccttaaaaagatacacaaagatgggctgtgggtccctggaaagggggagagttgccctttacagaatcactcgagccctttccagcactgttggtctgatgaacaaggttgttttaccttattttctcttggaacatatctgaaaaccttccccacaaataacttgtcacaccttttgtttcattctgagtctttagttttagtcatgggctttcttcacctgctctaggtgcaaaggcatgttgggaaagagatggatgttggggaggaagagaggagatggatttcagttgggagttaggaggagagtaggtgagatgatcagacaccggagttcaacgtcccagcagtcttggtaaaaggagggagcctgctgagccaggagggagaaaagaagattgaccagcttgctagaaaaatacttagcttttctttttctttttttgtggaggggggacggagaggaacaaggatggggaggtaggaatgaggtatagaaaagagatagcatcttctttggcacaagactagtggcttaccgcttaccttagagttttgttttttttttttcaaacccatcaaaatctacttatttatgaatccaaggggtggcagcatcactctgttctagcattctttgtggagatggtctggtgcctagctgggagtgagcagcagcccatcccctgttcactttctctagcccatcattacctgtgaactgcagtggggcagtcatggcaaatagaattgggctggggtttctccttcttttcagttcattgtttgccctgctaggaattagaagacagacaccatgtcccaggacagtgttacttcttctgcatgatgtgtggtagactccctttgctggcttgtgcagtgatactgagaaaatacatgaacagaaactgcccaggtggaacagcacgtaacctagtgagtgactgtactcctttctaggaatgctgattcagagtgcacctctttgactaggtcccaggatccccttgtccctggagtagggactaactatagcacaaagtaatatgtgccaatgctatttgtgaaatgtttggtctttctaaacgactaaaggatttgttgggtttttgcttaagttttgaaccaaatcctagagccagctgataatatttaataatctggaggagagaataatgatgtaccaataagtggagattcctccttatgatgtatgctaggttatggaagatgtaaaatattcaactttttcctcctttttttggactttgtattttactgcatgttttcttcatttttaatcaataaagagtaaattgtccttagtggtgtatggacgctttattttagtggccgttggcggagagctgtgggttgtgggtcaaggaatcaccaccaactttaattgttcatgcgaatagaagccaaagtacatataaactgtaaagtgtgtctgttgatctacaaattatctagaaccattaaagccattatatagttggggaaactgcaaccctaaaagggagggatgagatcagcccaaggaattggataggatgggatatggaactccttttattatcttttgatcttttttaaatctttggttttgcttatgctgttgggcaaggaaggatgccagattcaagcccttgggagtctctttcgaaagttcagaacagggctgaacttatctcttcttggctttgatattgcaatggtgaagttacatgtaagattctaggctcctttgtattcctgttatcctcccactgcaggaggaatcttccctcatcatctgcccttcccaacagcagtggcttttgatccatgataacactgcttgtgggtcctggtatttcagagctcagggctgtggagccttggagttgacaatactgtttggcctacagctagttgagtttgctttcaagataagcaagttataaaagtggaatcaaactattgtggggataggaaggaggtgcttgttactcataagtgaccatggtatatctggagggaagggaaggggtcaagggcaaattgagcttccacttgcccattctttctgacaagatcaggttgtatcactaggcttggttccttagctttatttgtttggcagcaatactcagtgcatccattcagggattccccctttgggtcaggtcatctaccccaaggtttttttttttttctttaatggactttaatttttagagcagttttagtttcacaataaaattgagtagaaattacagagttcccacacacctcctaactccacccacaaacagcctccactactgtcaacatcccccactagagtagtacatttgatacaattgagtgtacattgacacactattatcacccaaagtccatagtttacattagggttcactcttggtgttgtatgttctatgggttttgacaaatatatagtgacatatatccaccattacagtatcatacagaatagtttcactgctttaaacttctgtgctacctgttcctccctcccacccccactagtctgtgagaaccactgatctttttactgtcttttgccttttccaaagtgtcatatagttagaatcaaacagtatgtagccttttcagattttcctcttttacttagtaatatgcgtttcagtttcctcaatgatttttcatagcttgatagcacatttcttttcaacatagaataatactccattgtctgtacctcagtttattcatttacccactgaaggacaccttgattgtttccaaattttggcaattatgaataaagctgcagtaaacatctgagggcagatatttgtgtagacagttgaaaacagcaacagcttatttggataaactccaaggagcatgattactggatcatgggtaaggctatgttttgtaagaaactaccaaaacttgtggctgtaccattttgtattcccaccagcagtggatgagagttcctgttactccacatctttaacagcatttggtggtgttattggtattttggatttggccattctaataggtgtgtagtgatacctctttttaatttgcaacttcctaatgacatttgcatcttttcatatccttatttgctatctgcatatcttctttggtgaggtgtgtgctcaggtcctttgccctctccacttcccccctaattttaactttttattttgaaataatctcagacttacaaaaaaaattacaaaaacaatacaaagaattcccctatacccatctcccaacttccccaaatgttaacatcttacataactacttacaattatcaaaatcagg

SEQ ID NO: 12462 - DNA, 56616 bp, Human
  misc_feature (1)...(56616): n = A,T,C or G
tcatcaacgtcccagcctgggccatatgctgacctctgaaccactgcccaggctgtgtggccaggcccaggccatcaacctcccagatgactctcagagggttctcaaagcaggagtgatgctaggccggcagctgctacagacacatccccatgggtggtagtgtgcactcatgccgttcctcaccgtggacctgtgactcctccaggaggataaaggacagatttggaccctgctaagaccccagggctcctggggtcttggtgctatcagagggcctgttgacatcaccctgtccccgcctcagttacaacagtggaggccagtctgggccaaacaacctgatctccacattcaagttctagccctcatccaggggacctttgcactgcctgctgctccctccttcctggcttcgctaggctctggaccacctgcaccagcgcagccctgcccagtcccaggcagagcctggcaccctctccaccgctggcccagccccctccttgtatcctacctggaatttttagctctctgtgtaaccacgagcttagtgtctgcttccccttcacttgtaagtgccaggagggcagggccagatctgttctcattcatcaataagtctcttgcacctgcaccctgacaggtgtgaagtgggttcttaggaatgagagaaggaaggaaggaaagcgaccctgcatagtggagggttgggggcaaacgctgcggctcctgaatcgctctgagatttcccaacaacaggactcacccaagccccctccttcgctgtcgtggagcctcagttttcccaaccctccaatggcacaacctccttcccccagggcttgcagagtcgcggtgaaactagggagggattatgttagaaaaatgctctagacgagatgtaaaaatctttttttttttacacgactgaggaggatccgtttagaatttcaggatttttttaagaaaaaaaaaaacttcaaagtgcgcaaacgttgggccggttctcgtgaccttcctcgggagacgaggggcccagagtgcagggggaacgggagggacggccgggaaccagggcggagaaacgcgggccttggtgcctcactggggggtcggattccgaccccaggcgtaggaacccccgggtccctcgcgggcctgcagcgcgaggcagatctggggagggggcagctcggcgcgggtggggtcggggcttcctggggcgcctccagcttcgttcacaacctgcggaaccctcgccttcaagctcgggctccgcggcaaatcccagggtcgaattctgccaccgccgcggcgtccggttttggcagagtccttgtctgcctccgggagcctcggttttctcgtctctccgccaagcccgggcgttctctccacgcagggtgagggccaggcttagaggtctgcggagctctgaaacaagcctgtcactcagatgggagcgcggcaggaacagcggctcacgcgggtttccggagcgcgcgagtgatgccggacccctcgctctgccccttacgcggcccgtctgacttctcagcaccccgtgggagggagcttccctgggtagccccgtttcacagacgggaaagcggaggcacagcgcgatcgggccctgcccggcttccacgcctactctggttgagtcggggtctgaactcgggccgttggttgccctaagccccgctccgggatctggcgcccggcgccccagccttacacgcccgacccgcgcctgggagccgccctcggccccctccctggctcctggggggccgggctcccgtcggttgctcactactagaccggggggtccaatggtgagcaggtcgggcgnnnnnnnnnnnnnnnnnnnnatgggagcaggcgggcgggggaagctccgccccctttccccgcccccttccccgcccctctcggagggctccgggttataagggctggaggccgagcggcgggagctggagcccgcggagcccacggagcccacggagcccacggaggagcccacggaggagccccagcgtccgaacgggcagaccccctcgagccgcgaaggagcccgagaagcagccacgatgtgcggtgagtgccgcgcccgcccgagccgcctcctccacgccgtccgcgggtcccggcgccgcagcctctccgcgcctccgcccgcaagcaggcgccgaggacctggctgggggcgccgatctgccccgggcccctaccgaggggctgtcgtcggccgggcctggctgcccctcacccgcgttccccgagtggccgtctcggaggtgtgggtgggggatgcccaacccgactcctggtctcggacacagtgagggggaccgaggcccggtccccacggaggggagggacctggtccggtccggcctggaccccgtaacagaggggtccccaccccatgccgaccgaggtcgctctcctccacgtctcccagtcgcccacaaaggcggccacgcgcaggccggcgcatcccgagtgcggggcgcccatcccgactcagcccgccgcgcccaccgaggagaggagaggcgaccccgccccgccgtccccgcagcccgcccggtcgcccccgctgcgtcagtgcctcaggcagggcctgcgcgtcctcctcgcgaccccaaaggaacgtctggtccctagaagggtcgctgccgcgttaccgcctctttgcgcggggaagaggcagtcactgcccgaacctcggcccgaagccacgagagggagtccggggcggggagcggggccgggcgtccgattcccgcggcgctcccgcgctgtcccgcgtggctgcgggaccgctggggagggcggccgcggcccggagcgcacatctgcaattctttactctcctggctgggccgcctccgctggccgggagagagccgggaacttctgctgggacaaaaggtcactgtgctctttttttttttttttttttttccttgagtaggattcggttacccattccagcctcctgtggctggaggacctggaggaactttcgaagccatgaaaggcctctctctgactttgctgagggccggggtggggtgcgcccgcggtgagccctggccgaggtctgtgcaggcctcttgtctcggaggccagctgctcggcagaagggaacgacctacggcggagcgggcagcgtgcttcgggatgccgcctcacccaggctgaacaggcatccgtggaaattcctgaaccctcagctaaaatctcgtgctcccagacgccattctccatgtgtagagccacctttgggtgtttctgggggcagagatgaggcaaaggtggtagttttgccagatgtccaagccctgatgttccacacctctcagtgtagcattcaagacccttggccaaaactggtggccttggggccagacttgtgcaggagacccttgaaccaggagggtctgcccacagcaccagaggctccccttccccttcctttcagatgctcctctgcccccactgccacccctgcctgtcatcctccttcctactggcatcttgctttttcccaagtctctctgagctttgggggggctctacctcctccagctcacaaaatcacaagtgtttttgttctgcttcttaaagggacacacacgcgttgtctcctagggaaaggttgagctttggggtgtgaccacctgtatcttcagattttctggtactgacttgtggttgtatgtgagaaggagcttgaggtccccaaaggacacccagggctcaggagtggctgcggtccatgggggtgcccactcggagccagaatcaaagagtgcgtgctggcttaggtgccttctcagaattcccagatttgctgatttggggctgggggcagggtgggggaagtggggagggcacagctcagcaggaagtcgtggaatccctgcatgggaaagttatttccttttcaagaacatcaggagaaagtttcaacttggtgctaacgtgtccttaacatctctctgacacttgcttaagtatcctgtgcagaggggaagccattcctggctcagagcaggcagcagcagctggctagaattgaatacattggtctgtttgggggggatgatggtctgagtatgtatgacaagtgatactgattttccttttatggttgttttcttttggcatgaattcatttaaatttttgaaaatttaatcaaattctgcagaagaaaaagtagtgattatgctattagtacaaggatactgcaagaatcgtgaagatgctcctagaaagaaccagataagctcttcactttacgctggggaagctgaggccctgcgaagtctgtgcgcacctggcgtctgagcaggcctcgggtctcagatctcctgggccgttccctcaggggcggagacctaaggcccttccttatcacttggctgatgacactgctgagattatgtcttgctgtcctttatcctgctgcttctctcatgggaagccaggactcggcagtagttgatcctctacaaacagcagatgattctcaaaaactttcagtgcactgagaatttagctgaaatgacactttggttttattgacatctgaaagttgctggcattttgctgactttctgcgacagaaaatttacaatatttcctccctgtctctctcctttccttctctgcttcctttttcattcagccactagtggaaatgcccagtgttttccaggccctgggggactcgaagatctcatgggtgtggtcctcccctcaaagaaggggcaggtgagccgcagggctagtccagagactggtcaccagcagggacgggatgccgatcagggcagtgctgctgtggagggaggaccttgagcacgggctacagcctggtagagtactggccgaacagggaagacagacatctttttgtttggtgcacagggtttaaaccttttcctctattagttaccaaagtacaaaattgggagatttcacataagtaggtgggagttttggcttctcttgacaaaatctgaagatgagcaacctggagtccttatttccaaatagggcctgggtgaccccttgggtgatggacacaaactcgcctgttctcccagtccttcccagctgcctccctcactcatgggactctgcacaacagaggcaggagctgaccttcctaggaagaaggggagggacctggggcagtgccacaaggacccagacacgagcacgggccctgcagagaggagggggtggcaggcacgctgggctggggcacagcatgagctggagtgtggcagcatggaccaggcatgcatggggatttggcaggaaggatttgcgcttcccatccacgaatttgtaaactgtccctgtgcgtcccatactgcacttagtaatctgtgagggagaaaaaaaaaaaaacaatcactgtgaagagctggagaattcttagttcttgccagaaggtgaagcccttgccttgacatcaccgtcttttgtcctggttggtgtgttcgtctccactggctgctgtaacaaatgactgcaaacttactgatttaaaacaacagaaatgtattcgctcacagttctggagaccacaagtccagaatcggttttacttggcccagatcaaggtaccttcagggctgagcctcctccagaggctctgaggagaatctgtcgccggcctctcccagctcctggggctgccgcgttccttggcttgtggctgtgtcgctccagtctctgtgctggctgcagccctccactgtctcctcaggggtttcccaagttcagaaaaaccttctttttataactttatggtatagcatcagtaaacagtgcttttcaattgagagattatttttgtatctagcaaaattagcttataaagagtgattaatttgaggttataagtttgagagaaaattctgaaaatgaatttcacaataaaacaattaaactatttaggtattttatttttatttttagaggcagagtctcactctgttacccaggctgggatgcagtggggcaatcatggctcactgcatccttgaactcctgggctcaagccatcctcccacctcggcctcccaaagtgctgggattacaggcatgagccactgtacctgtccccttcttttcttaagatttttttttcttttaattaaatatatatcacttccctctttgtttttggtgaaactgtaagaatgaaagggacactggcaacttttctattaaaaaatagaaatggccgggcacggggactcacacctgtaatcccagcactttgggaggccgaggtgggtggatcacgaggtcaggagatcgagaccatcctggccaacatggtaaaaccctgtctctactaaaatacaaaaaattagccaggtgtggtggcacgcacctgtagtcccagctactcgggaaggagaggcaggagaattgcttgaacccaggaggcagaggttgcagtgagccgagatcgtgccactacactccagcctggcgacagagcaagaccctgtctcaaaaaaagaaaacaaaaaaaaaaaaaagaaaagaaatgtcctgtccaggttaccacaggaagcagagtctattatctcatggattccaatggtgaggtcactttaactcctggggtcccaaagaggcctggggcagtctggggctgtctccaggggagccaagtccccttcttaccctgagccaggtgccgcgtctgctcagggcccccgccaggcccgcaggctcctctgtctttctgtaagagcctggcgtgggatcacatgcatccgcggcacctccagctttgatcttgtttctgcaaggaggtggcaggaattgtcatccctgcttcaccaagtgacctttcccagtgtatgagaggccacagctcctcagcagcccttgcccaaggcccaggggactctccacacctgtgggcctcacccaggagagtggacctgtccctcttcccccaacacacacaggcaggcccaggcacacacgtgcacacgctcgggaatttcacgagccctcattgaggcagacattcaactggccgtactcttctgttgaggcaggaagtaatccagtttgggacctgggatgatacctaatctctaggaggctcatggactataaaggtcagccccttcagttcggagaagcaacagatggtgggagaaagacagatctctgaggggtgagtcctggcctgggtgggtggtgacatagcttccagagccaacctgtcctgtgtggagcactggctgggcctctccctggaacggtcccctcactcagagtgagggctgggctttcgttgggaagccgatgcttggaaagttggagagatttttcaaaacaagcgtcaccagaatcagaacgtgggcccaacctggctgctgcgaagtggtgtcttccccatcccccaggccgcaaatcatccctcccctccacccccacgctcagcactccaggggctgtagaggaaatcccaggaattcagtgccctagtgtggctgaccttctggctgggtgtccagggaatatcatctccctgcgctggccattgtcgttatctgtcacttgggggttgaaccctgagcttcagaggccctgcctgcgtgccccttcatggtgtctttgctcctgacttcctgtgtgatctctcgggccttgtgcagagaaagtgctggaagccccagaatatagcagtgagccggggccaagaggctacagtctcctctcggagggctcatgtcgaatcccttctggaatccccttgagtttttctcggtccctctccttctgggacctttcccggttcattttatctatcaattttgaggatagggccctgaaaggctgtctggaagctctgggtgggtgaccacagggcacatgaccaaactgggtggtggggccagggcagcctctgcccccaggccgggcctttctccaagccacctgggctctcctgctggtaggaaggatgcttggcccagggccatctttgcagaggttgcaaagtgctccttttctttagaaagatctccaggctcctgtatctcagactttccataaagcctgcattttcaggctctcctgccttcggctctcctggcctctcaatcccaaccctctgcaggctcttgggaacctgaaggcacctccctgtccagcccctctgggcgctcagcatcccccacctggctgggtccatcccctgtctcttcaatgtgagaaataagactgctcccaggtttgctaggcctgatgtctgttccctctcagttctgcaaggagatttccaagctaagaagagtaacagaaaggggaaaactttcccccaaagaagtttggtgttatttactgccccgttctcagctcatttaaaatcctgtcgcctgccagtgatgcctttcttacgccgtgggcagccctgggagtggaggctaggaaagagcagtagatcaaggtagaaagtgacagatgccttgaaaaggggacggaaagttggaaaaaggggttcagaggagggaaaagatcttcatctggggtagggggttggagaaggcatcacatgtgcataggcctgggggccccaggggcgcacgcactgggctgagggcaccctgcaggagtgggacccagagggcggaagctgcagggtggcatggggagcaaggcgggctcaggccagacagcaggaggggttgacgtcacgcggtgggcccgcggggcagagaagacgagagagggatgtagctggaacctgccttgccgtggtcaccgaggccctggtggggtgggggctgaacaggaggagaaaggtggagttggaagctggactgtcccgtggtggggcttggctctcagggggcagcacctgtcctggacccatctggtgctaggcgggcatctcctcagaagccagggaccctctgtgtgagctatacctttcttcttgggataggtttctatgctgattgtggggaggtgggggtagaagtggtgagcccaggcttgcaaaaaggcagacctggctgtgaattcctcaagtctttggcagtggagcctccgatgccatctctatccctgggaaccacagtctcttcacacaggatgtcatgaggattagaggaggtgaagctcgggaagggttggcatgcggggagccactgtagatggtggtttacccagcagggttctgggagccttccctaggccctggctcatttgattagaaggctgtcctcatgccagtcctgggatcctcatggtgcatggggccgggggtgttgtgcggggggatgtaagcctctgtgtttgattatcttggggttaaccgagagttctggtggcaccgtgctcccattgtaagggtctggcactcagggacctcctgcctctgtgtccctcttgtccttgctgtgggtcccagcgagcggagctgcttatgcttggctgaacgtggctgtctcagacccagctcaaaggctaccttctctggcattcctccatctgttcattcattcactcaacatggatttattgagcacctaagatgtgccaggccctgggccaggtgctggggactcagcaatggatgagacagatgtggtcccatcctccagaaggttacaatccagcggggagccgaagaaaaagacaaggaagcaagtgcagcgtggaataaccagggctatgtggctggagaaggtggtgggaaagatctgctaaaacctgcagaatgggtcagaggcgcctttgcgaagagctagcaagagccagccttgcaaagagctgcctactcccaccccagcgggaagccctttcccacctcccctgtgggcttgggaggtccctgtgcatccctgtccttccctggagcgctcagtgaggccccccgatgggtccatcccagtagcttgcagcacctagtacagcaacgcggccttgtgggcctgagaactgcttacagatgaattaaatcttgaccaagccacaaccaagtaacgcatttggtttaaccattatttccccaggcagaaggccaagatgaaatgacagtaaatggtactatttcccccttggttttattgaatgataaatctctcaagggataatttctcaagctccttgccctgtggcaggcactattgtagccatcaccctgtttcactgacagggaaactgaggtccgaacattcagtggcttgctggagagtgcactgaaatcaaggggtggagctggggttcgaggtgggttccggcactggccacggcctctgtgcttctgggtatgccttggctggtgaatggcagcagcagggaggaagccaacccaggcgggtggccctgggctggtgtttttaaggctggggcatgtgcttaggttgccccttattacagccctcttatggccgttgctcttccaggggagtggaacaggggaccagccaagtcaggtgggcccggcccctcttgtcgaggggcaagaaggcctggccagggcaggcctggcgtcccctgcagagggaagggccattgtggccctggtgcttcggacatgccaggagggttcaagcaccggtggaaagcagaaccagccagaggtccggcctggctgggggtcccaggtgccgcacggtcactcctcctgtacccagaagctctcaggtcccactcagcagaatgcctgtgccacaggaaatccaggtgaaccaggcaggtctgcgtcatgtacaccactgtccaaacagtcggtccatgttaaccctcaggccttggctaggacatccccctgtggatagaatgaagtctttgcttatttagacattatctggcatctagataatggtgatgtactcatcaccacctaattcacataggggcacatgtgccatggcacacggtgaaatgtcttaaccatctaaagaggacacgtgcagtggaaaggaagtttctgctcaacatccagtgacctcagaggctacctttgactgccctctgggcgtggtgcccttctagaaatgctccatgctcctcccccagcccttgcgtaatttactcatattctgcaagcttctttttcccttgacacatcttggagatttaaattgccttccaagagaatgcacagctttcccttgctctctgttgagggctgcctgtaaaaggccctgctgtgtggctgcactgtcccttgcctgtcccttgcctgtcgcttgccagacatcagactgtcactagtctttggcaaccacaagagccctgagcagctgtcctcgcacgtgtgcacatgcatctctgcaaaaagtccgctggataccttcttagaagcccaacagctctggtccacagatgtgtacatttttaattttgagagattgccagattgctttccaaagagggtatgtgagtttaaactctcactgtccaactgtttgatctttaccgacctcatgggtttaaaaaagtggattctcactgtagcttttatttatggatggaaggaattccaaaagggaattctgatgtaaatagcaggagaaattcctgggaaaggagcttcattttattctgtgttttatttttaaatgataagagcacagcgtgaacgctattttattcacttgagtgcagtagagtgcagggaggatccagccaagaggatgagctgcaaaagcaaagaaacagagcttccttcatgaaagaagtgaccgaagggatgtcactacgcaagagggctcgtggtgaaaatgagatttatgctttcttgcgccaagatggtgaaaaccacactccttggcagcttttctcactgcagtcagctcccctgctgtgcctgagtgggcaccgggcctcctggctgggtacggacacagctggtggtcctgaggacaaggaccccttatgcccccgctgctgtccaggaggctgtcgtgggtctgaaagtcagcggtgccttgcggagcgtgccgaacgttctcgcctgacgtgtgcaggagtgaagtgtggctgggaggtgggggagctgcaggggggagttgcagagctgactcattatgcactcgggaacatcattcagatgcaaaaccttttcagagttggcaatgggtacatttctgaacctttgtgtcatctgtgatgtctgtctgcttcccttagggtggtacaagtataattctagaacattcccagcccaggatgccaggaaagttcagtgtaaaagactctaacagattttattgagttgttccctccctcgcttaactgtggtctttacattgaccacaatttgaccatgtcctcacagggaactttctggttgttgtttttttctttctttctttcttcctttttttttctttttgagatggagtctccctctgtcacccaagctggagtgcaggggcgtgatctcagctcactgcaacctctgcctcccgagttcaagagattctcctgcctcagcctcctgagtagctgggattacaggcacgcaccaccatacccagctaatttttctattttttaagttcagacagggtttcaccatgttggctaggctggtcttgagctcctgacctcatgatctgtccagcttggcctcccaaagcgctaggattacaggcgtgagccactgcgctggcctctggttgtttttagaagagttaatgttatgaaaagtttcacctaggctgggcactgtggcttatgcctgtaatcccagcactttgggaggccaaggctgtggggatagcttgggcctgggagttcgaggttgcagtgagccgagatcacaacactgcactccagcctaggcaacagagcgagaccctgtctcaaaaaaaaaaaaaaaaaaacatttcacctaaacatgaatggtgataattgcacaactctgaatatactaaaccactgaatcgcatgctttagatggcaggctgctacggtacatgacttatgtctccagaaagctgttaaaattttttaattgacattaaaagatgtattagtccattttcatgctgctgataaagacgtgcccaagactgggcaatttacgaaagaaagagggttaatggactcatagttccacatggctggggaggcctcacagtcatggtggaaggtgaaaggcacatctcacgtggcggcagacaagagaagagagtgtgtgcagggaagctcccctttataaaaccatccgatctcatgagacttattcactctcacgagaacagcatgggaaagagccgcccccatgattcatttacctccttacacgtgggaattgtgggagctgcaattcaagatgagatttgggtggggacacagcgaaaccatatcaaaaaataactatctttttaaaaaataaggtgacaaaagtacctcccatgcccagatgtttgggggctgtcgtgtgagcctctggaaccataaatactcagcagcagtgctgcgcggccctcactggggacactttggccctgccggagaagggcctgaactgcacacacagcccatacattcagctcctctcacctgatctaaagatggcaaggaagacaaaaatagcctaccgagaaaattgcccttggctgattttaaaggaaaacgcctgtaactgctcagaaagcatagtgtacatatttttatatataaatcccccaccttaatacatatgtgcaaacatatcctgtgtacagtagctttcagtaagaatttaagtataatttatagtactatttaattttattgcctatttttgactgtttatagattaattaagtttatatgatgggaccccactcactgtttaggaatataacattcatttcattgaagtttatcatttattcagatgtagcatattgacatgaatctgatcttcttaattaccagagatattccaggtggtttcgtatataatcacaatcagctgtctgttatctaggggcaggttgtcctctctgaggttcacctctggaaaaatttcaatcctgatcagacctttctctcatcccagcaaaacatagttgggaaaataaaccttcttgtaaccctcgtggcatccatcccggggtactggccagtgggtaggagtgtttaagtcctgagtcggggattcttggttccactctggctctggacgagtcacaggctcccctgtggctctggtccagaagttaagaggagggccatggactagcctcagaggctgttttgagcataggatgaccctgtgggaactggtggcccagtgcccggcccacagggacttctcagtgaggcgagtcgctgttgtggcctgagagtttgttcccccgtcattcatctgttgaaatcctcagctgcatggtggtcttactaggaggtggggccttggggaggcgattaggtcatagggacatgggcctcacgaatgggatgagtgcccttatttaaaaactgcggagccaggcgtggtggctcacgcctgtaatcccagcactttgggaggcggaggtgggcagatcatgaggtcaggagattgagaccatcctggctaacatggtgaaaccccatctctactaaaaatacaaaaaaaaattagctgggcatggtgtcgggcacctgtagtcccagctactcgggaggctgaggcaggagaatagtgtgaacctgggaggcggagcttgcagtgagccaggatggcaccactgcactccagcctgggcaacagagctagactccgtctcaaaaaaaaaaaaaaaaaacctgcaggccaggcagggtggctcacgcctgtaatcccagcactttgggaagccgaggcgggcggatgacctgaggtcgggagttcgagaccagcctggccaacatggagaaaccccatctctactaaaaatacaaaattagccaggtgtggtggcacatgcctgtaatcccagctactcgggaggctgaggcaagagaatcgcttgaacccgggaggcggaggttgccatgagccaagatcgtgccattgcactccagcctgggcaacaagaatgaaactctgtctcaaaaaagaaaaacaacaaaaacaaaaacaaaaaaaaaaacctccagagagaccctggccccttccaccgtatgaggttggaatgagcagtcactgtctgtgaggaacgggccctcaccagacactgaatctctggcaccttgatcttggacttctcggcctccagaactgtgagaataaacatctgtggcttataacccaggcagtctgtggtattttgttacagcagcccaagccaacttaggacagttaccgtgaatatgcctgaaacccagtgacatttctatgacccatactattgcctccctccagggatacagatacacactcatcacatattctgttccacatgtgaacaggactgggtgccaacacacagtgaggaatacaaagatagaagcaccagcctatgcccttggtggggactgtgggtgtcccatgacgtgagagcactgaggtggccagagccaggagcacacctgcccagggcgggggctggagctgagctttgaagtgggcaggttttcctgagcagtgggagcgaggatgaaaggacagagggatgatgggatgaggatggggcatgcacagggcaggagagaggacatcaaggatctgtcatcacaaacaaggagtggaggaatctggaaggcagaaccaacacaacggctaactttctgtttggaaaattatcttgaaatatgaatacagaaagtcaagtggaacaaaatcttcttgactcataggcctaccttgaacataaggattctgcaggggccaaggggcatgagatggttttattcttgctgtcataaaagtagtgcttttttttttttttttttttttgagacagagtctagctctgtcgccaggctggagtgctgtggcacgatctcggctcactgcaacctccagctccctggttcaagcaattctcctgccccagcctcccgagtagctggggttagaggcacacaccaccacacccagctaatttttgcatttttagtagagatggggtttcaccatgttggccaggctggtctcgaactcctgacctcaggtgatccacccacctcggcctcccaaagggctgggattacaggcatgagccaccgcccccggctcaagtagtgcttatttaaggtcaagttccagccttacggagaaggggaccgtggaagcaaaggccccagcgcctgtcccatctgccctgggggctgctgtccctttctatggcactcctagatgtgtgctctgcaaatcagggagtgcatggaggtggggacttccggatgtcctaaggcggttggatttcattgctgccttttctattatggacattgccacgctgaaagctgcctcctgcaagtacagcataggataagttctcagcagtggaactgccagcccaagacatgtgacacaggctttctgggggtttttgtcacaggaggaagaaggggtgcaccgttcttcagctgtgctcagggaggggcatacccacctctgcaagcccctgggagacctttgtgatgccacctcggtgcatcccccagaagcgttttcttccaaacacgagctgagtattttatgaatgcaccatttttttctctttgaacaggaatctttgcctacatgaactacagagtcccccggacgaggaaggagatcttcgaaaccctcatcaagggcctgcagcggctggagtacagaggctacgactcggcaggtgggtgtgcggccgcccgcctcgtggctggggaccgggctccgctgctgtggtctcacccatctccactgcaggggggtttacaaccagggcattttttctgctactttttaacgtctcttttcaatataaaaataacacttgtccgttaaagaaattcgaaaactatggaaaaatagaagaagcaagggtaaaaaaccccagaaaacccccttcatcagaagtccccccatcaggaagcagaaagggtacaaagccacagtcatgcagcatgagtaagtcctggacagctgctctgccgtgcggtgcctgacttgagcaacactgtattttgcacataaaaatttgccaaaagggtagattttcatatttttatttttatttttgttactcaggctggagtgcagttccaagaaattggctcactgcagcctcaagctcctgggctcaggcgaccctcagcctcctcagcatctgggactacaggcgtgcaccaccacacccggctaattttttattttttgtagagatgaggtctcactgtgctgcccggcgtagccccaagcgatcctcctgcctttgcctcccaaagcactgagattgtaggtgtgagccagtgagcccagccaagagggtagagcttatgctaagtcctcttatcacacacagaacaatacataaagagggcaggagcagactctcggaggtgataggttgatggcatagacggcagtggtggtttcatgggggcacacgtgcctccaagctcatcgagttgtagacattaagtatgcgcagcgttgtgtttgtcagctccttcattaaaaaaggagcccccatcagtctttgggacccttctccggtcgctgttgtctgtgggggtggtctgtggtggaggtgttgtacgttgatattttttgtttttacctaattataattatgcaattttgtaattttatattcttctcttttcacttggcatttctaggatcctaaactcattcattctttttttttttttttcgagatggagtctcgctctgtcacccaggctgaagtgcagtggcgcgatctcagctcactgcaagctccgcctcctgggttcacgccattcttctgcctcagcctcccgagtagctgggactacaggcgcccaccaccacaccctgctaatttttgtacttttagtagagacggggtttcaccgtgttgaccaggatggtctcaatctcttgaccttgtgatccacccgccctggcctcccaaagtgctgggattacaggcgtgagccaccgcacccggccgatcctaaactctttctaagtagctttctaagtggctacacaatgctccgctgggtggctgtcccagagttcaggcctccattcactgcaaaggtggatgtttagtctgttgaccttgtttaattatgcagcctgaggagaaagggggagcccgatggttttaaatccttgtcgactcttaataggaagcacgtccgatagacgacgggaggaacactaacgcagtggagataccaacgaaatatcacaatgcgaggagcccttgggataaatgccctgcctgggcccattgccattagccgagggcctgggagcgcctgcagcggggaagtgtcccgaggggctcaccctagctaggcaggagcagggctgggggcagctgcggcctggaggaggcaggggcttcctcacttgctgttaagcctggccgcagtcacagcctctttcagagcagatttcctgaaaactgtacagctctccaacctgccataaacggacagcccggggcatgcagccctgaccctgcggagcacctgtgccaagtgtgtgagaaaaagctttggttgcaatataacaaatgctgtctacatcacaggtgtggcgatcgatgggaataatcacgaagtcaaagaaagacacattcagctggtcaagaaaagggggaaagtcaaggctctcgatgaagaactttacagtaagtggaggacctctgagtgggaggagccgctgcagcgccggccgctttctaggaccgtattccaacagcgccggagactggagattctcctttgtcccagctcagataaacagagggagggctaagcccgtgctgtaaaaccgggcttcgcagggtatgggatggtttattttaggtggtggcggcgcatggataatttttttaagtgtgaagggttacatacagtagttattttaattattccagcaaatgatactgcttctctgtttatggtagggatatatcattttctttttaaagcaagtttatttctgtgaagaagtgagctaagctacagacaagtagtaaataaccttcagcacgggtggtttgtgggcctgcgcggactcccagggtgggagctggtggggaggtgccatcggtgtgggtgacgtgacttgggtaacgacaccaggttgcactcacagtcctgggtcgaggcttgttgttcaagtgcggcaaactgattttcctttcatttagaacaagacagcatggacttaaaagtggagtttgagacacacttcggcattgcccacacgcgctgggccacccacggggtccccagtgctgtcaacagccaccctcagcgctcagacaaaggcaacggtatgtggcatgcttccccgtccccatggttccacctcaccctgagctgtgtcagggccagtgcccgccaaagcaggttccgcgcccacctctaactgacttctcagcctacttcatcttcccaagagaatgcggatgtcccctctcccagagctctgccagtggcctgggcctcagtcaggaggcaggcagcctggtcctagggtggtgctggcctcccaggagtgcacaggaaaacgatggcacttaaccaggagagctgctggctccttggaacccagcccatgagtgggatgaggccgcgtgagggactgaggggcctgggcactgttcctccccaagtgacggaaatgctgcagaagggtgtacccttcaggcaaggatgggttctgtccttatgcagctaaacctgtcttttccccacagagtggtccaggtgagggcaggggctgtactggtcttgattgctgccaccagacacaccgtgggccccagcgggagacctcagcagccaggggcttagggtttggagaagtaggggccgcagcccgaagcccaggggctcttcccaggtggagagccctcaactcagcttgcttcatgttcttaaaagttgagaaccactgtgcataaaagtccagacttctggcatcacttgaaaaactggaggatctggaaacactgagctgacagcacgttggagcaccacagattggcagagggccaaggtcgctgcacctgctgtccttggtgggtttcaggctctcctgttcgcccagtcaccccctcaggccagctcacaggtctgtgtcacttgcatgggtcgccaggacagttctccacgcgtgattctcttaaatgacacccttgccccctctcatgggggaaagactggtaggtctgcagctcctggtggcagttctcaggggtctgtggtcagccccagggcgccgggtcccctgcagtgggatgcagtaggcatggagcagaagagaggatctaatccctgtctcctcccaggcctccaagggcaggcaggagtctaagacataagctgggccttccagggggtcccccactctaggtgaggcctggtccagtcacgagcccctgaagcccccaacctggacatgccaggggagggtgtacagcaaagacagtgatttctgaagtcaactggaccccccaacccaagacatcctctggcatagtgtaagttcgtgccaagcctaatgttagataggaccaaatacatcagagcagttactgggagcttattagcaggcactaagccttgacacttgacaagtcccactgcggttaatccttgtggaagtcaggccacaggagagcagcaccagcctgcttggtgtcccccacccactgctgatcagtggttctccgaggcagtgtaactgggcgggatgggcaggcacccccaccacccacagaaagtgcagtggtgctgcttctccccagagcactctgcagggcctcaccagctcaccccgcccaatttggaagggaaggcgtcccccagaaaacggaaggagagccccatccaccctgctcagcagagcagcttggtggtagcacaggagccagggctactcatgcatcctagtgatcagggtcttgagggagtgaggtttttgcgagggcctcttccttgggtctggctcatgccctgaaccatagggcatttcgtgactgaggcacacaccctatgtccaggaggaggacagcagaccccatggtgctgaggacctagaatgtacatctggccagagcccaggtcaagtgcagaagctggtccctggggcagtcgtgctggccgagaaaacactgcgcccagaccatgtgccctgagatgttgccactttagccacagcctcctgcccttcccagtgataaaatgaacctcattggaaaatcccccacttcagtgtagatgatgattctcattgtgtccccaaagcagggaggctcccaggaggcccacccacacccaaacttggacactccagccctgactcaggatgagtaattgaaaagaaaacaacaggacaataagcaaagatttataaaatttctttgacactcagcagtgatagctgaagagcatgcttttaaggaagtctgaacgcccagcaactataccacacaaggaaattacacaaagattctgcagagacaacatggattccagaaaacaaattaatgataggatcataaactgagatgaaagaaagtgtagcagaattaagagaataatgtaaagaaacaatatcaccggccaggcatggtggctcacgcctgtaatcccagcactttgggaggccgaggcgggcggaccatgaggtcgggagatcgagaccatcctggctaacacggtgaaaccccatctctactaaaaatacaaaaaattagccaggcatggtggcgggtgcctgtggtcccagctactcgggaggcggaggcaggagaatggcgtgaacctgggaggcggagcttgcagtgagccgagctcgcgccactgcactccagcctgggcgacagagtgagactccatctcagaaaaaaaaaaagaaagaaaaagaaacaatatcaccatagatataaaaaaatggagaaggggatggacgtggagccagttaatatggatccaacatatgggtaactggtgtgcacaagaagcgatcagagcacagagcagtaaaaaataaataaataaatacataaaaaataaagctgagctgtggtcagcacatctgttgaaactgggcttttcttatttaagccctcccatttttgagtgtgacctcacaaaaacaaacactacaatttttttaaatagaggaaatcatggtgagaataaagaaaaagaataatggaaaaggtttcaaaagatgctgtgggagaaatctttcccgaactgaaggaaaacttgagttggatatccaaagaagggatcaaaaatagtcaatagaccaggcacagtggctcaagcctataatcccagcactttgggaggccaaggtgggtggatcgcctgaggtcaggagttcgagaccagcctggctaacatggtgaaaccctgtctctactaaaaaaatacaaaaattagccgggtgtggtggcgagcacctgcaattccagctacttgggaggctgaggcaggagaatcgcttgaacccgggaggcagcagtcgtggtgagccaaggtcacgccactgcactccagcctgggcaacagagtgagattctgtctcaaaataataatggtaataataaaaacaaataagacttcacagtgatgctttgaaaaaaatagtcaatatttatgaagcgtatcccacatctagacacctcctggtggaattattgaacctcaagggtaatagggaatctttctgtcctctagggggagagggaaacggagctacttgcccagaaaaattctcaggctggccttggatctttccctcaaggcactcatatgcgggctattcattgagaaaatgcagtggggtggaggcagacatccctcaccgcatcccccgcatccccctgctccccccgcccccccgccacctccccgccaggatcagcggggtgctacctgtgcaggaagccgcccgcgtgagctgggttgtgcggcaggaactggggaggtgggaaaagctgcagctggcagatcctgctgtgcaggaatgtggctgagcctggggatgccagaacttctgggatttttcccccaaggaaaccaggattttaaagtgaacactcagaattttaaaaactcaaatatttttacaacacagtgtgggtcaaacacagcacggtgctggactgttctttgcgacctctttgtgcctaaagccagttgagagtgcctggaatcacttctggaacgaagggctcatcatccccgtgggacatgaaccccaaagcctgtttgatactataatagcgcacaggggagagctctctgcacggtcaggctggtggctgctggtcactgaaagagggatgtgtatttcctccggatcccattgtagtagccgctgccctagacatccctggtgctaatccctggttccactgtagttgctgccgtaaacatctgtgctaatcactgtaaacaaagtgtgcttaacagaagtcttgaggcctggagtttgcagagagttctcaagccttgaaatcatctctcttcacatctgacatgaacctccttctcaatagcatttctctcttaacttttctttcagaatttgttgtcatccacaatgggatcatcacaaattacaaagatctgaggaaatttctggtaagatgcttcccctaggtgatgtctcagtccggtgggattggtctccccagaaactttccagccagctcatttccttgcggaaaccagtgtgggaactgagtgagacccacactcagccacgtcaccgtgttgagaagaaacctctgccttggctgagccaggccctgcagatctcgtttgaggagataacagggcattagtgtttatctcaagggccactgcagattcccagaatcaaaataacaggagcttcgttttattaaactgtctgcattatataacacagcgactcgtataccggcggagttgggacggaaagtcagacagtgactgtctgaagtttgaaaggctctgtggtgttagttgggatgtgggtgggtttgactcaacgtattttatcattttgactgctgttattttgcaatgtccagattagtggcaagggtgagcttctgaggtgggatgatctcagggcctccgggagtgactcagaggtatttggctgtgatgctggcaaacatttttccccccttcccggttttccctgttcttgacttaagtcactccaagggcagatcaccagggaggagagggagttggccaggcaggcattgtgcaatgaccaatctctcacactgtgccgactgcatattccaggaaagcaaaggctacgagtttgagtcagaaacagatacagagaccatcgccaagctgattaaatatgtgttcgacaacagagaaactgaggacattacgttttcaacgttggtcgagagagtcattcagcagttggtgagttacaaatcccatctgtctaactcattccttcattctttcattaaaaacatttttttcaagcagcaagtgccaaggaatccttcattttttataagcccttgttagacaaacttgcacagagtcctggggataaaagacagcccatctgcagagcctggccttaagatgttacactcttgtagaactggaagacgttctgtggtttgggtagtcaacatcaaatagaaagtgccctgcttcatcgtgacacttctgaaattgtgactggcattagagtccgtggctttttatgatgcacacgtgagcttggtggtggtgtgcagagagagttgtggtaccaagcgaggatgtgtttctaggtttttcttttttgagacagagtctcactctgttgcacaggctggagtgcagtggtgtgatcttggctcactgcaacctccacctcccaggttcaggcagtcctcctgcctcagcctcctgagttagctgagactacaggcacgcaccaccacacctggctaatttttgtacttttagtagagacagggtttcactatgttgaccaggctggtctcgaactcctgactttaagtgatccacctgccttggcctcccaaaatgctgggatttacaggcgtgagccactgtgcctggcctgtttttgtgataggtgatatcacagcatgtctgtatgtggaacggaatggcccaaaagagggagagagggagagagattggggacatcccagaggacagggcccagggagaagaagtccctgagaagggagcacacactgggcgtattgtccaaggggaggcccctacactgaggaggaggtggagcagacacaggcccatgcagggtgcgggaggacgagaggggtccgggcctctcagagcccatcctgtcagacagcagtgccacccagtagctcccccagggctgtggcagcctggacactggcccagagtccagaacatctggcaggcaccatcctgtagtgtaaaatacatcattcttgagcaggtgttttcagagtctgatttaaaaagtaagtctactgttgaagcctttttgtcctctaactcccgtttttggaggtccatcatttagaggacgtgtttataaaaaacagcctatcccacatttaatgtgctggataaggtacagtgagccaattaggtattacagcatgctgtttcttcttttccatttttattttgaaatttcagaaatacctctctcataatgacacttttaaacttaagacttttcctacctgggacagtaccgggctctttttggcagagaacgtgcagtgtttttccattcagtcctattttattgttgacaaaagcaccagggtctgcctgaagccccctggtttggggcagtttgaaagccccaatgaggcctggggacggtgactcaggttcctggccctgtagctgagttggcaacctggacccgacacgctgaccacccggggcctggggctgcccgtggcttccacacttggaggatttcttgtggaaattcagatttgcagctggttatatataactgagctctgctagggttgcggtaagttagtacaggatggtcaggacgtgggggaagaatttacaccaagaatttaagtcaaaaaaccatctggcctcttgtgttaggagagctggattctagttctggctttgcacaaaccaaccagctgaggcccagagggcaggtggcagtcgtatccatggaaaggataatagcagtaacggtcatgacaacctgtgcttctcttgggtctccggatgccaggctcagtgcattagcttatcatcgtcacggaagccccgccaggtggcgctgttctcacttccttcaccgatgaggagaacgaggcgccaagaaggctaaagggagagcccagtgcaggggtggagccaggatttgaacccaggccctaccgtgtgttgagctaaagtgcacttcacaggggcttgctgagtaggtgctgtccctgagcagggcagggaagcctggtcccagctatcatttcctgtgactctcactgccccgtctacccagctggcacccctgccgggctccctgtgggcctgggcaagccgcacatcgctcaccatggaattcacatgttctggtttgtggtacttcccgtggcaccgtctgttttgctttccctcgtgatgtcaccccggatgcgctgttctgcactcagctccccgagggaccccaggacctcccgccatcaggaggggcccagggagacgcacctgggctgtggccaggctgcagcagcggctgctggaacgcgttgaccctcactgtttgtgtgttttcaggaaggtgcattcgcgctggttttcaagagtgtccactacccaggagaagccgttgccacacggtgaggcaaaacacactggcatttcccataagaaagaacgaaaataaaatcacttagctggagggagacgggagaggtagggcctgtggcacgctgaaaggtgctcgtggtgtctaaagaacaactgtggctcagccccggggaccgcgccccaccatctccatggctggtggtgctacacttctgaattaaaaaaaaaaaaaaagaaaccagaaagttggatttgtgtttgaaatctccacagatttttagaggtgggcaacaaattccagttataaataaaatcgtacagacagggcagatccaggttttgtggggcttgaagcctgtacaatgtgggcccccctttaagaaaaagcaaaattatgaacatgaaactagggagcaaagtgaatattgatttggatccagtacagcagaggccttgaaggcccggggctcaagcttcaccttcacaaaggagcatgccaggaatcggctcagagagcctgcttgccccaatgtgtccctctgttacggtgggcccccagtgctgcatggatttacagaagcaggttaagtgccatcctgtttatattcacataggttgatcatccatccaaccatgcaactaatatttactgtgcacttactgtgtgctgggccctggggacttagtgacatctgacctggtccctgccttgaagggctgaacagttgtacaggagggcagagaagggcagaggatagtgatgccctgtgcccggccccagcacaggatatcaccttacctggcaggggggcaatggcaggtagccccaggcaggcagtgggaagaggaaccagcatgagcaaaggcaaggggcccagagggagtgggacctcccaggatccccgttggcaaggtgggggcatggtgcaagggcattggtgggacggaggcgttctaggcccagtgtgtgtttactgacacctgctgtgtgccaggcatgggagacagtggtgagcaaggtggtatggacactgctccagggcctcaaaggctgtggggagtggagaggcggacagaggccggctctaaatggcctcagtgccctgtgggctgcgggcttcatctgaagccccaggggagccatctggaatgaacctgtggcctgggagacggccggagagggtgaggctgtctcttccagactggcgtagtatctcagcaggaaacaacaggaatttatcatcattttttttaaccttttctaaaactggaactaatttgccatttggaatttaattccttcaattcatagaattataaaataccagttggttcctatcaaatttagaagccctttttaaaatccaattttatcatgatttactattttaaatgaactcagaagaaggcagcgtgaagaagcaataaagctttatttttctaaattgcctataactgagggctctataacctgcagtacaatcttcgggttgtcttgggagaattatatgtctcaaggtctagagaaaccacagagctcaacctacagcaataaaatttgggggagtcatttgccaagaaaattagatatccacctactttctcactgccattattataaactatttatgctagttccccactggccccagaactatgtctcagatttgctttacacaataaatgattaaaatattcaaggtgttcatagcaccttcctcaaagccccagactttgtcccccgctttgagaagccataagtggggtccaaacaggccaacgtgactggaaaacaaggtctgttattgttgaagaaaaatttaggaactgcattgagtcaggctaacagattatggatatatgtggactggattcaagccgatgagcaagcacttcattagttcattgatctaagttagcaagaaatcacctaaggtaaaatgttactggattgtattccaattcatgtgtttgaaacagctctcttaaattgtcttattacagtgttcgtcggtgttttcttcttattaataaattaatgtgtagaggggaaaggcacacatcctttcgtaactactgcacttttacctgcctggttttgaagaaccgcaggtttagagagcatgtgttaccagagtgagcctcttatttctgtgcacacctatggtagattttatttgcatgctgtaatttataagaatgagcaaaggattagattttggaatcaggatatcatttaaatcatgagatccttttatttatttatttatttatttatttagagatggagtctcgctttgtcgcccaagctggagtgcagtggcacgatctcggctcattgcaacctccgcctcccgggttcaagtgattctcttgtctcagcctccagagtagctgggattacaggcaccccccaccatgcccagctaatttttgtatttttagtagagacagggttccgccatgttggccaggctggtgtcaaactcctgatctcgtgatctgcgcgcttcagccccgcaaagtgctgggattacaggcgtgagccactgtgcgcccagccaaatcatgagatcttcatcacgtccaccactagaagttgtgaatcagaggaaatatcctaaagctctttcctaaagatcccctgctgaggtgctcagagagccgggctgcagtggctgagacagtgacgctgggacaggaggcctgagtgagggcccctcaccttggccagctgcagactccctgagattttgcctgtgacagttattgtcctctttatgatgaagtctacctggtgcggggtgaagattctaaacttccatccacggggtgtcactttggcagagacaaaaaaccacccaagaaatcaccttatgtcacctacaaagtagagaatatacaaaagtcagtcagactagtgcccactaatgctagagaactgggctaggggaagggaaggaacaacagggggtctttgggcagatggtgggtgcagagccctattgttatagggatgcgctgccgtcgaggctgggtggagacctagagtgcccctgtgccccaccagcgcctcctctgctgccaaacgctcagcctccgccatctaaccttgtgggttggtcacatgtggggacttgactggactggaggaggcccggcctaggagggtgggagtgagacaggttaccaagctttctgggcaggtgggtgatgccaagtcagggacctgggactcaggagctggcctttccatcctgtgctccaggcgtccgtcctgtgggacctaaacaggatcctccaccactgggaaagggctagatttggggatcctacctcagatgctgggcagacacccagcactgggcgtcaaaggcaatgggtaatgggatgcctctttctccctacaggagaggcagccccctgctcatcggagtccggagcaaatacaagctctccacagaacagatccctatcttatacaggacgtgtaagtttctcaagaagtaccggaacagcacagctgctggtgtcgcaggactcggcagctgctctggcacagtcagctcccctctgaggcaaggaaaccccactctgagccagacccaacaggcgcacagctccaggtctaaaaggtttttgtgcaactgagacttggctccattttttttaagctttttatcatggacatgaatttatcatgattttgtatattgtcaaacatacacaaaagtgccattgtataacggcaactgggctttgatgtgagtgcttctttggtttgtttttgtttgcattcctctcacactgtagccatttaaatgcttttgcagtggtactgtgctattgggggatcttttacacgatttggctgacacagccaaagctaaaaattgcaaatttctcccacacatattcagaggggaaattggttccttgctgcatattatgcaaacaaaacatcccagtgggatttgcaacccattcctccatttgctaggcactctggagaatgtgaagaatatctgtaagacacggatgaagaggctggacagctccgcctgcctgcatgctgtgggcgacaaggccgtggaattcttctttgcttctgatgcaaggtaactgagccttcttctcttcgcttcctgggattacataatcaaagaatgcctgtctaaacactgccggttcttactcatccttccatgtgagctatcgtggctcagcaagtcgcagggccaaagaagagttcagccatccctgggcctgggcctggagtccttgtcctaggagcacctgcatgactgtggtaggcagccctggtggccaaaggccagatgcactggtgggcacagtgcttcgagcctgcacaaaatgaatgggttagttgccaatgttgtaaaatttggagatttcacagagaaatctgaaatctctagcttctctggaagaactagcagatcggggcatgctgtgcagccctctctcaggtggcaggtgtctggatctgctcaaaggctgccccctttagatgagacaactgtgtctagacctcagtccctcccatgcccctccctgcctttgcctggggtgagaccatttgtgaaagacagagccaagacacagggagtttttcaattgattctaaagtccatgctctcatcaatccactgaataatgattttgaaatttgagaaattctgctttatactcatttcagaaaaaaaaaaagttatacacacactcacacacacacagagagagagagagggagagagagaaccagagcactttcctgccatttgaagtagaaaactgctgtaatcacctctggtaccttcttcaaagacccaaaggcttgggcctttgttatgtttccattcttgatgggttttctctttcccgaccagcctctaatagggccgtgctgtgaggcagggaggacaccaggccgggtctcctgggaaacgggagcgacagggaggcgaggcctgattaaacgcacagccagcatcatacttaacgctgaggtcaaggcagcgcttcccaaatggtgccccttagaacacgccgagaataccaacgagacgctggtattatttcagtgattctaaaacacggagaattgtagattttggcatagtaccattagaatttgttgaagcttttatttcttagaagtttgtcaaataattgtgatcttaacgatcaatagtaacttatattcaatgaaatatgatagatgtttctttttttatttttatttatttatttattttgtctcactctgtcgcccagactggagtgcagtggtgtgatctcggctcactgcaagctccgcctcctgggttcaagtgattctcctgcctcagcctctgagtagctgggactacaggtgcccgccaccacgcccggctaattttttgtatttttagtagagatggggtttcactgtgttagccaggattgtctccatctcctgacctcatgatccgccctcctcagcctcccaaagtgctgggattacaggtgtgagccaccgcgcccatccagatgtttcttttttttaaaaaaaaaggcatgaatgcctgaaaggagaggaaataattatttgtaggcaatactattacacatttttaaatccagccaaaaggctgttagaactgatagtactagcagctgggagtaaaggtgtggaaatcctatatcctggccttagccactaagctgtatctggttcaagtgggaccttgtccaccttattctcaggtgtcacctcacgtgaccaggcacgatgcagtcagcaaacgttaggtgaaccaaaaaagcaatactattcaccacagctggaaaaaaaaatgctttagagtaaattttaacaaaaatactctagaacatatttggagaagtctacagaaatttaccatgaggaagtaagagatttgaatataggaagagattccacattcctcagtaggaaggcttactattcttttctttttttttttttgagacagggtctcattaagttgcccaggctgtcctcgaactaactcctggactcaagggatcctcctgcctcagcttccagagtagctattttcaaaaattaatgcactcaacatttaaaactaatttaatgattacaagttatttttaaaaaatattgactctacccaaattattctgtgaattctgtgctgtaattaagactgtccaggccgggcgtggtggctcacgcctgtcatcccagcactttgggaggccgaggcggacagatcatgagatcaggagatcgagaccatcctggccaacacggtgaaacccggtttctactaaaaatacaaaaaaaaaatcagccgggcgtggtggcggaggcctgtagtcccagctactcgggaggctgaggcaggagaatggcgtgaacccgggaggcggagcttgcagtgagccgagatcgcgccactgcactccagcctgggcaacagagcgagactccgtctcaaaacaaaacaaaacaaaacaaaacaaaacaaaacaaaaccctccatattattttatttgtttatgcctttggaacttcaggaagtgattctgtcgcgtgtagtgtagagataagaaagacaacacatgctgagaaaggaatggcaggtggccctcccagatgtgagcacgctgtccagcttttgggcaacggtggccagtgtgtgcggggcacggtatgagagcctcaccaggatcccatgcgataatcatgacagacctctggggaaggcacagctcttttctgtttacagaggcggaacctgagacaggaactccagggggttatgtatgttgcccacgggcacaggtctggcaagtgacagaggccccgagtccacctcaagcctaactggtgggccattggttttaatgactagattacatgactacccattttggaaataaaataattatatttaaacaaacatgtacatgcacacataaatataaacacacatgcgtcatgcattgttggttggttaatgctacaatggaagcagtgttgatctctcggagacaggatagggccgtttttacttcttgtcactccatatttctactttttatacaaaaaaatatatttctatacaaaattttgtataaagctctgtatacttttatacaaagcatacaaagttatttgtacacttttatacaaagcatacgaagttatttgtacacttttatacaaagcatacgaagttatttgtacacttttatacaaagcatacgaagttatttgtacacttttatacaaagcatacgaagttatttgtatacttttatacaaagtatttttatataaagttttgtttaaaatattttttccagtacagtggcttgccatctttctttctctttcttccctaggatctggctggatatacgtcttttagagccttagaccttgatggtttctctctttacctttgcaccaggagtttaagtgttcattttcaggcagtcacgtgtgggtgtggctcttgatagaatgagagtgttttttttgagacggagtcttgctctgtcacccaggttagagtgcagtggcacaatctcagcccactgcagcctccgcctcctgggttcaagtgattctcctgcctcccaagtagctgggattacaggtgcccgccaccacacctggctaatttttgtatttttagtagagacggggttttgccatgttggccaggctggtctcaaactcctgacctcaggtgatcttcccgccttggtctcccaaagtgctaggattacaggtgtgagccagggctcccggccgagagtgttttctccagtagtccttcaagcccaacctgatggtttataccacaactatataccattaatcacctttctttttcatttagcaacttttcaaacttaaaatgattttaaaagatactttgtattatgatctcaagggaaaaaaatcattattcttttccatacagagaaagttataaaaataaacacaatgggctgggcacggtggctcacacctgtaatcccagcactttgggaggccgaggcgggcggatcacgaggtcaggagatcgagaccatcctggctaacacggtgaaaccccgtctctcctaaaaatacaaaaaagtagccgggcatggtgtcgggcacctgtagtcccagctactcgggaggctgaggcaggagaatggcgtgaacccgggaggcagagcttgcagtgagtggagatcgcgccactgcactccagcctgggcgacagagcgagactctgtctcaaaataaataaataaataaacacaatgaccctatgtttctttggtaagcatagcttgtagactacttttagggctcctttgtgtatgtgtgtgtgtgtgtaagaaactaggtcttttgtcctgatgagtttcccattgtctgggttttgctgagtgcaacccctggtgtcatttaccatcttcctctgtcccctgtgtttcctgtacgctggagtttacaagtgttaaaagctcgatcttattcaggtttgattttttttggcaagactacatagttggtggtgtgtccttccatcaggaggcgggtgatgtctcaccatctctctttttgtgctaagagccatcaggggtttgagtgttgccagccttatccatccatgataaagcttcgtccagctttttaccttctggtttcaacagccatgaatggtccttgattagagctattaataattaggagttcataaattgattcttctattatttcttcattactagctgtatcacttcttagagaaacttgccttcataaagtatgtggttgttctgaaagacagattgtttagaaaggcgagataaatgctttattctttcccttcacgattcagaataatgtgttggttctcgagtatcttccagaggtgacattgtttggatcctgatttgaagaaaccggttataaaaagacagccgtgagattattggagatatgtaaacatgctgaatatttgatgatataaaggaacaactattcattttagatatgattatggtattatagtaggttaaaatagttttagagctctatggtaaagtgtttacagaagaaatgatataatgtctgggactggcttcaaaataattccgtggggacaggagggaagagtggagaagaaaaggaagattcacctgcaaatcaatgtttttagtgtggtctctctgtccctcctaaaatgccaacgatgtggcctccacgcttgggaaccagcaaggggctgctgcctcgtaactgctcagggcagggcactgatgatgcctgtttcccttgccccagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggcaggtgtcctccagagtccacgtgcggcagcctcgggagccagcgcgcctggtggagctcctgacactctgcctggtcctagtagaggccacagccctcctgccctctgtggccaccagggcggggctgcaggtagcctgtggcttgcacaggtgaggggatgtggggaggctggcctggcacctccaagcgggggctcctgtgtgcagccagccgccaggtctttcctactggaactgagcccagtgtgtcagctgccttccttcaccgactccgcgggacacatgcccaccctcaggcatcatttctcctctgggtggaagtctgcaggtctgcagtaaatggggggtgggggtacactttctccctacaaggagagcctctctgtctgcacccatttctgtccccttacaacctctaccccacagggcagcctgagcaaacgtctaagaacatgaatcagcccctgtgatcatcccgctgctcaaggccctccaatggtttcctactgttcttagaataaaatccaaactccctgccacagcccacaaaccccacaccccagtggggccaaagcctggccccaccacactcaaccctctgtcccactgtgccccgccacagcccctgcattcgctgttcttctcataggactggttccttttcattgcctccagctcccttgaaatgtcaccccctcagagactccttctctgctcctgtgtctgccatggtccctccccagcccctcccctatggtggccacccctcattcccctcacttgcttcatttgctcgtcgcacaagtgccaggtcatgggagacaggccgggagcatgggcgatgttggtgtcatgagtgtgcgtatcctagagaacacggcctgccctgcctgtgggtacctccagagcatcaggtgcaggggcttgaacaccctgcagccccattgtcccatcagcaccatccaatcccactcaaatcagagccctggaaatgcctgtgtggctggaaaggtttttttttttttttttttgagacggagtcttgctctgtcgcccaggctggagtgctgtggcgcgatctcggctcactgcaagctccgcctcccgggttcacgccattctcctgcctcagcctcccaagtagctgggactacaggcgcccgccactacgcccggctaattttttgtatttttagtagagacggggtttcactgttttagccgggatggtctcgatctcctgacttcgtgatccgcccgcctcggcctcccaaagtgctgggattacaggcgtgagccactgcgcccggcctggaaaggtttttattacggaaaccaggagggtatttattagaaggaaaattgcctgtttctttgggcctgcttagctgtactttcctagctggatggctttttgggagtgaagcactttactttcttttggccttgctaagggagcatggcccagagggatcagccaggccatttgttacttgcatgccttgggcaaatccctccctttctcaagctgcagggtccaatatgtaaattggagatagtcctggttcctgacctgcttccctctgatggtagtgagtgtcaggcagggtaatccctggggatgcctttgggaatctgcagtaagctttacaggagttactatcgctgctgcataatgaaaagcagtgaaatataatgaaattaaaactgaccagacgtttatttgaccaggtaacttcagtgcgtttatgcagaaggagatcttcgaacagccagaatcagttttcaatactatgagaggtcgggtgaattttgaaaccaacacaggtaattcctacactcggtggggagcctccgcccgagcctagtctcagggaatgcggtgactgtgtagactcagcattaacgccttgtcgtgtgccctgcagtgctcctgggtggcttgaaggaccacttgaaggagattcgacgatgccgacggctcatcgtgattggctgtggaaccagctaccacgctgccgtggctgtaagtgtgacacatgtgcgtggggaagtcgacggcagtctaggaccagacactggccttcagttttatcactcatgtggccttctgaatttggctaagcccttgtacccattcccatgagctagcgtgagaaatgacacggagcccttttatcttcgaggtggcctgtgggtgaccgaagtcccctcgccacctggacagtgaggttccgtgtcacaaactgtccctagaagcccagctgccccatgtccctgtcgtgcctgtgactgactttagtctccatgcttgcttgttggcttcagacgcggcaagttttggaggaactgactgagcttcctgtgatggttgaacttgctagtgattttctggacaggaacacacctgtgttcagggatgacgtttgctttttcatcagccagtcaggtaagggacacaggcattgtggccagccttgcatcaggtcagctctgggctctctcctcttctccttcattcagttaagtcctctgcatggctaccctgtgctgcgaaccctctcttgcagcggtcatttaacccgtagagccatggattactgtcgccattgtacggggagggcaagagatgtctaaggccatgcagtcagggggtgacagctgggattgggctggaaatccacgcacgttagtctttcccctgccccgtggcttctccctcttcttgcctatccaagacttcaaggaccacttaccgaagtgctcataaatgtttgctgatttatgttaatagaaaaagcatctcctttaacattttgttaggttgagagtcacgtggaggacccagtatgggctctgtgcccaagtgtccaagccgagctgcctgtggcatgcagtgcccatgctgcccagcagggggaggtgtgggggagacagtgctcccttttagggccaaggaaggtctcccaagctacatgcaccccatctggtgccatcccaacactgggcttgacatttgctccagctgtctcagggaggtgatccagggccataggcttggagtctccttgagctcgtggaagatttttgaaatgttttaattacggataattccaagcctttataaaagtagaattttcatataatgaatatcctagccttatccagcccatcttgtgctggtcggacacactcatattaacccctcgtctccatggggttactttgaagccaatcccgggcatcatgatattcatccatataaatacttcaggctgcatgattaaaatgacaaaagaaaaacatataaccggccgggcgcggtggctcacgcctgtaatcccagcactttgggaggctgaggtgggcggatcacgaggtcaggagattgaggccatcctggctcacacagtgaaaccccgtctctactaaaaatataaaacaattagccgggcgtggtggcgggcgcctgtagtcccggctactcaggaggctgaggcaggagaatggtgtgaacccgggaggcggagcttgcagtgagctgagatcgcgccactgcactccagcctgggcgacagagcgagactccgtctcaaaaaaaaaaaaaagaaaaagaaaaacgtatgaccacggtgttactaccacaactaaaatactgattgtaatgccctatcatctattaggacttttagtactcctgccattttccattttaaataccatttccattttgttgacaagtgaagaaaaaccagtacagatacaccgaccatccggcccaccaccttatgacgcaggagctgctgccgtgttcacctttgggtttctgatcccaccagagcctcagactattttataaattggtgggagacattaacaaaagaacagaggtggagctaatatgaaaataatgcagtggcagcttccgaatctctgtgtgtatagaagtcagccctttaatgagattgaaaaaacactatcgaaccctagggcgcgggtgacagaagttagaaccccctttcccgcaccctcaccgcagtaccccgtgacactccagtgccataacccagggctctgaagaaagaaaagcagaggagaattgggccacctagcaccgggcggcacctgcctgccctgcaaagctgggacagacacagccaagagcagtggccctgcaaacagaacagcctcccgactcatgaggatttcaacagttttgattttatagtctggcttatgctgaatttaatttgagtgctttaggactcacaaacatagggagcttgtgctggtttatgcatgaagctgtttagctttattctaaaaacaatttgagtccacactgagaggcttgcaagaagtgtcctttcaaacaggatctagctgagaaacaccacttggggacattcctgcttgtcagatgttaaatctgttccatctcagcacgttctgaataaggcagcttattcagttgcagagagggcgctgggagccaagcccacctgtcaccagctgtatggctttgatcagagcaccggtttcctcctgtctctgagccctcatcctcaagaggaaaatggggacgatggtcctcacggggttgtcacgagatttaaatgaaaagatgcttgccacaaatagtaacacaccttgaatgtaagaatcaaccgaaaaggctgttgagcgagcgttttcctttctgaacacccgctggctgtgtctcgggcgccgatttccctgtaagagccggcggtgaaggaggaaggggtttggggtggggccgaggctggcggagcgcggcactgagagggcccctgggcggcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggtaggaggagccacgggcgcccgtcccagggagagcctggcggaggcaggtgcaccagaggccgccctcctccggcctgctctgcccgcgccaccgcctttctttccccttcccgcctcaccccttctctccgctcctttcctttcccctcccctcttggattcccgtatcttcattttttttatttttatttttattttatttatttattttttttgagacggagtctcactctgtcgcccaggctggagtgcaggggcgcgatctcggctcactgcaagctccgcctcccgggttcacgccattctcctgcctcagcctcccgagtagctgggactacaggcacccgccccacacccggctcattttttgtatttttagtagagacggggtttcaccgtgttagccgggatggtctcgatctcctgacctcgtgatccgcccgcctcggcctcccaaagtgctgggattacaggcgtgagcccccgtgcccggcccccatatcttcatttagtctcattttattcccatgccacgttcctgtgtttcgtccatgttgtcctgtggctctttgagcaccttggagatgcttattttaaagtcctttagggctggcacggggctcccccctggaatcccagcactgtgggaggctgaggcgggagcatcccttgaacccaggagttccagaccgccccgggcaaccccgtcccttcaaaaataaaacttaggccaggtgcggagactcaggcctgtaatcccagcactttgggaggccgaggcagggggatcacctgaggtcaggggtttgagaccatcctggctaacacggtgaaaccccgtctctactaaaaacacaaaaattagtcgggtgtggtggcgggtgcctgtaatcccagctactcgggaggctgaggcaggagaatcgcttgaacctggtaggtggaggttgcagtgagccgagatcgagccactgcactccagcctgggtgacacagcaagactttgtctcaaaaacaaaatagaaataaataaatagataaataaaacctaaaaattaactgggcagggtggtggcacctgtagtcccagttactcgggaggctgaggtgggagaatcacttgaggaggttgaggctgcagtgagccgtgatctcgccactgcactcaggcgtgagcaacagagtagaccctgtctcaaaaataaaagttgatttaaaaagtgaaaataaggtccctgccacctccttctttgtgcacaggcttataccagtcagttcatctctctggtgatgtttggtttgatgatgtctgaagaccgaatttcactacaaaacaggaggcaagagatcatccgtggcttgagatctttacctggtatgttctagaattcagctttccatgttttcagatctagtggactgttgctggccattctctgttgactctcacctgtacaggatgttgttcatttcttcttcctcctaaaacttcctagcttccccaactccctcctggaggccttgctgcctctgacctcatcctgctcggcccccacctccccctgcgctgccgcgctgcctccctgcctccctgcctccctgcctccccgcctccctggtcctcagcctccctgcctccctggtcctcagcctccctgcctccctggtcctcagcctccccgcctccctgcctccctggtcctcagcctccctgcctccctggtcctcagcctccccgcctccctgcctccctgcccctcagcctccccacctccccgcctccctgcctccctgcccctcagcctccccacctccctgcctccctggtcctcagcctccctgcctccctggtcctcagcagtgctcagtgctttctcaccgcagggccttcgcactggctctttactctgctgaaccatcttcttcctgctctgcatacagccgacagcttctcatctcccaaacctcagctcaaatgtcacctcctgagaccctccctggccatgctcacagaggccccgatgccagcactctgtgaaacattagcctgtttatttttttcataacacacctcatgacctgaaattccctgttcacctgttgactggcctgtctcccccaactaacatgtcggctccgtgaacacacagctctgtctgccagagctgccactggacagctggtgtccagcacagggcaggcatacagtaggtgctcagtaagtactcgagaaagagcaaatggccccaggtccttcctatgccaggcgctccttggcagccccaccacactttccccgtttgctgggcagcagcagtcgcagctgtcgtagctggtgagatacaatatctgttgcactaaatcatgacctccttggggaccgtggcctcccctttcttcattcatccaccacatatattaagaaccagtgccgtgccctgtcccatgtgctatccctggcctgccaagataagcagcagctcacctccttcagtcactcacatgccagagtaggagagagacttctgtgcaggcctgagaggcggagatgaatcgagcctcgccccaggctggcatggaacgctcactgcggacaggacatcatggggcttctggggagtgccctcccagagacagagtggacgctggagcttccctgggagccagggccaaaccccagagcaggcagttggggaagggccatcatagagaatggtcaattccaggccctcggggcctgacactggccgagacagcttgctgaaagtttatttctgagaaaagcattcttcctttaagccaggtcataaccatgcaaaacaggacccaattctgacgtctaagtcagtggttctccagatgtggtccacaggtcctgggtgtctgcaaagccctttgaacaaaattgttcacatagtaatacattctttatactaaaaattttttttttttttttttttttttttttttttgcctgtgtccacatttgcaaaggcagtggtggctgtgcccggcacccagcacactagaaggcctactggtcattgtgtccttcaccagcacacacccagtttcccttaagaatggccttgatggccgggcgcggtggctcacgcctgtaatcccagcactttgggaggctgaagtgggcggatcacctgcggtcaggagttcgagaccatcctggtcaacatggtgaaaccccatctctactaaaaacacaaaaagcagctggatgtggtggcaggtgcctgtaatcccagctactcgggaggctgaggcaggaaaatcacttgaacccaggaggcagaggttgcagtgagccaagattctgccactgcactccagcctgggcaacagagtgagactccatctcaaaaaacaaaaaagaatggccttgatggtgaggcgcagtggctcacgcctgtaatctcagtactttgggaggccgaggtgggcagatcgcctgaggtcaggagttcgagaccagcctggccaacatggtgaaaccccatctctactaaaaatacaaaaattagctgggcgtgctagtgggtgcctgtaatcccagctacttgggaggctgaggcaggagaattgcttgaacccaggaggcggagattgcagtgagccgagattgtgccattgtactccagcctgggcgacaagagcgagacttcatctcaaaaagaaaaggctgggcacggtggctcatgcctgtcatcctagcactttgggaggtcgaggcaggcagatcatgaggtcaggagatcgagaccatcctggctaacatggtgaaaccccgtctctactaaaaatacaaaaaattagccgggcgtggtggtgggcacctgtagtcccagctactcggggggctgaggcagaagaatggcgtgaacctgggaggcagagtttgcagtgagccgagatcgcaccactgcactccagcctgggtgacagagtgatactccatctcaaaaaaaaaaaaggaatggccttgatgaggtggtaaaaattattagtctgtaaattgcaactctttgtaatatcctttatgatgaaatggggagtacacgtagcgcctttctactggggccaggcgtggtggctcatgcctgtaatcccagcactttgggaggccaaggcgagcggatcacctgaggtcaggagttcgagaccagcctgaccaacgcagtgaaaccccatctctactaaaaatagctgggtgtggtggtgtgcgcctttaatcccagctacttgggaggctgagtcaggagaatcacttgaacctgggaagcagaggttgcaatgagctgagatcacgccgttgcactccagtctgggcaacaagagcaaaactccgtctggaaaaagagaaaaagcctttctgctctacactgaagtgtgatgcttgtctcaagagaagcagccatcccattgagtagcaagctgattttggtgtttgttagacattttctcaaaatgaaaaatcagctgacgcatcagtagaagcaacccatggtatttgttgccaatgataaactttaagctcccaggcaaaacttttgagtgttagaaaacacctctgttaccatgagcttgaccagttcctaacatttaaagacttctctagggccgggcacggtggctgatgcctgtaatcccagcactttgggaggccgaggtgggtggatcatgaggtcaggagttcaagaccagcctatccaagatggtgaaaccccatctctactaaaaatatttaaaaaatttagctgggtgcagtggcaggcacctgtaatcccagctactcaggaggctgaggcaggagaatcacttgaacccgggtggccgaggttacagtgagccgagatcgtgccactgcaccccaggttgggtgacagagtgagactctgtctcaaaaaaaaaaaaaagtcttctctgatgagatcaaggtgacttcaacaaggtgatttttaaagaacattttataataaaagtgtccattttaagaagatttacatacctttgtggccagttcacgatgtcacagagttatgcacttgtaaatgatccatttaaaagcacaagacagaaaaataaattttaacctaacaaagtagaaaaagtttattgataggatttcagattctatattggcacctaccctttcaagaacctactgtttctcaagtttgatgtactgtggtgtcaaagaacaatattcacaattatttgtaaaataatttaaatactcctcgcttttccaactacaaatctgtatttgtaggctgaattttatttttatacttcaaccaaaagagcttatcaccacagattgaatgtgaaagcagatattagagtcaacagtcttttattaaaaaggcagacactaaaaagatttgcaagaacaaaaagcagtgccattcttctcactaattcttgttggaaatgaagtaatgtaatagatttagtgttgttattttaaagtgaatatttttaaatttctcattgttagtttctttctttctttttcttcttttttttttttcgagatggagtctcgctctgttgcccaggctggagtgccgtggtgccatctcagctcactgcaagctccgcctcccaggttcacgccactctcctgcctcagcctcccgagtagctgggactacaggcgcccgccaccatgcccggctaattttttgtatttttagtagataccaggtctcaccatgttagccaggatggtctcgatctcctgacctcgtgatccgcctgccccagccttccaaagtgctgggattacaggcgtgagccaccgcacccaaccacgcccggctaattttttgtatttttagtagagacggggttttaccatgttagccaggatggtctcgatctcctgacctcatgatccacccgcctcggcctcccaaagtgcggcgattacaggcgtgagccaccacgcctggtcctcagtgttattttctaatctggtaaatgttgacagatttaactcaaaaacaaaggctcttggggatgtgcaataatttgagggacttgcaataattttcaagagtgtaaaggagtcctgagaccaaagggtttgagaaccggtggtcccacttacaggggccttgtcttgagacacagcaggaaagaggggtgttaactggtggtgtcagctctgtctccagtgggtgatttttgcctctctgagcctcagttgtcttacctgcaaaacggagtgagaaatggtacttcctaccttgttggtgctcaagaaagtgttcacacaacacgaatccccatcctaacagaatcctggccaggagcccaagttatttcctgtaatctacgtttgaaacgaatgcgaggaagcaaagtgtgctaagtgatgcggtttcaaaagctcctcttaaaccccagcatttgtcttcatgaatattgctttaaagtcggcctgactggttttctccctctgctccgtgcatggcccagagctgatcaaggaagtgctgtctctggaggagaagatccacgacttggccctggagctctacacgcagagatcgctgctggtgatggggcggggctacaactatgccacctgcctggaaggagccctggtgagcccccacccccagcccccacccccacggaggacaggcacaggagaccctgaggagccagcgggaaggagggcagggcgttgggcttggggagggccgggcctaaggaccccttggccagtcctgtgagcctgcgctgagcaccagctctccaccaggtttctagccctgggcacacagagatgggtgaggcaggtgcctgcccccagggatctcccaatctactgaggagaaagggacagggcgcctggggtgtgcccctccggctgtccaggcactgccagggtccacttggaacagctcactcagacctcatgagctgcttctgagaggttggcggttgctattcaccctcattcaggaggaaacaaagcctctgaaagcttaagtatctcactcaagatgacgtaggggacccgaatcagacctgagtccatggggccttcgcttttttccaccaaaattgaggggtgggttctccgcagagtttccttgttacccctcaaacttccaaggggagtttgagatcctgcaggaattaacttcgaaggccttgctttttcaaaaattggtgacaggccatttgccccctgcagcattaaagatccacgccaggaaagagaaagctgatggggcagggacagggtgccagggccacagggctgcccagagggtgggcagagagccgtgcagggtcctgcatctcggacttgccctttcctcgctgtcagcgtgccatgcacggagcagatgctcagcccaggtaacggggacagtgctccagctgaggctgcactggccaccaagacgagggcattaaccgtggcccagctgggctgccatcctctcccatctcctccccaccacccccatttgaaagacaatgctaggctggcacagtggtccacgcctgtaatcccagcactttgggaggccaaggcagtcagatcatttgaggtcaggagttcgagaccagcctggacaacatggtaaaagcccatctctaccaaaaattcaaaaactagctgggcgtggtggtgcacgcctgtaatcccagctacatgggaggctgaggcaggagaatcgcttgaatccaagaggaggaggttgcagtgagccaagatcatgccactgcactccagcctgggagacagaacgagactcccatctcaacgaaaaaaaaaaaaaagaaagaaagaaaaaaaaaagaaagacaatgccagttacaagtggttaccggaaacattcagagttgatttccttggtcttggtggggagtgcagggctgtcctcactgagctccatctcctgcacctgccccctggagattctgactcctgttaaagaacaggcaggtgctgcttcttggagtgcagtagaggcaaggcctggggtgcactgtcagtccccagatgactctgcgtcatgggtgggggctgagctgcggtggctgaacgtgctggcgggagatgcacattgcagctatgcctccgcatgagtctgctgaaggaagaagcgtttaggtggctgctggcacgagcccatggtcctctggtcactgggaggccggcactgcagctgtctgcgcctccagactggagccgcactccttacagtgtggccctgacctaaatcagcagtgctagcggggagtcgagagatgatttatttgactgtctcaccatttcaatgacgtggatttgtggtaactgaatagagatggatctacctgaacacaggaaaaaaattaattcaaataacaccccagtttgtgtgattttgcttggaaccactctttagaagttattaatgggcaaatgcttaatcagataattaactgaaggtgtagctaagctgaatacgatgctgtcgttatacacgtggctggctagggaggagcagggggtgagctaggctgactccgacttgtttgtcctaaggggtggctgtgcgtgggactggagagagacaacagcagtgcccggggctggtgtggggacacagaggttgtgtcccgggctggtgcatgctctggatggtagccaggcctctccccaggcccttgctgggtgtcctcagtgctgtcaagcactccaggcatctgtctgccttgcaacccttggctctctgccttccagagtcatccttcccctggttccccttcttcccctctggctgatctgctccagccccatctgcccagtgtgactctgatctcacctcctgtttccagaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccaggtgagggctctccactggactgggccagctctctcctgcttttccccatgcatgcccacctcaccactgtctgccagtaccagtgatggatggtctggccagtgagtggctgtgaccacacaccctcccccgggccgcctgtggggagtgcacacacttggaaaggagctggtcagcccgcagctgtcccacacagctctttggtggggcccagggacccacactgctgtgagcagcaccagatcctagcctggagctcaggggaggtactcctggtggacatccctggggcagggtttccccaggttctgcggccaagcagctccgatgggaactacctggagttaggtcaggtctcatagggcaggggcacagctttccataagactgccctcgattcaggcacctgttgcaagccaggggtccacccacacatctgagcaactgactatgaatccaaggattcccactctcccctgaagttcagtaattttctagaacgacccatagaactcaggagatgactatatgattacagttttattataaaagatataaatcacagccaacccaaaagaagagacccctagtttgagggccccagatgtgaagcttgtgtcctcaggatgtgtcaccctcccagcacgtcactgtgtgtcgcccgggagctcccctgagctgctagctccagtgtccagagtttgtattgtggttttattaagtaggcaggatggagtgaaccattggccatgtgatcaaactcagtcgccagccccacttttgtccttggaggttgggaggtcagactgacaggctcatgtctcaaagccccaaccttctaatcatgtggctggcctttctagcagggccagacgccatcctggaactatctacaggcccaccacgagtcgtcaccttagcataaagttaggtatagtccaagggacctcccataaataacaaagatgcttttgtcacatgggaaagtccagaagccaggagctcccttcctggaaccggccacaaagaccaaccaaatgctttgtacacagcagctgccctgaggtaggagggcagagttcatgaagtttcggggaggtgaaatccaatgaggtgccccatccagatgttgccacctggctcagcacagaggtcagagtgagggtataaaacacaatggcatcatttccccacttaaaaccctcccatacctgcctgtcaagccacagagacccacagtcctgcgttatctggccctttcctcctgtttcagtgagttccaggcactccagctttccttctgcgtcccactctcattgcgcccgcgcccgcctccgggcctttgcgctggccgctcctgctgtctggaatgcccttcccacagaatgctccgccgagggttgtcccctcatcatttagggttcagtccagatgtctcctgtttttgagagagctttggagacctcaccagtctcccaatgacattatcctgttttctagccttggtggcatttctttggaattcattttttttttttttttgtgacggagtctggctctgtcgcccaggctggagtgcagtggcgccatctcggctcactgcaagctccgcctcccaggttcacgccattctcctgcctcagcctccccagtagctgggactacaggcccccgccaccacacccggctaattttttgtattttttagtagagacagggtttcaccatgttagccaggatggtctcgatctcctgacctcgtgatccacccgcctcagcctcccaaagtgttgggattacaggcgtgagccaccacgcccggcctggaattcatctttatttcttggtttgcttgtctaggtttttgttttctaccactagactatgagccccgctagagttaggagtgagtctgccccgctctcggcaaggcacaaatgggtgccaaatgatgcagcaggatggcaatctccttaccagggaaggggaagaaacccccaaaaagcatcagacactttatcctttccaagcatttgtgtcccacacataccacctcacccatgactccagcaaatgcaaaagaggactgttctcatcacagtaatgtagcttccagatactctgtatgcatcagggatagcttctttcagagagggtctattttatgatgctatttctctgctctagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgtgcgtctaaaaactgcacctaacagcagagaggagagacataaccccagagttcctttctgttctttaaatacttggagtaaatagtcatagagtaaataattttatttaaagtagctttcttttttttttttttgagattgagtctcgctctgtcgcccaggctggagggcagtggcacaacctcggctcactgcaagctccacctcctgggttcaagcgattctcctgcctcagcctcccgagtagctgggactacaagcacccgccaccatgcctggctaattttttgtattttttgtagagacggggtttcaccgtgttagccaggatgaccttgatctgacctcgtgatccacctgcctcagcctcccaaagtgctgggattacaggtgtgagccaccgcacccggcccagtagaagcgtacttatgaaccattcctacctttccttcccactccaccctaaacaaataagtcccatggaattcatatatattcttgcaagaaaagttaatttttaacagtacacaccaagttacctgtgtttaaaagcatgaaccttattctttaaatcatgttaacagatcatgacacacatcaggtgcacagtaaatgtttattgagggactaaaccttatacggttaaatgaggcttctggactaaggaatctgcctccaagacgcaggtctctaggttggtgaccatggtgaacatctgtctcttgtttttaagtactctgaaaattgtctgtgagaggtagcatgttgctgagatctttggggtcctgaacagtcactttctttcattttaggttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttttttgtgtgtgtttgcattttgttaacctcattctttttgtgtactttgaattttgaggactgtgcaggagctcggcagtgtttggaggggcagccctgtttgttagtaacattggcctcgtccacacctgagacctatgggtttctagtaggaaaaggagggctgttgtccaggatacaacaaatccaagagatttgggactcagcagaggggccactgaacctggaaggggttgggcagaacctgtagacagcatagaggggtgaaactctcaaatttgtatttttttcccaataaggctattatagtccctggtttcattaatacaatcagatggaaagattgaaagccagagagttctgaagttttgtgaagtcagaacttaggctccctacgtaagtgctgtcgcacacaacctgaatgatgtcttcatgacaacgggtgtgtgtagccctagtatctcataaaccctgtccaggattacctatgggctactcagcaaatttccatcctgtcctatgccctcacctgtatcatgggctggaaacctgggagctacatttccagttatccaccatcctgtcctatgccctcacctgtatcacaggggctggaaacctgggagctacatttccagttatccaccatcctgtcctatgccctcacctgtatcacaggggctggaaacctgggagctacatttccagttatccaccattctgtcctatgccctcacctgtatcacaggggctggaaagctgggagctacatttctaggttatccaccagtgagaggcattcatgggagacttggaagatagttgagtggcagaaatcatattttgtatttatctctggcagaagcagatagaaatgttgcttcagcaaacggggttctgctgtggccctcaggggctccccaaaacgcacccacctcagcatgccaggcagtggtgaccatgaacagaggtcgcctgtggctcctctaaaatcccaactctggagagctggcagcaaccaggtgccacaggggcttttcctgacttctgtcctccaggccctgggtcagtcccagggaaatggctagaatagtttctgtcctactaatcaatccatgaccaatacaacttccaagattaggagactacaaactagccagaacatttttctctggacaagacctagaaagtgtatttcatccttatgcccaagaggcgacggccattctgacttttgtgccaattgttcccttgcttttctttatagtttcacctgtgtatctatcccccaaatacactgcctagttcgaaagtggagggtgagtgcatgctggcggtgcaaggagagggcggcactgcctccactagacggaggttccaggaggtgagcagatcagtctccaggtcgtggtctgacccctgcttctctgggaactgacaaggcccctcctggggaagtcatgaggaaggtctcgaggaagtcttgggctcagcacagtcaggcacctggtagggccaaggtggggaccacgcgctggacctgcagtggaaatagtcagagggagggggctgacctgtacgtcctgcttctaagctcgccacggcctgcctccagctctcggtggggggaaagctggaaacttctgtgaatgttgtgcgtcctcagcagaggaggggagcgcccctcgtcggcacatggccaagccaagtaccgccaagaacctaggccaggctctcctgggcattttgtccccgggctacagatggcctgatggaggtggggtcttggtgaagacagttcaccccgtgggtcacgctgctcagtatggctcagtcgctctccacgtctggtgcagagccatcacctcagggtcacttctcgccaccctccatgggcctcccaggccatgtcttctgtgttgggttcctgtttttgtttttttgtttgtttgcttgttttttgacagagttttgctctgttgctaggctggagtgcagt

SEQ ID NO: 12463 - DNA, 4732 bp, Human
ctggctaacatggcgaaaccccgtctctactaaaaatacaaaacattagccaggcgtagtggcggttgcctgtagtcccagctacttgggaggctgagacaggagaatcacttgaacctgggaggcagaggttgcagtgagccaagatcgcgccactgcactccagcctgggtgacagagcgagactccgtctcaaaaaaacaaaaaatttttgccttgcaatcgtttgccttgatgttatgtctaaagccccacaattctctaaaaacagagatgtataaaaaagcacacgtatataattctctgaaaacagaatataaatgagtcattgctccatttaactgacatttgttgagtgcttgttataaatatggcattattctagctggtgtgaggttaccaattttttttaaacaaaagtaatatgaatatatacacacacatttagtgactgcatatgtgatgtgtgcttttgaagaaaaaggagatgctgttggaggaaaatggtggtggtggtgggaagtgatttagagtagaaccagggaagtctcagaagtgacaactagctggaacctaaagaacgaggaggtagcaggtggaagagaaaggcaaaggcattctaggttgagagaataggatgtgataatgtcccgaggaaagagagcttactgacagggagggaagatgtcaggtgtgaccgaactgtagtgagcaaagggtaactgaggaggtggtcaggagcctgctcagccaatggggtaaatactgttaaggaattaggacttgattttaagaacaaccatcgcatcattttaaaagcaaacaaattgcactataatttccctcttcaaaaaggcacattggctgtgcacggtggctgacacatgtaatcccagcactttgggaggctgaggcgggtggatcacctgaagtcaggagttcgagaccagcctggccaatgtgttgaaaccccgtctctaccaaaaatacaaaagttagccaggcgtggtgacatgtgcctgtaatcccagctacttgggaggctgaggcatgagaattgcttgaactggggaggcggaggtttcagtgagcagagatcgtgccaccccactccagcctggacgacagagcaagattccgtcttaagaaaaaaaaaagggcacattgatggctattcaaggcagagaggggcacatataaccccaaagagatggctctggggagggttgtgttgtattacattgttggcattgtattatccaggtgagagatgctggaggctgggcggtgccagtggtgatgaaaaggagagatggatttgaaacataggaataatctctcagattgtttcttggcatcacttacctaaaatgcttctttcaaatatagatgtacacacccctccctttaggatacttgggacaatgtgccacttagacataggggatggaacaaattggagagtctgtcaatgccccctgcaatcttttctcttgatgttatctcataatgccccacaattctctaaaaacagagaacataaatgagtcattggtccattccactgacgtttgttgagtgcttgttatgaatgtggcattattctagctcttgtaaggttaccaattttttaaaaaacaaaagtaatgcaagactgctgatgaaaatttggaatatgagaaaagcataaagaagaaaatacatatctttaagcacaccacccactgttaacattctgatctatgtacttctaatattttctccattttcatatgtacacatacatttatttacatgcatatataaatatcaaagtgtatatatataattttctctgccatttaaatttttactgtgtaacaatcatggattgtaaaaaaagtgaataaaatgtacgcagtcagtttaaagactaacaaaatatgcattaaatcaccagccaggttaagaagaaatactattacttataccctggcatctccctcccacctttacatagccaaatccagaaaagatccgttttcctaaccttgttcgcctattttattatttaaattgcagcaggagggaagcatgtctactttatccaatttcacacagacgctggaagacgtcttccgaaggatttttattacttatatggacaattggcgccagaacacaacagctgagcaagaggccctccaagccaaagttgatgctgagaacttctactatgtcatcctgtacctcatggtgatgattggaatgttctctttcatcatcgtggccatcctggtgagcactgtgaaatccaagagacgggaacactccaatgacccctaccaccagtacattgtagaggactggcaggaaaagtacaagagccaaatcttgaatctagaagaatcgaaggccaccatccatgagaacattggtgcggctgggttcaaaatgtccccctgataagggagaaaggcaccaagctaacatctgacgtccagacatgaagagatgccagtgccacgaggcaaatccaaattgtctttgcttagaagaaagtgagttccttgctctctgttgagaattttcatggagattatgtggttggccaataaagatagatgacatttcaatctcagtgatttatgcttgcttgttggagcaatattttgtgctgaagacctcttttactttccgggcaagtgaatgtcattttaatcaatatcaatgatgaaaataaagccaaatttgaagtaaagtgtctgggcagtggctgtggggatagaaaggagagatttacaaatcattgaatcttctttctcatgaaacatcatttgtgtgtgacaaattcaatttataaataacccagatgtattatgtagaagctgaggctcaaaagctatcacttgcttaccagacggacataggagcatttatctgtaatattaattcatgagtgtggagtctgaagagatgaataaacaaaccataagattactttacatttattgttttcctggcctttaacctatttagaagtcttaagacagaacaaacatttttctttttctttttctttttcttttgagacatggtctctctctgtcacccagcctggagtgcagtggtgcaatctcagctcactgcagcctcaacctcccgggctcaagtgatcctcccacctcagcctccctagtagctgggactacaggcacgtgtgccaccacacccagctaacttttgtatttttttgtaaaaacagggtctcactatgttgcccaggctggtctcgaacctgaacaaacatttcaaaggacaaataatccataccagagaagtagagtatttaagaagtacccagtataacaaaacatattttaaaactaacatttaaagttttgcagaaaactaatcttaaaaagttctcattatttaagaaaaaaaaataaaaagttataatgtcgctttaaaaatgtattcttttaacttgatttagttttcctctatttataattagttgttagcatttatgtttaagaaactaaaggatacagaaagggtctaaattgctgatgccctctgaagacctagacaggaactacttaatatcttgcaccatgtggtgcaggatatcatagaatgtcagggctgatcattctactgttggcagagaccacttcacttacagatgagagaagggcagtccactgagaggagacaatttcattcactaattcggtcaggcaacattgacctacttggtccactggcctagaccccaagagtataaagatgagcaaggccgggcacagtggctcacacctgtaatcctagcactttgagaggctgaggtgggcagatcacctgaggtcaggagttcaagaccagcctggccaacatggtgaaactccatctctactaaaaatataaaaattaaccgcgtgtggtggcaggagcctgtaatcccagctactggggagactgaggcatgagaatcacttgaacccgggagggggagattgcagtgagccgagattgcatcattgcactccagcctgagtgacagatgctaaacatcatagtacaatgtgacaaggtcctaacagagatcaatgcaaaggggacacagccagccagcacaaggacaggagggcatgcctaatgcaggtcaaggtcttctctctcagagcagctgagagtagcaggtcaatggcagcagagagatgtggggcctcagcatcccatggcttcatgcctcctagtttaccctgttctcctccccatgccccagccaaggcacagcaacgatgggcaaggcctcaagcctcagggtgctaggacaaaatttagaaaaagaggctcttcttcagagaatgcttgtagaactcgttattccaatcacaaggtttgtctctttaaaattacagagtgagatatgtacaaggtatctacttcctaataacagatttgcaattatgccaactgaagcattcagtacagttagagaaaaccatccatattccaagagcagatgtaggaagagtggcttccctcctcagatcagaaacccagaaatgttgtcccacccagaaacatccatctcagagaggccagagcagccatcaggctttaaatcccagccctctgctctgcatccagacagaaatccgaggtttccatcaggtgacaaagaccctctccttaaccaaactgtcaagctcctctgagccctcttcttgactagagccca

SEQ ID NO: 12464 - DNA, 60002 bp, Human
  misc_feature (1)...(60002): n = A,T,C or G
ttgagggttggaagttcaagaagtttgctttttcctgaaaagactaaccgttttctttgcaacagaatcctattgactagatatgaatcattcccttggtatttgagtcaccaggtggaagatttggatacttgattgcagatgaccatatataggaaagtatgcaggtgctgggaggttctgggtcgctggaggcccctctggctactgatacgaaattgcatagcccaggccgaattctttccaaggatttgtgttcagcactgacagcaagaccctgccctccgggaaagatacatttactatgttcaccaacatcattttttaaaatgtaactaattaaaacgttactccatgaagataccacctttggttttcacgaagacggaaaacttcagactgaccagaaagggaatttttaaatgtaaagaaaaccagaatcttgttcccagaactatgtggttgtgtagagaaacctgtttagaaataaccgtagaggaggaagtaaaaggaaatgatgtaatccctttcaggaaaggatatattgaaattctgtttaagtcatttggccttcgctgtggagtaattctttacatcttaaaagttaaatgatagattagtaataattcttaataattttccagttctgctggatcaatgcatattaagtgtcagatttggtcaggtgtgggccaggcagcagattaaggcagaagcatgggggttaggttcatacctttagagtctagctgcctagatgcagtaggggtccactcactagctgtgtgactgtgggacattaccatacctctctgggctccagcttcttcatatgcaaaacgaagatgtaatacctaactcactggatgattgtgcggcttgtattaaatcattcatttaatcaataagttttttttttaaatatctaccgtgcaccagtgcacacagataagaagaatctccagccctgtgaaactgacctcgttcaatgctggcaacacccccttcttcactttttacagatgaggaaattgaggcccaaagaaattgtgtttagctttaagaggcaaaatgagaaccaataatgccttgttttcactgtacagatggtttgacttctgatttttagacttcagaatagtttatctggctgtaacccctcataagtcaaagagcatgtatttagagagatgcagtattagactctaactggagagttgactgccctaggctacagagagcctgaaaaaaccaaggtgaaatatttccagagactaatagtgtaatttcccattgaacttttctctgggggtgtcagggaatttttagaatattttgttcccaggaagggtgggagcaacttgcatttctaaatcaaccctggagatatgccagcatgtttgaataatatctatttaagaaaaatgtgtctggcttcccaatcaaagaactgtgcctttcacctctgcaccccaccaaggactggaccacctcctcaaagagcagatgtgtctttataacagactgtaggcttggagccttgtaaaatgtacatggagtttcacaatcaagcacaaggaatccaactgaaggcagctaaactttgtgttgatttggtgaggaggagtaaaatcctgtgtttttgttgttattgatccccgtagtggtagcctgtcagtaatcagcagagttctcctggactttaaataagtcaaaaattggcttttcaggaagtatatttgtaagcatcttaagtacaaagatttttttctgtctcttgtcttgaagtcctcacaggtctagcacagtcccttgcatatggtagatgctcagtaaatgtttgtttagcaaatgggatacccaatgtcagatatatgctcttcctgagaaggtttttctgtgaatgttgacatctgttttctggattcaagattaagggttggactaagattattgtgttctgaatcacatattgataccatttactaattgttttcttttaatagattagtgtgatctcagctcaaggcaaaggtgggatatcatggcatctatctgggtaagtaaaaattaagccttcacaacacagtaacatatatgagtcaaaccaaaacacagaaggtcaagatagcaaggaaaattttaggaaagtttttaagtttatctggcaaaattaacatgctagaaaagccagaggatgtcaaaaataataaaatatttttaaaaatgcattgtaaagttacatagttaaaataacttatgatgacaccaaggcggaaaggtcaaaatcagataataaatttagtatataatttgggaatttattatatgaaaaagatgacatatcagagaagaagagacggattattcaataaatgttaggaaaacttctagctgtttggggaaaaagtaaatctgtattcctttttctccttacaataaaataacttccatgtggataaaatacagaaatgaagaagatgaaatatgaatgggccgggtgtggtggctcacacctgtaatcctagcactttgggaggccgaggtgggtggatcacctaaagccaggagtttgagaccagcctggccaacatggtgaaaccgtgtctctactagaaatacaaaaatagcccggtgcgatggcagatgcctgtaatcccagctactcaggaggctgaggcaggagaatcgcctgaacctgggaggcagaggttgcagtgagctgagatcatgccactgcactccagcctgagagacagagtgagactccgtctcaaaaaaatagaaaaagagaaagaaatatgaatggattgaagaatattcttggagtggggaagatgcttacaactgtgacacaaaaccaaacgcctaaaagaaaaatattgatctattttaactacatacaagtttatcactatgacagccaacaatcccattggtagaggcagaagacagctcgcagggaaaaaatatttgcagcacattagacaaaagacttatttccttaacatacaaataacttgaataaattggtttaaaaaatgaacttgacagaaaaagttgtaagggacataaacaggacataaaaagaattataaatgtccaataacatcagaaggtgctacaaggttggacacagtggctcacacctataatcccagcattttgggaggccaagatgggaggatcatttgagcccagaagttcgagaccagcatgggtaatatggcaagacccagtctcttaaaaaaaaaaaaaaaaaactttaaaaattagctgaacgttgtggggtgtacccatggtcctagatacttgggaggctcaggtggtaagatcgcttaagcccaagaggtggaggctgcagtgagccatgttcataccactgtactccagcttgggtgacagagtgaaaccctatctattaaaaaaaaaaaaactcctgcatctcagaattgaaaaaaacataaatatcatgatgagaaacacttttctacttaagagattggtgaaggttaaaaaaaaaaagtaatgtagaggatgtggcaaggtgatatttttattctctgttcatgggagagtaaatttggtacacttttggatagtattttggcaatatctctcagtccttaaatgcacatgtcctttaaacccagtaattccacttgtgggtatgtatcttatagataaacttgcataaggttgaaaaaataggggcccaagtacatttgtttgtattaatgaaaacaaacatgcagacagcataaatgtccatcgatagggtaggaataagtaaattactcatttataacttacaggcatttttatgtgatcattaaaatgaatgggaaaaaagtggatcagctgtatgtgaattgacattaaaaaagtcccaagatgtaataatttaaaaaatcaacttatagagtaatatgtacagagggattctgtttaaaagaaagaacaaagaaaataaaaaatttacggaaagactattacatcaaaactttgtggaaaggtggaattgtgagaaaggaattttacttttcaatatatcaccttctgtactgtttgatttttttttttaatcatgagcatacattatattttataagtaaggtggagggcaagtttaaagaaaagcctgtgcagagatgtgaccatcccttggcctggcgtatggatggaaggtgtgctgttggaaggctttgtttggcccaagttactcccttctcactggctaggaggctaaactctcatctttcatctgaaatccctgctgcttttatgaacatatcatagaatcagatgaaaaaagcatctctccaaaatgctggtgttaaaaaaaaaagtcgccctctggccctcgcccatgagtaaattaacatggaattatttgggcaggctctcctgctgacaccttcaaaggcgtggcacatttctgaagggctaggagagacccaagtgcgtgtgatcaagggtgtattcatttcctattgcactatgacaaattatcataaatttagcaatttaaaacaacatccatttattatctcacagttctatatgttagaagcctgaaatgggtcacacagcactaaaatgaaggtgttgttgggactgcattcctttctggagactttgggaagaatcctcttccaagcccttttaggttgttggtagaatttagttccttgtagttgtcgaattgagttcttagtgcttgctggctgccagcagaagctgtctttggctcctggaggtctctgcctgtccttgtatgtggcccctgcatctcagaaccagcaatgatgcatcaaatcttacttatgcttggaatctctttggcttttctttctgggggatctcttttctgccattctcttctccctccagctgaagacatttctctgcttttaagggtgcgtgtgattaaattgggcccacctggataacacgggctaatccctgtgttttaaggtctggaaccttaattatgtttgcaaagtctctttcatcatgaaacacaatacattgacaattcccaaggattatggtgtatacattttaggaggctgttgttctgcctaccacaggggctaggagtatggctacatcagggatggtagcatttggcatcagatagcaggaaagaggtggggaggggccaaaaacaggaggctaacctgagcctggagggcaaacccacacgtggagaaagaggccctagccaaagaagggctcctactgtctctgggtttttctttcttttttttttttttcctgtttacctcctctccctcaattaaagaactaatacttatgagtggctcagagagcaaacattaggaacaactcagaactgctatggaaaacaagatagcaattctccaaaaaattaaaactagaactaccacatgctccagcaatcccatttctgggtatatatccaaaggaaatgaaagcaggatcttaaagaaaggtatctatacacccatgttcactgcagtactttttacaatagccaagaggtagaagcagcccagtttccattgacagaagaatgaataaacaaaatgcggtacacacacacaatggaatattattcagtcttttaaaaacacatgttgtgtgagaggaagaaaaccctgtcacatgctactatgtgggtgagccttgagcccagtatgttaagtgaaaaagccagtcccaaagagacaaaatactgtatgatttcattgataagaggtatccaaagcagtcaaattcataggaacagaaggagactggtcgttaggaatgaataaggaaagagaaaaagaggagttgtttaatgtgtagagtttcagtattgaaagatgaaaaagttctgaagatgtttcaaaacaatgtgaatattctaaccactactgaactatacacttagaaatggttaagatggtaaaaaccctcagatttccaattgtaaacattcttatcacaaagttttatgtgttctttttttctctctgccacacaaaaccacatacacactcaaacataaataagcaatcaagtcattgcatttctacaaaactgtatacgtgattatgtgtatgattaatttattacagtggtatgatcaagggagaagtcattagttgcaatttcaacgcattaccattgaagatgaaagaatggctggtttcttaggtcttttatattctatctaggagtgttgcaaccctaccattgtttcagatgaatcaacaatctatgttgcattagtatttcctttgtttgcaaattttgaatatctctgttcagacatatgttctaccacttcacccttgatgaaagggcctgatatcttattggtttgtactccttggacttagagtcccttgtcatatgttgcctgtaggtccacagcaagcactcaggaagcccacaaattagaatgtcttagaacgtgactttttattaagctaccacagcagtattttttctgcgtaccttctgttatacaatgctggctttcttaggtaaatactctgagctctttcctccttgatcaattcctaacttacatttacagaataataataaatgtaattcctattagtttgaactctcaaattagaatttttattatggtactagaatttttctttctttatttctttatttttttttgacagagcttcactgtcattcaggctggagtgcagtggtgcaatcacggcttgctgcagcctcaacctcctgggctcaagcgatcctactgcctcagtctcctgagtaggtgggaccacaggcatgcccccaccatgcccagctaatttttaaaatttttttatagagatgggaattcactgtgttgcccaggctggtcttgaactcctgagctcagctgatccacccacattggccttcggaagtgttgggattacaggtgtgagccaccacacccagtggtgctaaaatttttttaaattaactcacaatcattgtaatcaccatgaactgttagtaacatcctaacttgggatacattctcctttcaccactccaaactctaatttacaaaatgaggaaagggaatatagagctactctgcaaccaagggataagagaagttttataaaaatatattacctaaatacaatgcctactaactttgttttgaagttcatccaaaacagttaaacaattaaagcagcaagtacctagtgcgacaggctctgctgggagcagaatgaagacagtctaaccaaaattgtaactctccctttcagaactccctaatcatttaaaaggtaggctcttgagcaaattgcttagtctttctctacttcagtttcctcatctataaaacaggtagggtaatagtgcttatctcatctacggtttgtaagcattaagccagttcatgtaaaatgtattagcagtgcctggcatggagtgagcactcaataaatgttagttttaatcagcatgatttcaatatattaattttattctaaaatgtatttcttgccaaataatatcgctgcaactgtttttgtagaggggcttctgcctatttcctgggcctgattttattacacatcaatagccccctctccccattggaatggttctttcagccatctaaaagagatgtcatgtcctcaatcagattccttctgaccactcttgttttcaatattttataatattttaaacacatatatatttctaaagacataaaatactccctttccactcctagtgggcatactggaatacagttctgacactaactacccagcattagcatcagattccacaggattaagggttcagtcctctgcaaaactgccctcacttcagatgtcagttcaagtgtcgggaatcacctgcacttctggccaactggctataaatttaggagttttcatgaccctctgaaattaaagaattccctagaatgattcacagaactcactgaaagtgctatccttatgaatgcaagtttattatgagggatacccatgggcaagctctggaagggtcctggacccagagcctccatgccctctccctgtggcatcagggcacctcaccctcctttgtgtcagtgtgttcaataaccaggaagctcctctgagcctcagtgtccagaattgtaattggagttccattatgtagacacgaatgattgattaaattatttgttacatgattgaactcaatctccagcccctctttcctcctcagaggtctggctgaccagagttgcaaccctgtgatcacagggctaatctttctggagaccagccatcattctaaggctatctaagggtctaccatgagtcaccccaattgcatcacaaagtcactcctatcactcaggaaattccaagggtttttgaagctctatgccaagaaccagtgcaaagaccagatacattcctaattatactacacatctataactcacattaaggcacacagtttccaatatatattcttttatttttgactaacattatattaaaaataaataaagttatattaataccaatggccctggctatttatgttgatcagaagctctgattgttagatgtatttttcatatatgggaaaaataggaaaatgaattaatgtttggtaataaatatagattagcaaggcagaatcattcaaaacatgggatccatatagaagataccgaaaaagggatccgcggtggtagaaatgttgggaaaggctgccaggatggacccttgcagataggaaaagctaatctatgatcaagtgttcatggtgagagaaggcacagccccccttccctcccgaacccttcctctctggtgggaacaagattggtgcagtttgacatatgaggacacagtcatctcatttccactgttaacccagaggaatggcagtagtggtagaggctcttaggaaaggtgcaatgtgctaacatgagagagaaatttgggaagataatgcctttcaaattctgtcccatagaagacaccagccctgggcatttggatgctgttgttcctgggttcaaagagtttgtgagtgtcctgtccagtttcatactccttgctttgacacagacatcccattagacctttctttcctgatgtgattgctcttctttgctatgcaaatttaaaacgtgtgaggagaaagctgtgttcatgcatgtgaatatgctgaactcctcctctggtctccctcacatctaccacatccaggaatggaagatcaagcttggtgactattttcactgaaagagacttttcacatcccaagcagaacaggcatctttcctggttaggtgctgttcaagtctgctgtgtgttttaaaccatgttccctgaagctgctttaggtaaatattggcattcagacaggtacacaaatggtcttttgcagaaagttgatttaaaacaggttagacctggatttcaaatcaaaacatttaagctttgttttgggacaaagcctggaaagtttctcatctgagtgagaacagagaggcttcctaggaatgagtggaatgaacactaaaaagctgttctttgccattctctgatgttagcccaactgtgaaggagggagggtccctcttttatatttaatcatgataaaactatagtatgcaaagctaatgtttaaccattggaaaagcctggtaaatcagaggtaaagaggaaaataaaaagctctagatcagaggaaggaatgtaaagtggagaaggtatgatttgttctcttgaaagtctatttttttggtggatgtaaagcagttagaaaaaaaagaagtatatagagtactgagcaataaaatgaatacacaggtctcacgtgaattataagagaataaatcaaaagaggagaaaattctcaagtctatcccttcattatcagatctttatttctttcatttgtaactctttgtgtttgattcagtacctcacgtaggttctggaggcatgtttaaataggagtagtgacagtcccatgtgaacagggtttaagaaaggtgaagattgcatttgtagaatttttaccatatggcatggagctctgaaaagtctgacaccggcatttgagaattattgaaagaaacaggatgcagaacaagaaagcatttttaattcatttattcactcaactaatatttactaactatcttttatatgccagatattggctctggcaacacagcagagaaagagaaataaaaaggatggcacctacattttattagggaagacagacaataaatgaagaaataaatgtacagtataaaaagacagttttaagtgctctggggaaaagtaaaggtggataataaatatgatggggggtgtgattttctgctcagatataggaggagaagtcaacgtggcatgagatggtgagctgagggaatatctcgggaaagagcagccaggcagacggaatgataagtgtaagccctgaggcagatgggcaagacacatttgaatgcaacaggaagattcccacgaagcaaaaacagggatacaagattacaaggggattgggggaggtattacaattctcttttatggtactttattatcctccaagggccacagagagtcccaagaagtcttcacatggactgttcaaggagtttccattctctaggtttactttacattaggaagcattcttaaatttgctgcaacttcttgttgggattatcgctttttaaaaaaactcataaataacccataaaataatgcatttaccatcatgtccagtagacatcatttaccttggccatttatgtaagaagtattctgcccagaatattacaaacaggagacatccctgatcccagtccctcacaggtttctcatcctcataggagtgaggtggatagagtaagtgtccccaaatcctgcaaagccagtgctgtggtctaaatgtctgtgtcgttccccctcccccaccaacctgccccttattcataggttgaaatcctgaccttcaggatgattgggcgatgggatctctggggggtgattaggttaggtggggattattgcccttttaaaagaggtctgagggagcttggtcacatcttctgccatgtgagaacacagccagaaggtgccgtatatgaaccataaagtggaccttcactagacactgaatctgctggcaccttgatcttggaattttagcctccagaattgtgagaaataaatttttattatttataagacacccagtttgtggtattttgttatatcagcctggaatgctaagacagacagccaccgttctctagccaagggccatttaagaagatgtggattctgcacttcagtgagccaaattccctatatttctccatatatccaggaagatataaattctctatatattcctgttagattgcaggacccttagacagggacgtctcccgcagaagttacacatgcacagggctgagtatgtggccagaatagccatgttagtcttcaaatctttgtgacccttggccaagagaatttggtcaagaactcttaactaggttaagcactttactttgattgtagaacaaagagataatctacaaatactggtgctagatgactcaaaagaagattaatacaaattatttataatctgctttaaacaaatacatgaaaattattctgagaaagatgttcatgttaataaagtctctggggaggccaagtgtttcaaactcaatccagatagttgggtttgctacctttgtcagagaaaccctgagcgcttggagagacaggaaggaagatgtaacagaatcaccagacacagtcatgcatttcatgtctccagtgtactagaaaacactcagcttctgaagtatctcccaaatctcccagaatacaataggaactttgatttctagactattgatacttgaaggaagcaactcatcgggcagccaaccatctagtgtagagcttggagaaagtccacactgtgagatgtcattgtcttgctttcatattcttacttagcaaactaattcacagttatgtattaagcccctatctggggactgagcactgggctcccagctggataaataggaatgagtgaaacaaatgtctctgccttctggaattttattttagagggggtggagagacagatataaacagcgagaggtattactcaatgctgagtgccctaacaatggagaggtggctgagatgcagaataacagtagaagacctactcagatcaagtgccaaagaagatctgttagagaagatggtctttaaggagaggactgaaggtaaaaatcattccagttagagagaacaacacaaaccaaggcattaaggtgggaaagagttcattgtataccagcttgactttcaaagaactgaagtgtgggaactctacctctcatctggagagagtggctccagataagagtcatgaaggtggttgggccaaaccatgcagggccctatggaccagtgtaaggagtttggactctattcagtgtgaaataggggagtgacaagatctgacttagattttttttttttttttttttgagatggagtctcgctctgttgcacagaccagagtgcagtagcacgatctcagctcactacaacctctgcctcctgggttcaagtgattctcctgccccagcctcctgagtagctgggattacaggcacctgccaccacgcctggttaaattttgtatttttagtagaggcagagtttcatcatattggccaggctggtctcgaactcctgacctcaggtgatccatcccaaagcacagagattacaggtgtgagtcaccccacctggcccgacttagatctttaacagatcccttggctgctatgtgggaaatggctggagatgggaagtaggaagtagagaggaacatgactcagatgttcaagtacgggagagcgatgattgtgagttggacaagagcaggagcaaagaacctggggaggagcgcccatgcgattatcttcttaaaataatctcagcaggccttgctgatagatggaattcagagggaaatgcaggtgaaggaatcaaaggggactcccaggtttctggtggctgatgattgctccttttacagggatggggaaggttgaggaaactgagcaaattggcgatgagcacagaaactggagccagattgcctaggttcaaatcctggctgtgccacaaactacctatgtgaccttggcgagtgtcttaaccgctctggaccctcttttttctcctctataaaatcacggtattaattgtacctacctcatagggtggttttgaggattaaatgatcaggtatatgtaaaatacaagtaagtactatgtaagtgtcagaagggggaagaaatagcttgggaggaaacaatgagttgatataggagataatcaaaacaaatacatggaggagacattgaatatacaagaccagtgctcagaactgaagtctgggctagagctataatgtgggatttttctgtatacagaagagggagtggaagaaataacccacagcaggattagagggaaagaaaagagagagccactttccactttagaattgcgtattttatagaggtcagacaaaggtgagtgcatcctggagaggcgggaagaaacctaggaggtgaggcacaggagccaatggaaggcaggctagctgtgagtgacacatgctccaaggggtcaaggcttcttattataactcatgtgtcatggaaaatacaacatcaatggcttgtttgtccctgtcttccctgatttctgaatctcattcatctttctactccatcccacaccctcctctgttctcacattccagtcctcttgctctgacactgccctgatgatgaaatcactctatttaaaaaagaaaagctgaactattcacagtagcaaaaatatggaataaaactaaggtttatcaacagaggattgaattaagaaaatgaatgtagaatactatactatactatactatagaatactactcagccactcagccacaaaaaaaaaaaaaaatgaaatcatgtcttttgcaggaacatgaatggaactggaggccattatcctgagtgaaataactcagaagcagaaagtcaaataccacttataagtgggagctaaacaatgggtacacattgatatagagaacggaataatagagattgaacacttcaaaaggtgggagggtgggaggggctaagggctgaaaattacctattgagcacagggctcactagtcgggtgacgggtacactaataaaagccaagacttcaccaccatgcaccatctgcatgtaagaaatctgcacttgtaccccctaaatatttttaagaaatttaaaaaagaaaagctgaaaagtatgaatattttttctttgagtgagcccaagaacaaatataaactttttcttcagtactttggacacattatgaacaaagccatgttgtcagcctggcatatctcagggatcccagcgtctgccagtcttgcctgctgtggacgttcagcaccgcctactccttactgccctgtgggctgcagagcatgcctgcggtggtggtgggaggcttctgtttgtgcatcatcttccataggcacagtgatcattgccagccagtggcacttctaggtgaggaggctcttaggcgaggcccccaggatttgccctgtaggaaccgcttggttaccagtatttttctctggcctttacctgctgtattagtttcctagggctgctgtaataaagtaccacaagctgctggtttcgaatgacatgaatatattatctcacagttctggaggccagaagtctaaaatcaaggtgtggtcagggccgtcctccctctgaaagctgtaggggagaacttcttagcctcttcctggtttctagtggtttactggtataggggagtaacagtaatccccataggttcttagttggaaagcacctttgttacaaaagacagattgacaagagaaaaccagacagaagtttattaacatgtgtattttgagtatacatggagacaccaagagaatgagtagttttcagaggtggctttgaatttcagcttatatagcatcttcaacaaagaacagtaaattttttgtaacaagacaatagaaaaggacctttgaatctctgtgggcagcaacttgcaggtggggcagtgaagaaaggcaaataacttgcagataaaggttagttagtacagcttgctaatataaattcttctaataccattgtcaggctgataagggtcttaaactatcttcagtctttaacctttgttctccctggtagtcaggagggcagaataccttttgtcttcataaatctttgtcctgcttttaggcaaatggaggaaagatatctcttgagtatctgtttcttcttgtcttcaacaatccttcatgttttgaagaggcacattctggtctcatactggcagctcgcagctgcgtaactccagtctctgccttcaccatcacatcacattctttctgtatgtctctgcctttacatggctgtcttataaggataccagtggtattggattgggggcctgccactgtgacctcatcttaattaattacatctgcaataacctggtctccaagtaaggccacattctgtggtactgtgggttaggactttaaggtatttttttggggagacacaattcaacccataacacctgcctcacttgactgcattttatttcagggctgtttacagtaaactttctttggttttgaaaaatgctttttactggaaaaattgaacaggaagtcttaacaatttccaagtttgattgctttattttttataatctactccatttttccttgtatcataaagcttcatgacccaacatagcatcttgacattgaacagagagccatcgtttctccccggctctttgagagctccttgtcctggagttttatctggagctttgatttgatgcctcaatttttggatgtggcctttatagggctttctgaagtgatgagtgatctggcttcaccgcatcttcaaaatgtccctgcagcaactgctattcttgctctgtagcatttggctttaaatatgtttcatatcaacagggttggcaccttctgtttttctcttccactcatccttctgaatgtaaatgtttaacttcttgcaaacacagtacactttgcataaagaaataggtacaactggcttttgtgagtcaaaaacagactggcctctcccaggggcaatagcaaacagctccctaggcccagcttggccaagcagtggcttcaaggtgtcatgtgctaaggctgacctccgaaggatgattttagaagatcaagggagattatattgtcttgaaaaagatggtttaaatgagatgaaggctagtctagtttaggagcaaagactgttggaacagaccacttactggctgtgggaacttagacaagttacttaatcatcagtttcatcatctgtgaaaaggatttattatatctaccttataagtttattgcaaggattgaataagcaaatgcaggaaacgcgcttagcacagtacttggcacatagtgattagcagcaattgttcttagtataaagagctcctgttactttccccctttatctagacattctttgctttaatttgttttccaactggcttcagcagcatttttcttttggaggcatctgaaggtcaagtttcagaaaaggaaagcaactaaatgtgtttaaatgtgtggatggaaatctgatcaaaggcaatttttttttttttaaatagactttgccaagtattcaggtgatgttctacgctagcactgactatgttaggacactagggttactggaaataaactcagccaagtattgattagtaatataaatgtcaaggaattaagcttgcagtggagcaggcaatgcaagcagtcctgtttggctgtaaaaatgccgacattcctgaagcgatgagctcatcattaaattcttcatcttccacacccataagagaattcatggcttgtttgctcatttttgctttggttttctagacagctaagaaggaaataaagcagtgcttcttaaactttattgtgtactagaatcacctggaaggtttgttaaatcgcagattctgcatcctggccctgcagttgttggttcaggaacactggggttgggcctgagaatttgcatttctgtcacattcccgggtgatgctgatgcagctgcttcaggaaccacactttgagaaccactaagatgaactccctcgaggcattgtgatgtgacatagagcagggggcattttagtcataaggtgatgggtttgagtcctggggctgtccttattagcagagctcttttaagcaaataatctctgtgagactgggtttcttccattttcaattagaaataataaaattcacctcatgaaggctcttgtaagagttaaatgtttgtaaatcactttgttcatgtattagttttaaaagatttcattaatctttgattgtaagattattttgtaagtcatgtaatatttccgaatgatttgggcaaccaagtctatcaaatgaataatgccattcgtttaaataatggaagcagttttaaatatttcactaaaattccacttcagaattcccaagccctttttcaagttggggtgtgtgtgtgcgtactttcttccccccttgtaattaaacaagttattcctcccccatttaattcttgctaagtactaaattgcataataaattgggaatttcctccttctctaattctgtgcattggcattttagcatattttgatgtgtaggtggtaaaggccagtgaaaagttcacagctggagtgcaaaccctgagttttcatgatgcatgaacaactgggatctgaccacaattttgtctttttatatttagaatcagccacgtcaatatctgcatggcacagaatcacctgggagcttcttacacatgtagaatttagcaccccatctctaaaacatatgattcagtatatagaaggtgtgtcctggtcatatacatttaaagtatcactccaggtggtacagagactgcacttcatgaaacaccaggaatggtctggaatagtctagtttgcttttaaattcagcctctgcctgcaactagctgtgtagacttgatcaaattctctggtcttcttaaatcttggtgctgtttatgtgaaattgctcactctcatttattggggctgttatgcagattataattaacatatataaagtgcttagcatgtaaagtgtgctgggcatgaagcattcaaacaatctaacattggggtagttcttttacaatgccagacactggaaggtggacaggtaagatcaacacaaaagttcctagatggatagaagtgaaatgaagccagttggctctgtgaatccataaaatatttatcaagccttggagaaagagaattcatcaaaaattatattaaagtgactaatttattttctttctttctttctttctttttttttgtgagacacggtctcactctgtcacctagactacagtgcagtgacacaatcacagctcactgcagccttgaccttctgcgctcaagtggtcctcccacctcagcctcccaagtagctgggaccacacctgcacaccaccacacctggtaattttttaatattttgtagagacagggtcttactgtgttgcccaggctggccctgaactcctgggctcaaatgatcctctgtctttggcccccgaaagacctgggagtacaagagtgagccaccatgtccagactaaagtgactggtttgttacaggtatcttcaggtcaggaacattcacaactagtttctaacttgcaattattttctaggttctaaagttcttattttagatgctataagattaaacagtgtttgagtgtattgaaatcaattattcagtctaatctaatgaatcagcagactatcatattttactgtgccagaacactaattttccattcactttaatgtgacagataatgtcctttcatgaaaatattaaacccttcaagagagccaaaatgaacccatattaatacaagacaacagagccaatactattcagtaacaggatagaaaaatgctgtttaaaaggaaatattattactgtaaagacagatttttattcaagaagttaggaactaccacataaatctacgtttactttgatttttctcaacatctttgtggctgtccttctttagtctcataagcaattttaaaatattttttctatattatggtctttcccagcttactgacatgcttctaatttacatgcttaaaattagtagtgtggcattttttacttccttgcaattcctgaagatctatgatgtcagtagagcttttagaaggtcttctaattgcacattcattaaacaaagcttaagaacagacagtcctaagggggttttcatttatggatcatttagtctgggattccccaaggacaatggtcaacattaattaaaacatcttgaagtctgtaaaccacagttacttctgtgcgagatgccatgatgagctttgaattatcacttgaaaaataagaagatttaggaaatttcagctttcttgttgctctcctgcaaatgctactttaaaacaaattttcttcagtgtcaccaagattaacacaacttactgctctagagaaccaatgttttatatttgtaatttgttacacaaaagaaaaagaggactcctgagatatggggtagatatcatattccctgtgtctggggggtagaccatcacttcaactgtaactgccagatgggttcttcctgctcactgtgcagacaaaatcagtccactgagaccatcacattgcagtaaagaaaaagtttaattgatgccaggctagccacaccatgtgggagacagagttattactcaaatcaatttccctgaaggctcaaaagttaggggtttttcaaggttaaaatggagggcagggggctagggaaggggcatgctgattggttggagatgtaattataggggtatagaaaacagtccttgtaggctgagtctgcttctaagtgggggccaccaaaggagttgctggtctgggtggggctgtccagtagtcagaaatgcaaaaagcctaaaagacttnnnnnnnnnnnnnnnnnnnntagtgatgctatctgcaagagtaattggggaggttgcaaatattgtgacctccagaataatggcaggtaattatgtaactatgcctgcatcttagtaaaattcaggcccctctcatcctcctaacttggtagacttccattaattttacaagggtagtttagcttttgggaagagctagtatcatttaaactataaactaaattcctcctgaagttagtttgccccacacccaggaatgagcaaagacagccagcctgtgaggctagaagcaagatggagtcaaccatgtcagatttctcttactgtcataattttccaaaggcaatttcagagccactcctgaagtggtaggaaggtgtgcgaattatgggtttgtcatatgcctctcatatgcatgaaggaatatgcatatgtaatacaagaaagatgtcattttgaaccaatgggactttcaagtatttccttctaggttggacaccgaggaacagtaagagattatccagactttagcccatcagtggatgctgaagctattcagaaagcaatcagaggaattggtgagtgatattttacaattcctttcttaatgttgaagcaaatcaggcaagttacaatctaaaagttcagtttgctcagattggcttactcaatttaataaattgtcaggaattttctaaaattgtgaaataacgaggaaatatatagagaacccagttttattaaatcttaacatttatcatatttacttaatattaaaaattaccactgatactagtggtctaggggagatccccaaatgccgggggaatctcaaccctggctggtatccagactcttgacaccatctagagaagaaattcaaggatgggtcaaaaaatactgaaaacacagagatttattgcaaagtgaaaaatacacactcaggaaaggggagtgtgagtgtactcaagagacagtcgtgcacaagggggtttggggctgttgcctttatgggtttctttaaccaaggggtggaatagtcatgaagattctgggaaaaaggtgatttcttgaaactgtagtgccacccctttttacaccaaatgtcggtgtttccggaactgccatggcactggtgggtgtgtgattgagtatgttaattagcatataatgagatcctaggagaatcctaggtcaaatccagcgccatgttgggtccagtgggtcttagccagcttgatccacactatgggttttcagggtcatatcagcccctagtttctgcagctatttcaacagtttccttttgctagtcatgtgaaactgctgcctggaattttctgttctcctgtgaccatcctgtattagtcctatctaaccaccaccaccactgccaccaacaacagtaataattatcataataaatcattacaaatatggcccccttggttgggcatggtggctcctgcctgtgatcccagcactttgggagggggaggcaggaggatcactagagcccaggagttcaacaccagcctggcaatataaggagggcccttctctacaaaaaaactcaaaaaattagctgggcttagtggcttgggcttgtgatcccagctacttgggaggctgaggtagggggatactttgagccagggaggttgaggctgccctgagctgtgattgtgccactgcactccagcctcgatgacagagtgagagtctatttcaaaaacaaaacaacaacaacaaaaaaacccaacacaatcccgtcagttcttcctggatttcactcttgcccctttccctagagataaacaccatcccaaattagagttcattcccatgaaacttttaataccataactacatatacatgtacatattgttatgcatggtctcaaacagcataaaatgaaatcatactgtatacattcttctgcaatatgtttttgtctcttaacattatgtttttgagatttatccatgttgatatggtgagctctagtgcattaattttaactgcatggtagtctattgcatcactatatcagaagatgggaatattgatggaacatttaaattgcctacaattcttttatattgcaatataaaaatgctgcaatgaatattcctctcatgtctcattgtgcatatttgctagcatttctctagaatatgacaagaactggaatttccacattgatggggatgcttctcttcaaatcaactagaaattttgccatactgctctctgaaatgaatgcagaaattagcattcctttcagcaatgtacaagacttccttttgctccatattctcaccaacacttgctatagtaagactattccatttttctaattaagtgtgtctaaacagtatcttatactgcatgtgtgtttgtttcctgtctctactccaatgactgatgcagttaagcatcctcacttgtgcatctgcttccactttcatatgtcaataaaatataaaatatattttatctatttttttcagttggtttgtcttctttatgattggcaagagtttttttataattcctcaatacagactttttaaaaaatattacaagccatgaaaatatttcctataagtttatggttttttttttaacattggtgacatggtttggccctgtgtccccacccaaatctcatcttgtagcttccataattcccacgtgttgtgggagggacctggtgggagatgactgaatcatggggacaggtctttcccgtgctgttctcatgatagtgaataagtctcacaagatctgatggctttataaggtggagtttccctgcacaagctctctccttgcctgccaccatccacgtaagatgtgacttctcctccttcccttccaccatgattgtgaggcttccccagccacatggaactgtgagttctccattaaagagttccttcataaattgcccaggctagggtatgtctttatcaacaacgtgaaatggattaatacaattggttacagtaatttttattgcatagaagttttaaattttagtgaaatcaagtttaccaatatttttgtccaggatttatgcttattgaatcttttctataacgaagtcataaagttagatattctcctactttttttttcaaagttttgaaattttatttttcgtattatgatcttaaatctacatggaattagtgttcatggatggtatttaaaggtgtctcattttattctatttcatgtggacatttaattgtcccagaacaatgtattgaagagctcttccttttcacactgatttgtacgtaatatcacctatgttttatgcttccctatttttctcttctctgttatgcttcatttatctatttggccctcccaacaccacattgtcacaattattaggattttataatgacactaaatatctaccaggcaaggtctttcttggctctttgccctcctctatgaattttaaaatcagcttgtcaaattcaataaatatactatattagaactttatatcaatataatattatgttttttctgcctgtttgaggtttattttttccatttttcaatgtaagttatttcttcatttatctcttgatttccttattttttttttaagagagaagggcttgctctgtcacctaggctcgaatgcagtgatatgatcacagcccactgcagcctcaaactcctggatcctatggcctcagcctctggtgttgctaggactacagatgctcatcacaatgtgtacctaatttttaaattttctgtagtgacagggtcttgctatgttgcccacgctagtcttggactcctgggctcaagtaatccttctgccttgtcctcccaaagtcctgggattatagatgtgagtcactgcacccagcctgattgccctatttatatctagtgttgaatagactgtttcatgaggttaatagtctttaaattctgtcacctctttttaaacattatgtttcttcatgaatttgcactttggcttacaggccttctttaagaaggaggttattgtttatgagcaccacttctgataggttctgagttcagaatgaggtatcataacggtgtttgcattagggatgggtcagacacagtctctgaacctgaggcatcttggcttagtttttgatcttgggcatgtttaaaaataagagatgagaaactgccaggcatacaaactacacataactgcaggtagtttggtatagttgtagtctaggtgcataggttatagagatgcagagagggggtagaaaatgagaacaaagacataaggcaggagagatcataatgagctgatacatgagctaaggggcttaaacttcatcctgaagattacaaagagccattagaattttagccaagggggtgacatgatcagattgtatttttaaacatttacttaggcagtagtttacaggaataattatatgggagtcacattaggaggtgatttaggttatccaggtaaaatatgataaggacacaggagcagagggcatgcagaggagacgacaaatttaagagatgcagataattgctataatatagagaataagataaagaaaggaatctgagatgattcccagggtttttgcctggatgactatatccatagttgtggatgagggaacataaaaagaaagacaagtcagagaggaaatacaataaattccacccagaatgtgctgagtttcagatacttgtgcagttgtggtggccggtagtgtactgacacagatgctgggtacaatacacagcaccaaattggtgctcagacccacagagcacaaatacactttaatctgattcggtatttatttaactatgtgtaagaatacaaaaccaaagacacagaaaggcagcatctttcattgggaggcccagcagctaaccaagtacacagaagcttttgcttcatcattgatgtaagctgtgtaccactgccacggaagtgtgtagatgaggtctgtgagggtcaccttgacacaaagaagttgagcattgagttccaggtgctcttttatacctctctagtcatgcatgctctaggcctgcaagccaattcacagcttcccaaaccaggtatcatcgtgggttgggaaattaattagacacaactttccacgtttttcttactactgtagtcaccaagataagaatgaccttgaggtcattcttaggcaggccagcatcagctctggcctgatgttaccttttgcttacaaacaattcattttgtatatgggtttgaaatttatgagagaggccgggtacggtggcttacccctgaaatcccggcactttggaaggctgaggcgggtggatcacctgaggtcaggagttcgagaccagcctgatcaacatggtgaaaccccatctctactaaattaaaaaaaaaattagctgggcatgattgcacatgcctgtaatcccagctacttgggagactgaggcaggagaatcgcttgaacccgggaggtggtggttgcagtgagccgagatcgtgccattgcactgcagcctgggcaacgagagagagagaaagggcgaaggggagagagagagcgagagagagagagagagagagagagagagagaaagggagggagggagggagggaaggagggagagagggaggaaagaaggaagggagggagggagggagagagagatgtggaagaaatgcatgagagagatgtggaccaaagatagaaatatatgttttggggtcagagatttgggttcaacttcttgctggaccactcagcagttgtgtgactttggcaaggaagataagttcgtgtcttcatctttagtacagcgggcccctgtgaatattaactatggcaatgaataaaagggtgtttcatgcagggcagattttcaataagtgttggttcctgttttccagaggaagaaatattttgatatcaagtatgggagagagataaaaggcaataagacagtaaccaaacctcataaaggtaaaaaagtcaagttcaaaagtagtaggttgttttgtctgatgtacagaaaggagtatttagacaatgattgtttccttccccccaaaactatccaaataaagttaacttttttttcccaaaactcaggcaaacaaaataaataaataaataaataaataaataaataaataaaattccaaccagataagatgctagaaattaaaatgccttactctctgcatttgtctcaggccattgatcattttgcttttgttcaagacaaatgttgagcataaatattgagtaaaataacttttgtttcatttaggaactgatgagaaaatgctcatcagcattctgactgagaggtcaaatgcacagcggcagctgattgttaaggaatatcaagcagcatatggaaaggtaaggtcacattaacatgacaggcagtaaagagatcattaatgtaccatggtcgctcccacatggttatgcccacagtcttctgtttcaggctgagtgtaacagaagatgccctgtgcatccagtcaggagcctggaatctgagtcgtggttttgccttgaactagctgactggctttgggcatgttacttggtctttctgggcctcagtttcttcacctgtaggataaggtttgccttagcccagtgggttctaaaccagaagtgattttgctccccaggggacatttgggatgaatggagacattctgatgatcacaaacaggatggtggggagtacttctagcatgtagtaggcataggtcagggatgctacaagcatctgagaatgcgcaaggcagccctccacaacaaagaattactaaggaaactatctgactaattctgtcttaggtaaccttttatttctcttttaattttaaaatatttatgtagttataggtttaattcattcagcaaagaaaatttagtaattaccagaaactatataagaacaagtaactttgggaggctgaggcgggtggatcacctgagatcaggagtttgagaccagcctggccaacatggtgtaaccccatttctactaaaaatactgaaattagcctggtgtgatggcacatgcctgtaatctcagctactcgggaggctgagggctgaggcaggagaattgcttgaacccgggaggcggagtcttcagtgagccgagattgatccagcctggaaacagagcaagactccgtctcaaaaaacaaaataaaaaggaaaaagtaaaagtaagacttggtctttgctatacagtttatttgtccaatgtctatttctgagtactaatctgtgttaggagatatcctagacattggaaatagactggtataaaaagcacatcctgccttctttcatggagctaacattctattagaatataataaacaagtaaataaaaataattcagatatgataagtgatatgaaagaattaaaatggttgatatgatagacagtgactggtgactggctcctgcagatagagtgatgaaggaatgtcagtgaggggttgttacctcactccccactaagcctaaacaatactaggggttctgccctgcttgatcaggagatagtatttaaggtacagaaaatataaaagccctgaagcaaaaagaaactgggaatatgtgagaaataaagaattccaatatggcaggaatgtagaaagtgaagggggcagaagaaagagatgaggctggagacaggttgagaacatgctaagccttgggtcttggtagggtttagattttattctaagggctacagggaaccactggaggtttgtaagcagaggaataatatactgcagtttttatttttaaaggattattttggctgctgtagataatgaactgtggggggaaaaggtacaaacagacccggccaactgttgagagggtctagtgaccatccacaggcacctcaggaattacctcctgggagtgttctccaggcccccaggctccattaagacacccttctctgagctccctttatcagataacatattatattgaaattttatctttgaatatttctgtttttcccatgagggcagaatgccttaggataaggactttgtctaacttacctttaaaggactagcacagagcaggtgcccagaaaacatttgttgaattgagtgaattgcctagcttcagggcaagacaacactttcacatacagagaaggtgaatgatctattggccttttggtatttccaaaatatggaagaaagatggaggtggaggggaacaaccatttctcacagtggaataggatgagagctgtgaaataagattcagctgcagtggcttggattgaggacagatggtagtgaaatttaccatttagagaggaaaaaaacactgtggcaattaaagcagagttgataacactgaatgccaccccatttgtttcagcaggaacatgccactgctgcaccccccaggagtgtggttgtgtcaatctgtgcccacagcgtttcagcaggctcagaggctaccagcctctatttcagagctgaaaataatcaggagcaggaacaaacattattcagtattatgccattgaatattgaaaatagaaaccctgttacccccctttaagcaggggagatggactgtacttaggtgtgaaaacagtgctcaaaacaatatcaataggtaatgtctgtaagaggctaaattctagtgttccatcgccctgtaggataactatagttaacaataatatagtttcaaatagctagaaggaggatattgaatattcctaaaacaaaaaaatgttacatgtttgagatgatgggtatgcaattaccctgatctgattaccatacattatatgtattgaaacatcactatgtaccttatgaataagtacaattattatttgtcagaaaaaataagtctaatgtattgccacacttagggttttcttttctttacttgttgccagaaaattgcttctgatgccacctagttccacattctcaccagagacaaatgaccagccactgtcctcccttccccttcctcttggagctctttgggagttactgagaggcaagacaccgaggaagagagcacctcccactgaagctgggcgtgaatttataagggttcctcttcctcttcccttaccccaatctaagcattgaaagcatggcggatctaggaaatgcatttgaatacagttcctaactgtggcactcatggaatcctcccatttggctctccttcaaaaaacctctacaaaacagaacaatttgggagtaattagaaaatgcagattaatattcatagaaatattttcaacacttctgtttattccctgtggatggacatgttttgtctgattttgatacatatgttcatctttcactaggtgactttagagaaagagaaaaaaagtatttcacatttttccccttggttttttgattttaggagctgaaagatgacttgaagggtgatctctctggccactttgagcatctcatggtggccctagtgactccaccagcagtctttgatgcaaagcagctaaagaaatccatgaaggtatgagccccccacaagccatttctgcccagggtttgaccaagtcatcaaaaatagtgactttcttgcagtgcacacttgtgatgggtggacttggatgcccttttggtctggactctcccagtggtagaatgactctgaaataggcaacagctatagaaccttaagcccaaatgttcctgggctggaagaattttgtcatatcctttgtttgacatgaagagtcaagttctctaatttgtcatcgttgaaagtaaatagcactatgattaaccccaacactcaagctaaaaacctagcattatccttgagcccttgttttctcttacccttccaagctcccaaatctatcagcaagttccttagttttacttcaaaatccattataaatatgtgcacttctctcaaaatccattgctactgttctagtctgaccaccatcatctcttgactggtccatatcaataggcttctaactggtccctttgcctccatttttgcccatctcaaattcattctacacagaatagccaaaattatttttattaatttattttaaaaatcagattatgctacttacctgcataaatttccaatggctttgtacgcttaaaatccaagcttcttatcatgactttcatcacccaacatagtgcagctcctgtctaactctgtgactttttaaaattctatttatatcagtcagggttccctcagagaagcagaaccaataggcaggacatagactttaaaagatttattgtaaggccaggtgctgtggctcttgcctgtaatcccaatactttgggaggccaaggtaggtagattgcttgagctcaggagtttgaaatcagcctgggcaacttggagaaaccctgtctctacaaaaaataaaaaaaaaattagctgtgcatagtagtgcattcctgtagtcccagctacttgggaggctgtggtgggaggatcacctgagcccagaaggtcaaggctgcagtgagctgtgattgtgccactgcacttcagtctgggtgacagtgagaccctgtctcaaaacaacaacaacaaaaatttattggaaagaattggaggccatggtgggaggattgcttgggctcaggagttcaaaaccagcctcaaactgagcaacatagtgagaacttgtctctacaaaaaatttttaaaaattagccaggcatggtggctcatgcctgtagtcccagctatttgggaggctgaggtgggagaatcacttaagcccagcaggtctaggctacaatgagccatgaccgtgccactgcactccagcctgggatgctgtctcagaaaaaaaaaaaaaaagaagaagaagaagaagaaagaagaattggttacatgattatgggactggttaggcaagttcaaaatctgtagagcaggctgtcaggaaaggcaggctggaactcttgggcacaagctgaagctgctgtccacagaaagaatcttctaaacagaagccttgcctctggtcttaaggcgtttcaactgattggatcaggtctgccgagaaaggtaatctcccttacttaaagtgaatcgataataaactgaaattatatctacaaaataccttcacagcaacacctagattagtgtttgattgaataagtggcattatagcctggccaagttggcacataaaactgaccgtcataccccctcctgctcacccattaatgatgtagctacactggccttttctctgctccttgaacatcataagcttattcttgttttgagatctttatacatgatgtttcttccatctggaatgcttttcctccagacattttccattaattcactcaaatatattttcttaactgcacttattactgtctaaaagtatcttgtctatttatttgtttttgagacaaggtctcgcttcattgcccaggctctagtaaagtggtgcaattatggctcactgcagcctcaacctccctggcaagcctccaacttcagcctcctgagcagctgggactgcaggcacacaccaccacacctggctaattaaaattttttttttttgtagagacagggtcttgctatgtcacccagactggtctcaaactcctgagtcaagcaatcctcctgcctcggcctctcaaagtactggaattacaggtgtaagccactgcacctggccttttctatttttaaaatccatttgtttattatcttttttcatctaactaaaaggcaaacctccaccatggcagggaacctcattggtcttggcctatatcttctgttcctagagcaactcctgaaatgaagtgggtgctcaacgtattaattaataggaaggaggaaaaagaagggagcctagatctgaggcataagccatattctgccttgccatcagggaatggagttatcttcttttctgtggaggacatatgggcatctgagaagcagatggcaagatggaatttgatgtacaggagatttattttgagaaacacctgtgaaggataaagaggcgaagagcagggtaggtggggtgaaccttcagactgcagtggtggcctgacccctatgagaggagagaggagaggaagtaggctgagattaggaagagcctcagtgcatagtgaagctccgagaaaaccttggtaggctgttggggagcccctgagcaaagactgccctttggaggagttctgtgttgggcgcaagtccagtacccctgttgtttacagtcattgactgacagccacctggagagggcatgacctcagtgtgaactttggtagacccaaaggtgtggcagttggaggctgttagctaactgcgttctttgcagctgattctcttgaagtgaaatctgagcattgtttctctatggctacccaaaggggagggtttagcaggtgtaattgtaaggattagattcaccaataagtattagaacagtttctcttttacataaaagaaatccaggctgtggtggcaccaccattatcagagactcagtctccttctatcttgaggctctgccgtctttaactcatggttttcacttcctggctaaagaaggctcatgactcagccattatgtcttcattccaggcaactcaaaagagtaaaggacaaagaagggttcactccctcactctaaggatactccctgagcatacatatggtacttctgcatatatcccattggtcagagtttagtttctggacatatttcactgtaaaagaagctgagaaacatagcctttatatgggtagcaatgtaccaagttaaaagttgggggttccattactaagcaagaaagacaaaagagatactgtggtaaactaggaatctctgctacagagagacagaattcagtctctgttcatatgctgcactggccttattcaatcaagtcttagtgtatatgacttttcttggagtcacagtgtgattcagtgaccttgatataaacaggactgagaggtaattagtccccatgccagccaggcccatgatgcacattactgaggatttgaaaggctccctgtatgaagagaatgatacatgctgatagacccagtacagtgatgcaaggatgaaatcattcaaaagtattatagagccttttctaaacatagtggaatgtttgaatgttggtagggttaatcctgttagactgtcacttctaatcttgaatgacacaggctttttcttttatactatttctttccagaattattcaattgattttcacactagagtgaaaaatttgctgtcactttattccagatgatttatgttattactaaaatatatggaaaaatagaaaacgagagcaatagagaaccttgtattgatttacttaaaagtgtcctttcatctatataaacaagataataagaccaaaaggcatgagattaagttatttaagtgttctaaaaattagattttcttttcctttttagggcgcgggaacaaacgaagatgccttgattgaaatcttaactaccaggacaagcaggcaaatgaaggatatctctcaagcctattatacaggtgtcttattttctgcttaccttcaccactgttcacacatatttgagccaatgttgcttttcctagaatcctctcaatctcttcatgaggcattttgagaagacaagacttacagaaacgagaatacattctaaaatcagctaaagactatgagtttccaggaaaaattggaatatgatctgagctagagactgctacataacaatagcattaatgctttacatttataatattacagctgcagtggattttgctctcggcaatctctcattaattgaattaaccattgtcatcaatgtaagagactcaaatcgtattttatttttaggcgttagaaatcactcagattagatccacgattttgggtgtgggaaattagattaatttagaggatgtgttgagcataaggattcaatagaagtagctaaagacctaatagtctgctggctgtgtaaaattagaaagactctgaaatgtaattctgactgtaactacccagggttagtgtgacttcacaggttaaggtcacagtccccacaagactaccttcacctcagacaccagcccacaagctcaggtgttttcaggctacacgtgcttttaaccagctggctacaaattcagggttctcactaccctctcaggttgaatagcacactagaatgacacagaactcaagaaagtgctgtgttcacaaatgcgatattatcataaaggaaacaaatcagggccaatccaatgtggagactgcatatggagatatttggaagggtccagtggaagcttccactctcctgaccattgatatatcattaccaaccagcaagctcacttgattattggtagccttagtttttattggggttttgttatataagcatgattggttgaaccattgttcatgtgattgaaccagtccacctacactccccagaggtcaggctgatattgtggctcaaagcctcaaccttttaatcatatggttgatctttctgatgtgaccagcctttattctgggtcatattgttagcataactgagctgtagtccaagagaccaaccatgaataacaaggacacacctatgacttgggaaatccaaagaatttagagtttacctcccaggaatcaggaataagaccagcccaattctctactattcaatggccccatagaaccctctccaagtactttaagggagccacagtttctctgtttgtgtctcacagaggtcagttgtgtcatagcagcttttgcagtgggagaggtccaaagaaggagtacatattggtcctcatgtaggtgttaaagaggatgctttgggagattcttgttagaaggtaaatacctcaatgtcaggtgactgttttgttattgatgtactaattgggttctaatcagaaaaacagaaacagcactaggtattttgacagatagaatgtaatataaagaactgcttaaagggccgggtgtggtgactcacgcctgtaatcacagcacttggggaggctgaggtcagcggatcacaaggtcaggagttcgagaccagcctggccaatatggtgaaatcccatctctactaaaaaatacaaaaaaagttagatggtcatggtggcgtgcacctgtagtcccagctactcaggaggctgaggcaggagaattgcttgaacccaggaggcagaggttacagtgagccgagatggtgccactgcactccagcctgggcaacagaatgagattccatctcaaaagaattgcttaagctgggcacagtggctcatgcctgtaatcctggcattttgggaggctgaggtgggcagattgcgtgagccaaggagtttaagaccagcccaggcaacatgacaaaacccagtctctataaaaaataccaaaaattggccaggtgtggtggtgcacgcctacagtcccagctcctcaggaggctcaagtgggaggatcacttgagtctaagagattgaggccacagtaagccttgatcatgccactgcactccagcctgcgtgacagagtgagaccttgtcttggaaaaaaaagaagaattgctaaacacctttcagaggactgaaaaagcaaaaagggaacaaaaggattcatgcaggttataaccccccagacctgagacaacaaaggaaagaggttgaggctatcagaaactggaagctagaatgagggacatacctggctgatgtcgggacctcaggggctcagagcagaggcttaaggagcaggagttcagatctctgaaaagagggctccatctgtaggtactggagccagtacctacacgggggtcaaagtgactttttctaggaagctggagccagttgctgctgtcggggtgaacagccttccctgggttgacactgacatgactagccgtcagatagcttgcacttctttccacctcctgccttccagtcccctctactccccagtactggtggaacctaatagggagcgggtacagacagaagtagacaagagaattgcttaatcattaatgcacaaaagagtatgttttaggtgtttaaaatatttcagttcaacaaggtttacatattttacaaaacccatcagaaccaggcactgtttcccaagttggcttggtattttctggtgtttcttagaagagccactgctccccaagtggacctgccctgtgacagatccctggagcccagcatttaggtacaaacagttccaggatgtgagctttatgaggatgaggattttcgtctatgttgttcactgctgtatcctcagttctaagaacagtggggcagataagtgcaaatatttattaaatgagtgtcctcaaaattgaggttaaggtcttaagagccaagtgaaacttttaccattcaggatagtgttgtgcagatatgacagatgataatagcacaaagttaccagagcctcaatttctatgtgagtaatgctctctgaggctacaaaggatacaactgcatcaaggttaccttggttactagagattaatgatacacaagaagatcaagaaggaaattgtctcaatcatgcatagccaaactttacagagattaaagtcacagcactacccgagggacccagttatgttgtcactctctcggcagcaggcatccattgctccccatgctaatgttttccgtgacagtaactgctcctcttcctttttgcttctaatgttcttgacaccagcaagtaacatcccctcccctaccacatggtgtttgtctacccaaggcttataaatatttgtgcatagcttttggttattcttggctactgttttcttcattatttccaggagtcttttggttctttgttattctattgtctttgtctccttttctgtgtcactcgctccctaagagagaagatacaatgggttcaggaagtcactatcatgttggccctcataaagggaccagatgtcttctacagcttattcagtacagtggcacaatagagtctaaataaagagagatctaaattcttaacttttttcggtattctaaagtcaatggtgtgtgagagagagaacactgaaacagggatcagggactcaaagttctagtccaggcacctgtactattaaaatattctatttgattttatactctactgtgcctcaaaatggataaagtagttgtcaacttaggttgaaataattttttactctaatatcccacaaaatatttgaaggaaagggagaggctgtgtgaaatgacttataaagtctcatctaaataattccaaaattacaaaatacttccccaagttctaagaaatgggatattcattcttctacttgatattttcaaatttaaagttttttatctaactagaatgaaggatagatgtaacaatatcacaaccattaggtttaatgatgcctactaaatattattatttagaaaaataacacacttttttggtggattttgcttatatgaattgctttgaaaagttacagatttcataaaaaagagacttactaaaatcatgctgaagaagtttccatctcagcgcagttcttgctattggataatctcatatcactttctataattgtctttcattgatttaaatagatgagaattctcatggctagtatggctaatttatagaattcttgagaatggtgcagacagttcagatagccacatggtgtcacctacaacaaagggtatagtggctccaagagaatcaccaccccatggatggggcagacagagatttaagactgatgggcactgcacatcacaggccatgcaaaaggggctacaactagtcagtactaaaatatatgaacacacagttggcatttgtaaagggaaatggcatgttttgggtagctttcttacttttgggagatacgaaaaaatatggtttaattatattcattaagattagggttagattcgataaaacagaaaaattacagtggcttacaaaaggtagaagtttatttctatcatatgtagaagtctagacattggcaattctaagtctagtatgacagctactcaaagcttttaggaactcagacttcttcttgattacttttatgccatcactaagaagtggtccttatcttcacagtccaagatggctgcccaagatgcagatatcagttcacatgtaaggcagttggatggaggaaggactaagatgaacatggcctcatccctttaaggagatttgtctgccttcatttcattgtgaataactaagttatagaactgtactagctaagaggaaagctgagaaagtagtttttaagctgtgtacattatatcttgcttaaggttagggttctcttagtatggaagatggccagaatggaaattgaaaggcacactagtagctcatccaccccagcttttccactatgcatcccttagtgccattgtcagatgaaataaaccaagatttgctccagaatgacaactctttctattcttttgcatctaccacaacacagtgcagtaagagttacaagaagaatgtaccatctcacaacagaaaagcatgaagaaattaaataaaagggcaagatttatcttatcacatacccattctttgctagtgttggcatttaaacttttctctgttttataatcatatttttcagtttgtcaaggcttaatttcattctgatttggtttcagtatacaagaagagtcttggagatgacattagttccgaaacatctggtgacttccggaaagctctgttgactttggcagatgtaaggttttattttttattttttaactccccagtaagctgcatgctcaataacaatttttagggagtttaaaaataaccaaactgagacaatgagttcacaattttccttatgaaatggtttgttcattttacattttcattgccaccaagcaatataatgtttaaccaagatcataaaagcatacataatgatgtaacaacaaagaaaacttatttgagtcagtaagtggaggtgttttggtcaggtttcacaattttgacattagaagacattctgatacatcatctgacatacaatatttatttccattataagtgtctccattttaaagaacaggtttattttcttctggactctgaagaataaatatttcttttgttagcttctaaattaaataggaagcatgatacagaagaatgatctttagagatgggaattaaattgagtatcagtctcaggattaaaaaaaagaaaatgattgctgcaatttcagccttgccaccttggaaaagctgccaaactattaatcatcatgtgacctaatgaggccacaccttgctttctctttttagaaggcttatgacttttattataaagatggtaaggtcaaggatgaggtgtattcacagctgtgtgtaagagagaacgtgatttaaaccatagctcaccaattttctttcagctgatttacatagcacctaaatgtgagaaaatcccaacaacggtctcagcctcatggttgaaacagcacctgtcaaagtgaggcattatgccattaggaagcgatttatctaaattatggtttcagttactttaaatgtgaaaaacttatgaaggttgaacccacaacaccaaatttatgaagcattgctgcaaacatatgctctcagaggtatatattcctaagtgcacatctgtttgtgtatggacatgaatgcacccacccacaggaggcagtatagagtagggctctaggacagggttctagaatcaaacagggctggaatctcatgctgccaactagctttgtatatttggacaagttctttaagtcttaaagcattcattttcatatctgtaaaactaaaatactaacaataacaagtactcatagggtgttatgaagattaagagaaagagagagtatgtgaagtacttagtgatcaacacagggtggtagtggttagtattatattaagaccgatgataatcagcatttatgtcattggagcgagcgtaagtgaaagagaacaagaagaaagcaaacagcagcagggtatcagcagcacagaaaagaaaccaggcaaaaatcagacagtcatacaaggacctaatgtttaaaaataggaacaaattcattttaaactattgtagctaaatgtttcattcacctataatttgccaaataattcaggcaatcccgtgttttggttttgtctcctgtctttccataatgtgcttaagtatttgtacatgaacacacataccacacacacacacacacacacacacacacacacacacacacacaccacttaaaccatagagcctttaatatcacagttggggatctttgaggactttttattttttcttttttgagacagagtctcactctgtcatccagactggagtgctgtggtgcgatctcggctcactgcaacctctgcctcccaggttcaagcaattctcctgcctcagcctccctagcagctgggattacaggcacacgccaccacacccggctaatttttgtattttagtagagacagggtttcatcatgttggctaggatggtctcaaactcctgacctcaatcaatccacccgcctcagcctcccaaagtgctgggattacaggcgtgagccactgcgccccgcctttgagttttttttttttttaaataaactttactttttagagcagcttcagatttatggaaaaattgagcagaaagtacagagagctcccatatgaccctattctactctctcctttcctttccattattattattattattattattattttgagacaggatctggctctgttgcccaggcttgagaactatggtgtgatcttagctcactgtagtctcgacctcctgggcccaagcagacctcccacttcagcctcctgagtaactgggaccacaggtgtacaccaccacattcagctaattttttttttttttttttttttttttagagcgagagaaggtctcactcttgcattaattagtatgtgtatttattataattggtgaatgaatattgatacattattattaactgaagtttatagtttacattagggttcactctttctgtgatatagttctatggattttaataaatgtataatgtcatatgtctatcattacagtatgatagagtagtttcactgtcctaaaaatcctctgtgctctgccagttcataccttcctccccaccaactactgatcttcttactgtctctatagttttgccatctctagaatgtcctatagttggaatcatacagtacgtagccatttcaggcaggctggcttctttcacttagctatatgcctttaaggttcctctatgtcttttcatggcttgatagctcatttctttttagtactgagtagtattccattgtatagaatatttattttacctgctgaaaggcatcttctttgcttccaagtttggcaattataaataaaacttctgtaaacattcatgtgcagatttttgtatggacatgttttcaactcctttagttaaatagcgaggggtgcaattgcttgattatatagtaagagatatttagctttattaaaaaactgcagaactgtcttccaaagtgactgtaccattttgctttcatatcagcagtgaatgagagttcctgttgctccacattctcaccagtatttggtgttgtcagtgttttggatttaagcccttctaataggttgtgtagtggcatcttattgttttaatttgtaattatctaatgacatacaatgttgagaatcttttcatgtgccatctgtgcgtcttctttggtgagatgtctgttgagatctttcaaccatttttaaattgggttgttattttcatattgagttttaagagttctttatgtattttggatacaagttctttatcagatacatgttacaaatatgttctcccagtttgtaccttgtcttttcttccacataagacctctgtgttgggttgggcacagtggcccacacttgtattcccagagattcaggaggctgaggtgggaggacagcttgaggccaggagtttgagaccagcctgggcaacatagcgagatcccatctctaaaaaaaatttttaaattagctgtgtgtggtggtgtgcacctgtagtcatattagctattcaggaggctgaagcgggaagatggcttgagccttggagttcaaggttatagtgagctatgactgcaggactacactctggcctggccaacagagagtgagaacctgtctctaaatatatatatatatgaattttcggaggagggaactgaggcccccaaaattgtgtgatttgctaaaaatttcatgactagtcaatggcagaaccagaactggagccctgagtacatgatttttctgtgcaacctgtcctgccttaaagaaaaaccactaagatcccctgctggttgaagtactatgtgttagaatcttctatctttaaaggatggcccttgttttcgtcctcctgtttagggcagaagagatgaaagtctgaaagtggatgagcatctggccaaacaagatgcccaggtcagtaacaaagcgggaaaacatttcctttacctattctcctatgtggctgcctttgcatttatgtgaaaagggagaaaaatagcagcaacagggacttttctttttttttttttcctgtttgaaagagaagcctgaagcttggggatcggaaccctaactttttgcctgccccagtggtagttatcattctccttggctcctgacagcccaatttttgatttctagtcttctgaaagtgagagatttagataatagatgatggcactgacctctgaaatacaactccgattcttctcatgtcacctctcaaaaagaaaataattgtgtctctaatatcattctcttgtgaatagattctctataaagctggtgagaacagatggggcacggatgaagacaaattcactgagatcctgtgtttaaggagctttcctcaattaaaactaagtacaaactcacattacaatcctttgtgttgtatgttgtttttacaaatgtttttgcatttagtatacaaagatctagaaaaacgaagtttaaaattgcgaagtctgttccagttattcacacttcaggaaacaaaatgggaaagctgtattgtaactcaaggaagtactgacactacacttttgtttttccatagaggctgagtagattacctagtgagtaccaggtaatagatgggggagggaggtggcagggagaagaaaagaggccaccctctagggtgagagtagaagggcttgttcctgtggaatggagaagcccaactgcttccactccacctaacagttctccctagttagccacttccagaaaagccagacactgcaggtgagtctctgttgacacatcaatactgattaacctttagctatttctgatatgaaggtaagtggtagaatggatcaactcttatcgtcagaccagctattacatggaattgtgggcacccgccctcttgctcatggcatctcctagaactgttctggaagcaacaacacctagaaaactaaaccttcatttactgtgaacatcttctgactgtggcttccagatgctagtttacagaacaaccacacagcaagaccaagcttatgctgagttgacggaacaatgagtaaacataaggatattactgtgactttgaaattctgaaattgttctttcttaacttttgcattaaaatcacatttattttataaaataatgacaacagtatgtgatagttgctttattcatgtctttgtttgaaaaacaaaaaccagataaccctaggtctctctccaaaatttctttttttaaaaatgtattggggaaaaatatacttggcttacaaaatatgcctgtatacttggtgacatatgtacaggttttgcttggggcaaatactgatcaagaaattcaaatgccttctgggaggtgtgaagtaggccatgccaccttaggaaatgattcagcacaaggaagtcttcagaattaagatttctttaccagagaaaacatatttgactagtgattatagtatcatttcccaggtgctgctataaataaaatttaaaatagcccaacttactggataaattatttattatttaactatttaggctatttaaaatgcttactgcttgagagaaggggaaagagaaagagagatcattgaagaaaatcatctagggagtttgggttttgttgtagatgatttccttaaaaaggaacaaaagaaaaacaaaaacttctgtgcccagattttcatggtttaaagagggagttttttagcttgctacttgatcttctgcatatcaaataaaaaactagaatatattcaaatgtgctcaactgcgttgctttaaataattttgtggtgcttctttttagcatttgatgaatacagaaatatcagccaaaaggacattgtggacagcataaaaggagaattatctgggcattttgaagacttactgttggccataggtaagacttcgagtgctggtaaactaagttactttgcacttgctttaactcagtgccgaggcctgctccttttgggcaagaatcctgactgatccattttttttgctccctacagcccccaacatggtccaggatacacacagtacgctcaacaaatattgttaaatgaatgcttgaagaagttatttttttaagtcttttttctttttcttttttgaaacaggatctcactctgtcacccaggctggagtgcagtggtgtgatctcagctcactgcagcctcaacctcctgggctcaagcagtcctcccacctcagcctcccaagtagctgagacaacaagcatgtataccacctggcccagctaattttgtattttttgtagagatggggtttcaccatgttgcccaggctggtcgtgaactcctgagctcaagcaatccatccacctcagcctcccaaagtgttgggattacaggtgtgagctaccacatccagccatctttttaaatcttaccttgctttttaaatttgtatttgtcttgtgaccatgtttagcttgtagacttcttgagagctgaaatattttatttctactggcatttttattgagctttgttgaaaactgagacgtaggcaaagcacagtggcatgcacgtgtagtcttacctacttgggaggctgaggtggaaggattgctggagccaaggagttcaaggccagtttgggcaacatagcaagatcttgtctctttaattaaaaaaaccacacacacacacacacacacacacacatgcaactaagacctaagccagtttggtaatccaccatatttggttatttatgaaagatatcagtggcttttcttttctttctttcttttttttttttcttttgagatggagtctcactctgtcacccagactagagtgcagtggcacaatctcagctcattgttgactctgaattgctaaaagataagccgaggaggctaagaaagggaaaactttcttcttcaattaaaaaagtagaattgagatcagtcttcataattagttctcagactgttccagtggtaatgatacacctggttaatttttttttccattttacattgttaatctttttttctttttttttctttgtgacggagtctcgctcggttgcccaagctggagtgtggtggcgcaatctcaggtcactgcaacctccgccttccaggttcaagcaattcttgtgcctcagcctcctaagtagctgggattacaggcacacgccaccacgcctggctaacgtttgtatttttagtagagacagggtttcaccatgttggccggggtggtctcaaattcctgacctcaagtgatccgcccacctctgcctcccaaagtgctgggattacaggcttgagccaccacccctggcctatattgttaatctttatattaattctgcttgctgtttttcatttggtgttcttgctaagccgtaatgtttgaaaaactttgttgagatgtacaaactctcattcactgagctaaggagcattcttggaaatatatcattgaataatgtattacatttgggctataatgcacattattttatcatgtaaaaaaagaccttataattcaattgaagttcaaaatatgttacactttcattttgtttcagtctaccattggaataaaccagtttataaaattttttattgagatataacttacataccataaagttcacccactcaaagtgtgcaattcaatgctttttaatgtagtcacaaggttttgcaaccatcaccacaatctaagtttaggacgttttaatcagccgcataagaaaccctgtaactattgacagtcactttccaatcctccccaccccctggctcctataatcattaatctactttctgtctctatagatttgcctactctgcatatttcatacacaaggaatccaatacaatggtcaacacatagtttttgacatgaaaaacgatctgagctgtgtcatcttagaatcgtgtaataggagcatactacttgccaaataagaacaaatccagacttaagtaaggagaggctttattcagtagaactatttcaatagagagaacatgttgatttcagaaacctgaaagactgggctgggtgtggtggctcatgcacataatcccatcactttgagaggctgaggcaggaggatccctttaggccaggagttcaagaccagcctgggcaacatagtgagagcagcattctgagactgttccaatggcaatgatagaactggttaattttttttccattttatattgttaatctatatattaaagattctacaaaaaaataaaaaattagctgggtaggttggtggacgcctgtagtcccagctactcaaggggctaaggtgggaggagtgcttgaacccaggaggtcgaggctccagtgagctatgttggtgccactacaccagagcctgagtgacaaaagtgagatcccatctctaaaagatggggaaaaatgtgcaaaagtttcaaaatccaacagaaaagtcttagcagcaacttttaatgttgggcaagcacaagggcatgatcactggggattgacaggaaacacgtctggcagtggacagctggactctcaagataagctgcaacagaggcatgttctgcattttagggcttgcccaggactggggacaagccagagttcaggaacctgtgggaggagagaggcctgatggaagtgtggtcaagacaatgaagagggtagggaatgggcaattatgaattcttggtcatggtaattaactctaacggactcccaagcttccctgcctatggtgctgggtgataaagcctccttcccactgaaacatactgccaccttccaaaactttcagatatgaagaacaaatctagtaggtaagaatataaagcagaaggcaagctaaagggaagaaaggatcatgaaaagaagggattgtacaaatctagttggcagggaggtgactggaaagcttaataggatgaaagtgggcatcattattttttatcaagctattatggcttacttaatgtgagttttactagtttaaatggttagtttcttgtcagagaacttcatgtaacagtttgattctaaatgctgtgtttgggtttctaatacatttctccttctatttcccttaaatcactcaaaaagccaaaagtcttttagctttccttaagacagtctataagccacgatgagaaagtcacttattcttgttctgagctccaaaattcattataaaatccattcacttttggttggattcctacctagagatcagatttaagattataaaaataattgtgttgctgtaaataggtttcttccctacagacttttctattcctattttctttttatttaaaagataatttactcttgcgtttttgtcagtttcctttttcttgttttatttctgctttacttgttatttcaaaataaagaattgaaggattgtattttttttttaaggcaactgaatttagatgacagatacttgttctaatggagtcactctaaccagcctataaattctaatccagtcatttaaaagaaaattctttccatgggaaaaattgcttttaaatggaactccagtgcccctgcgtgcctaatgagttatttggagcaacatcgctgcagttgtcaggcccaggttgttcatcagtagcccgagatgctagtagctgagcagtgtcgcaccctagggagttatcagggaaagcgtaggtgttcggggtgtctgggatccagagatgagtcagtcgctgtgggagtttctttggcaggtaattttattttccccatggctggagataattactgtgctaaagttctgtgcaaatatggtattaaaaggctatgaaaatcagggtaagcagcctttctttcattccaagtaaaagccagttgtggggaggggatagagtggtatgacagtccaaagaatctttttaaaaaacatattacttactatagattaacccaatttctattccgtgaagctgaacattatttgctttttgttacagttaattgtgtgaggaacacgccggcctttttagccgaaagactgcatcgagccttgaaggttggtctggaaagttcatgtgcattcttagcgtcccttaattcccttgggaaagtatgcaaatagtagaacaaatatttaaaaattagttattttaatgtaatttaaacattttaagataaattatattacagcaaatcaaggtatgatacaatacactctttacacagacacctgattttctcttcaaaataaacagacctgggtttatgaaataatttttttctaagtaggtataatttgatttctatttaactaaaacattctcattttctctaatatgatgagtttaagtagatgctaatattccacttgtatgaaagatgaaaattcatgtataatattaaattttaaaagttcatcctctattttaaatagaaaatgagaaggcaggccaggcgcggtggctcacgcctgtaatcccagcattttaggaggcccaggcgggtggatcacaaggtcaggagttcaagaccagcctggccagacggtgaaaccctgtctctactaaaaatacaaaaattagccgggcgtggtagcagatgcactgtaatcccagctactcgcgaggctgaggcagagaattgcttgaacccaggaggcagaggttgcagtgagcctagattgcgccactgcactccagtctgggcgacagagtgagactctgtctcaaaaaaaaaaaaaaaaaaagaaaatgagaaggtaaaaatatggcttaatgttgatagaatgtcatatttcttttccacttagattagttttctacagtagctaatttgtctactgatttgcctcataggttaatagtattctaacccatatagagataggtacagagaagtattgaccacattattttcactgcttcacagtaagtgcaggcagtaaaacttgttttagaatgccaaacctcaagcttgagacccagtagatcctgtggcctctcaaactgccttgcttaaaataaaccaagctgagttggcagcctttaatgatgccgtaaccctgtgtttgcttgtctgtctttactgccagatggtgcgctccatgagtacagactcctgtttatcctcagaccctagggccttgtgcacagaagatgcttacctccatctctttaccagccattttctgtggtcccacacgtaccttcaaagtcatatcctaagtgaacacatcctttccttcatctcgcccagccccacatctgctccccttcccctgttcagtcatcccagagaatggccccaacaggaatttgcccaactctctgaagtcgtaccattcctccccagacttcttgactatgcctcagccaccccaggcttctttccattcctcaactgtggcaagtctattctcacatcacagtctttgcatccattccttctctggaatgctcatcctctagatctttacctagctgactccttctcatctttcaggtttcagctctcctcctgagagaggtctcccctaactgtaccaggccaattggttccctttcagtcactctccatgccatttccagctttcttttcttcatatttctgatcactatttacttaagcaatagttaatttgctttgctgtctgtctccatctactagaacataagctccatgcagacagagatataatctgttctgttcaccgccattggcacagcacatggaataatgcctggctatagtcgatgctcataagcatttgctggatgaattacatagatgaatggaatatcatttagtatgttggccatcattaggtcaaaatccacctaactgctcagctagaaattttacactatctctctttttcattatcctgtagcgatacatcattatgttttgtcaatccatttacataagcaactctcaaatcttcccattttctccatccctactgcctttattctaaggatggccatcatcatctcttaattactcagtctcctcaagatgagtctcaaagcctctagtcttaactcccttatcttccttctactcctaccttgcaatctgtttctcatgctgcagtcaaagtgattttctgaaaccacgaatttgatctgatctcaacattctcatgtttaaaatattacaagagctctccacacttaggataaagtcagaatttcatttcatggttaacaaggtctggcctttccagacacatttctttttatccctctttgttaacttacgtatccttgaacgtggcgttctttattgccctaaaccttcacgcctgctatttcctctataggaagtttctctcctccctacatgaacctactccttcctcttgttgactgtttagtccttgcttaaatgtcactttctcagacttttcctaatccctaatctttcttaggcccccctgaagtatgctcccatggtacccaatattttcaacatgtcagactgttttgcaatggcttactttcttgcctgtattctttacaaaactggaagcttaacatgggtatctcatctctgctttgcagcatttagcatgatgctgtcacagagtaggtgctcaacaaatatttcttgaataatgaatgatgagtttgataataaatgaaaaagaatcactatagttgaatattttgcacaccattatctgattcttataaatatagatctctatgttgctttgtgaccaatgacatttgtgttgtgaacacctgcattccttaacagggtattggaactgatgagtttactctgaaccgaataatggtgtccagatcagaaattgaccttttggacattcgaacagagttcaagaagcattatggctattccctatattcagcaattaaagtaagtctacttttaaaaatagcaaaacatattttgcccttctctacccatctccttactcttatatgccttaaaatataaagatatttgacttagatttctctctccttgtcaatgtataaatgtgttgtctgagcttaaaatagtagcagcaaaatatcccttattttcagctctaaaatcccaggcatataatagacactcaatatttttttaggtgtactagccactaatttttcttcttttgtgaattacatatgcaagttgtttacctgttttttatattgcactgtttttatttatttcagtctttatgacaatgtaagaaaagaaaaatacgtattttaaatttcctctctgttttacatgagacagcatggttctgcagcttagagtgcttttcatttcagtatataggaaactttctcattttatttaacagctgtatatcattccattgtttgtatatttgtacccaccacaacaaacagaggcttccagtttattgctattgcaaacaatgttgtataatgcatacacaacttcatcaggtacgagtgtatctttgggatgaattctcagaagtaggatttctgagacagatataaatgcattttaaattttgacaaatattactaattgaattccattttgcaattccatgaggaatgtatgagaacttctttctccatagctttggcacagagggtattttcaaacttttaggtttttaaaacattttttagagatggggtcttgctgtgttgcccaggctgaagtgctgtggctgttcacaggtgcgatcataatacattgtagcctagaactcctgggctcgagcagtcctcttgccttagcctccaagtagctgggactataggtaaacttttgggttttcataatctgataggtgaggaattgtatctcagtgtagttgtaatatacatttttcttagtataagtaaggctgaatatattttcatgtttgaaataacatttgtatttctctttctgtgatctgtctttttacattctttgtccacattcttttgggtttttgttctttttggtcagtttctaagacgtttttcacataaggtagattagccttttgtctggtcatattttcccagtccgttctttgtcctttgacttggccaaaagtatttttttccaagcagaggttgcacatcttatttaattaaatttatcaatctttcacagtattttagtttttaaaaaatctggtcccttctgtttctttcattctggatgagaatcttcctaaaatgggctccttcctttctcttttaaagcatgaaacccattttcattgttttcagatctcagttgatatattatacatagaaacttcaaataaattacaaattatttgaattaatagggcagtaagcctgacaaaaattgtacaagaggcttctgtaccttaagctcatggttcaaaagtcatagtcccaacaggaagatggcaactagttagtggagaactaaggggctagccccacacctgctcagtagccttccattgatttacttttctaccttgatgctccagaccacatatgaaagtctctagtaaatgagtgatagagagtgttagtccaagctggttccctggaacaaagtggaagctggggttggtgagtggagcaatccactgtccttgcctccaaggccacactgaccaggggaaaagacagagtcagggctgccttcgcagaggacttgcaggctatgcagacctctccgtctctttgctactccatctacccttgaatgtctcgaggaaatcagcactagagagtattggacccaggtgaactctccaaggtctaagctgagacttggggcctagaaggtgatccaggatgaagagggaagcagcagccaagcagagtgtttgctctgagtgctgagggtctaaaactgggaatggagtccatgctgattagaccccctaagctgtggatcattatgcaccatgcacatcctgatcctgggtagcagcaccctctctcaagcccctacaaggctggagcactacctctgtgggggagcttacactcagcgatgtcccctggggacacctggcttagaccacattccagtgtccctgccagcagctggagtctttggtccaaccttcgctatggccctacccacaatagccacccttgaacaggcacaaatattagcctgggtctttctgcagctatcttgggaaggtttctgcctctgactttacaaatggcctttgaatgaatgaatgaatgaatgaacatcaatcagtcaactagattcattcactaaaatctctctctctctctttttaatcagagtttttgtttttgcactaaacttttacagaaagagagctgagatgcatgcataagttgaaatcaggaacttactcaaaaaggcaattctcagactgtgcctgggacttagcacaaattgcatcaactgctcacactcaattctatttgaatcagtcctgacacatcacaatagtttcaatcatcagaggaagattcaataacattaaccatgttgtagctactaaggcagaaaaatagactcacacattttctaaagattgtcagtaacaaggttgagacataaagagggctttcagttcaccctcagcaaaccagaaaattaaattaaccagtggctctccgttccccagtggtctgggtaattgaggcttattgtattagaaaacatttaaactatttgtagtttgatagaaaagaaaaatccatcactgaaaacttcagtttgcagtttgaaatagtacaagatttctttatttctaccacctaacacatattattaagtaatctcattacatttttgctattgaagaacaggatctttttagatggttgtttctgaaattcatgggatagagttccattttgcatatcatctcagcctgtcatcctgcctgttttcttccttccacctattgtttagacatttctttgtccattgacacctttctcagggggtaaccggtgggaaggagaaggcaaggaagaacagaggtgaaaaaccaatgtgtacctcttactactttataagaagatattatggaaaatttagatgaaattatattttttggtagttttccttcatagacaaattctgtatttatttaataaatagcacaattccaagctttttatgggaaaatatagtagccactcacaatcaactcataatctatgtggagacttgaggtaggtatgaagaaacaattagaagataataattgaaacaacagacaattaaatactagattgttgaatatagagctagtactatcggaattgagaagaaaagaagtttggggttagagaaatgggtcttgagcctgcctttcaggtcaacaagcatgtgttgagtgtctcctgtgggccaggtgctctgctggagcatttacctttaagaccccagatcaatagggtcttaaaagtaaatgctctagagacagatatgggaagaagcaagagggaaagaagtaataaggcatttgtttgattagagggtctaccttggggaatattgagaaataaaatccaagtagcaagatgagttcagttgaaagagagctttgagatcagcgaattcactcattcaattaaaaatattatcaaatgcatattatgtgctaggctcagggttacaattataagcaaagggggtagggtgggggaagacattttctgcccttatggaattacaactatgttaaatgtaaaggaaagtgacattgtgctaaaagatcctacaatagtaggacttgacttagaggaaaggcttctatgagaaagtcatgattcagatctggaaaataagtagatattaataaggcaaaatgtatggaggtaagggagccagtagaacattctaataaaagaaatgacaaatggaaaggcctcatggtggaggaagcataatgaaaaatgaggatgtgggggccagatcatgcaggacctttttggcaatgtttaaggaattttggctttagcttaagagtaaggggaagccattgaagagttctgggcatgagctcttgaagagttagtatcaggatcatgaaaagatccctgtaagatcttcttattctggagaataagaagggctcaaaagatatttaggagttgaaacttaagggacttggtataatatcttggtgtgaggaaaggaagatagcaaggatgacactcaagttcctaacttggaaaacagacagtggcgccattccttgcaagaggatcaggttttaggttgtttgtttgtttgtttgtttccttttcttttgggggagtggggggaggtttatgagtttggttttacatgtattgagtttgagatgtctttgagccatgtaagacatgtggagaggtcaagtaagtcattagcggtgtaaatatactttgagttacttggatgtattttcttgactaactggtagaacgcctaattgtttacaactctgatcagagatgtctagaaggagctcttttaatacaaagctggagcattgttgacttgtcagctctgctattgcagagcaagacaggaaaaccaatagcataagaactaaaatctatataaaaacgaagaatattgtcatatattttgtgaaacagacaaatgaacaagaaataaagaaaacagaaaaatatatataaaggcctattgtgtcttactatgaaagtaatgcttaacttcttcactaaatgagccttctctgagacttcctttatattaccactttctctaatattcaccccagtaacagccattccaaatgtgaaacttaagtgataagaagagctcactggttgggttacctcaaataaaataaaaataatgtgagcatcttacacaatccaggttgaaagccaagttttacctcctgtgaagtcttttgcgttacaaacttggtatctttgccctttaagcctcaacctcacgtagtatcttttctggacaacagtctatttttggttggccttgggaaaaggaactgataaacatattctttaaaaatgtggttcatttcactttcctaagttaggcagtgtagcagggtattaaggagccaggatatagggattcaaatcctgcttttgtcacttattctcgataagatttgaggcaagtttcctaacctgtctttctcattttacttatctgttaaatgggggatacgtatagtacctattgcagagagcttttaaaagggttaaagtagttaatacacattaagccttttgaatagcaagtgttcgataaatattattaaaactaaaatttgaagtttttatagaaatcaatattatgtaagtgatgcaatcttattttattaaaccaaaattgaaatttaactgcagtatatcaggaagaatctaaatattacttacagtgaagaagatgctggtcagaacgtaattacactcaggtatgaatgaatgatggaattgcaggtatgttttactaaatggtatagctcatgagtctcacacccaggtgaattccctagtgctataggatttgattcatttatggtctcccattatttatactgtatttgttcttcattgattttattctttgcagtcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctaatccattaaatataaagcaagataataaaaattgttgcttttgttaaaagtaatttctttgtttgctttcagagcttgccaacattgtttgatgcctggtgccaacaactaatattttaaaacatgtttctgtatagaagctgttactgcttcagtttatcaccttgttaatcacacttttttgaaagaaaggaataagatgaagatgtatgtgaccctggcctaccctttgtagttgtgatcaagctataggagtggtaatgcatgataagttatttcagctttcagaaaacatctgctgaaggattaatctaaccacttcctgtctgaatggcaagcatgaattatggttgcttcatgctaaatactactttcccagaatgggcatttagaatcaagcctctaaggtttccttttctcttgagttggcaaaactatgcatttaaagaatccatcatgccatctttgagtgggacctaatatgaaataccttgactgatatgaaatagataaagtgaaaaaaattccagttagagttattttcctggaccagaatagaaatgatcgtactggccatgtgcagtggctcacgcctgtaatctcagcactttgggaggttagcaggcggactgcttgagcccaggagtttgagaccagcctgggcaacctagtgagaccctgtctctgccaaaaatacaaaaattagcctggcatggtggcacatgcctgtggtccaagctacttgggaggctgaggtgggaggattgcttgagtcaggaagctcatttggcaagttagttctgtaatcaatactataaatgtcagtcataactaagatgatggcaggagataatgaaaacaactacttaaatatttgggagataaaattgagtaaacatggtattcaaagttaccaagtgtcagtcaagtatgccttcacgattttagtgtaagtgatttagtgagtaagtatatcacgaagcaataaatcaatgttaatactcatagagtgcttactatgtattaggtactatgttaaacagtgtagtatattttaatttgttaatcctcaaggcatcttacaatgtagataccaacacagatatagaaatggaaatggaagcttagagaaattaagtaacttgtcactgtaagagccaggtagtccaactccagtgtccaggctcttaaccactgttttgccttagaatttatcccatcccagggccactgtagttttcaatgcctagtgcttagattagaacagtgctcagcacataaaaggcatttaatacagtgaatctttattttagatctcattcatcctcagagttgttataccacttatgtattaagtactttctgaaacaaagcatggttacatgtgtcaatatttcccctgttttgcaagtgaggaaaatgagactcaggttaggtatccagcccagggttacacagtggcaaagccaaggcttaagatccgggtcatctggactttaaaacttatctgtggctgggcaaagtggctcacacctctaatcccagcatgttgggaggctgagacagaaggatcacttgagcccaggggtttgagaccagtccaggaaacatcaggagactctgtctctacgaaaaatttaaaaattagctgggtgtggtagtgtgcacctatagtctcagctactcaagagactgaagtgggatgatcagttgagcccaggagtttgaggctgcagtaagctatgatcacaccaccgtactgcagcctgggtgacagagcaagaccccgtctcaaaaacaaaacaaaacaaaaaaaccttacctgtgcatgagtgagtttgaagaaggtgagaacttgaacacagtagtgatcacacaagagaattctgcagaaaaaaaaaaagccccaatgaggtaaccctctaacccttctactcacatctgttttgccttgtatgcattggacttcaggcaattacctttctaagccacatattcctcgtctttaaaatgggacaacaatagtacctacc

SEQ ID NO: 12465 - DNA, 45299 bp, Human
  misc_feature (1)...(45299): n = A,T,C or G
gtgtcttgtgtgtacgtgtgtgcgcgtgtctttgtgtgcatgtgcgtgagtgtgcagtacacgtgtgtacgtgtgtgcgtgtgtctgagtattcctgtgtgcacgtgtgtgcgtgtgtctgtgtgcgtgcatatgtgtgtgagtgtgcgtgtgtctgtgtgtgcgtgtgtgtgtgtagaggtgggaggggaggcagcccccctggatgtctctaggtcactaagaggttagggatctcacacggagtgattctgccccccaggggacccggggcagtgtctggggacatttgtggccaacacatctggggggtgctcctggcacggagcaggtggatgccagggacgcagctcaccaccctgcagagcccaggatgctcccgccccggagaacaatccggcgctggtgtccgtattgctgggtgggaggagagaccctggcttaggagaaggtgacctcagtcaccgccttcctgcagctgagacccgggagcctctgggaaagccgggactcggcctccccagctgggctgcaaggtgaggaggcttcccgccgacctcagcttccttggcctccaatgcagccccggggcgcagggctgctgagaaagtgtcgtgtgtgggtggcccggactccagcccaggagcagcagccatgtggctcttctttgtgtcggtggaaaaaaacccattggtttgtggaaatagcaaatgtttgtgacggaagaggggcctggccggcttcagagaccacaggggcccttcagggcaggagggaaacagccttggccacgtgaacccggcccagcccggcctcgagcagctcaggaagctgggcctgggttgggcccggtgcaggggcgtctgctgacctcgccgggcaagcccactgcagggtgagccccgctaggcaggacggggcctcccctagagctgacagtggtgcagctcctggcttctccaagtggggctgccggctcagcagcagagcagtggtggcctaaccgggagacacagaacctggcatctgggttcattgtgcgcaagtcccggccccatgacctcggccggtgtagacgctccgcaaggcaggggcctttgcctgcctcgggcctccttgtccacgaaataggaggctgccgcgaagctggagggggcagatcgctgcctggatctccctccagaccttagtgggagtcaggaaagaccacggaaggtggtccccgtgggcccccctcgcgatccgtgcactgtgcattggagacggccgtgggccccccctcgcgatccgtgcactgtgcattggagacggatacggggcctggccctgtgcagggtccggcttggaacagaggattccgttccatggaaaaccgcagctccaaaggccccaaccgccccgacccccggagaccaatcaccggggcctggagacgttctttccttcctattgacctcctggccctgggcggctcacatgagacccccggccttcctgccccccgtatacctgtcacttcctccattcggggttaattggtttgtccccagtttccactttccacctctccctttgcccggcacgtggcttacataaaagtagaaatcagagatggaaaaacaccgaagtattccatgggaaggcgccgtgcctgggtattttgtttttcttgcactggtgtgtctgatggactggactttgactgtggggttggggcttccttgttctgaaatggaataacacaagtttctggaagataatttgccctgttgtccagcaagagaagcatccaggtcttctccgcacggatcggtggtaaagaataaagtggattctgcccccgttttctccggagggcacggccctttcgaattcccatgcctcatttttggggacagcaacgtcgttctccgataaaagctggaggtagctctgtgagttccttgtaagtaaaaaatatgtaaccatgcttttctctttctctctccttttttaaacagggtgtacagcaagctgtgattcctgggaaaactaaaaaaggtatgtggcattttctcttacttcatgaggttggaatctcttgttttttagaaaaaggaacaaacaagccccagtcttttatgtgtgcctgacactttgggaggttgagtcatcccataaaagggctccgggctcagagccaggaaacctgagttcaaatcccagatccccttttaccagctctgccccgtttgggtgggttcgcgtcaactgtctgcagtggagatgacgttctccgttttgcaggaaggttgcaaagattaaacaagcatatagatacaaaaatataaaaatagccaggtgcagtggctcacgcctgtaatcccagcactttgggaggctgaggcaggtgggtcacctgaggtcaggtgtttgagaccaggctgaccaacacagcgaaaccccgtctctaccaaaagtacaaaaattagcagggcatggtggcaggtgcctgtaatcccagctactctggaagctgaggcaggagaatcgcttgaacctgggagatggaggttgcagtgagctaagatcatgccaccgtacaccagcctgggcaacagagtgagactctgtctcaaaaaaaaaaaaatatatatatatatatagcatatatattttatacacacatatacctatatatatgtatacacagtggcgtgcgcctgtagtcccagctactcaggaggctgaggcaagaggattgcttgaacccaggagttcggggttgcagtgagctatgattgcaccactgtactccagcctaggtgacagagtgagacccggtctcttaaaaaatatacccagtgtggtggcacgtgcctgtcatcctagcattttgggaggctgaggcagaaggatcacttgagcccaggaggtggaggctactgtgagctgtgattgtgattgcaccatgggactccacgctgggcaacagagtgagaccaggtctctaaagaaaagaaaaaaatatatatattatatattatatataatatattatagttcactgctataatatactattatatcatagctcactgcaatcttgaactcctgggttcaagcaatccctttgcctcagcctcctgagtagctgggactataggtgcacgccactgtgtatacatatatacatataatatatacatatgtgtaatatatattacatataatatatacatatgtgtaatatatattacatataatatattacatacaatatattacatgcaatatgcacatgtatgtaatattacatagaatatgtacatgtatgcaatgttacatataatatgtacatgtatgcaatattacatatatacatgtatgtgatataatatattacacatgatacgtacatgtgtgtgatataacattacatgcaatatgtgcatatatgtaatatattgcatgtaatatgtacatatatgtaatatattatatgtaatgtgtacatgtgtgtaatataacatattacatgtaacgtgtgcatgtatgtaatataacatattacatgtaacgtgtgcatgtatgtagtatgatatattgcatgtaatatgtgcgtgtatgtgatatgatttattacatgtgatattacatatatgtaatgtgatattacatgtaatgtgtacatatatgtaatgagatgtacatataaaatataatatatagtatataatatataacataatatattgcatataatatataacatatatattgcatataaaatgtatattacatatatatatatgtatatatatatatgctcagcaccatgctggcatgtcagtatctaagagatgtgagctgaacctgaaaccatcgctgatctgtttcattcgcgtttttctaggaatttgtccatttcgtgtagattacctaattggatgtcacacactggttcataatgctaccgtgttctctgataatgccttttatttccatacagttggtagtaatgtcctcctttcgtttctgcgtgtagttatctgcatcttatttcctctttttttttttttttttggttttgcttttggtcagccccgctagaggtttgtcaatcacctagctcttttcaaagaaccaacttttggtttcgtcgactcgccagtttttctcatctctgtctcgtttatcgctgctctgatctttacaatttccttcctcctgctggcttggggctgccttcgttcttccttttctggttccttaaggcagcagtcctcaacctttttggccccagggagtggattcgtggaagacagtttttccacagacagtggggaggtggggggggtggagccgggaggatggtttggggacgattcaaacgcattactttttttgtgcactttgtttctgttattatgacattgtaatatataataaaataattccacaactcaccataatgtgggatcactgggagcccggagcttgtttcctgcaactagatggtccctgggctgggtgtggtggctcacgcctataaccccagcattttgggaggctgaggcgggtggatcacttgaggtcaggagttcgagactagcctgaccaacaagatgaaacctcatctctactaaaaatacaaaaattagccaggcgtggtggtgggcacctgtagtcccagctacttgggaggctgaggtaggagaatcgcttgaacccgggaggcggaggttgtagtgagccgagatcgcaccattgtactccagcctcggcaacagagcgagactctgtctcaataacaaacaaacaaataaaaactagatggtcccatctggaggtgatgggagacagtgacagatcatcaggcattagattatttctgtttgcttgttttgagacagagtctctctctgttgcccagtctggagtgcagtggcatgatcttagcttactgcaaactccgcctcctgggttcaagcaatttccggctgattttttgtattttttagtagagatggggttttatcatgttggccagtcgaggccattaggcattagattctcataaggagcgtgcaaccaagatcccttacatgcacagttcacaattgggttcacgcttctatgagaatctgataccactgctgatgggacaggaggcggagctcaggcgggaatgcaagcgttggggggcagctgtgaacacacaagcagtcaggcgccgtggctcacgcctgtaatcccagcactttgggaggtcaaggtgggtggatcgcctgaggtcagaagctcgagaccagactggccaacatggcaaaaccccatctctactgaaaataaaaaaaattagccgggcgtggtgacgcatgcctgtaatcccagctacttgggaggctgaggcagaaaactcacttgagcccgggaggcagaggttgcagtgagctgagatcgtgccgttgcactccagcctgggggccagagcgagactctgtctcaaaatatgtgtgtgtatatatatatattttttaaatatatattttatttataaatatgtatatgtgtttttatatatttataaatatatatttgtttatatatttataaatgcatatttatatattatagataatagataaatatatattaataaatacatataaatatatttttatataaataataaaagattgtatgaaaatataatttaccagcacggcagggctttttggcgttccctagattttgcccccaaggtgagtgccgcatggcctcaccctagtcccggcccccacacaaatgacactcaggatgacgacgaagacagtgatgatttaaaacctggccgatggccgaggggtcgcatgtgcccgtggtgtctggtctggatccttttacgtccttctccatgaatatattctccatggagaagtccctgccctctctcctgttttctgaccgggagaccagacctcctttgctggaggtcaaacggccagggtgaggtccctggagcctgccctgagccccgtcctctgggacacacaagtgctggctgatggcagcgtggctggacggcaggtggcacggagctgcctgggcaaggctcaggtgtctccaggccgcaagctcaagctgccagccatgtggccacgtgccgtggggattaggtccctatgctgcagcatctgctgggagggatgacaagaggctccagcaatgacatcaggcagctctcgtcgggccctggctaagtcccctggccctgttcccagcagccgggccatccccaccactgacgcctccctgatcctcagctccccctactcagcgactcagcagatacctctcccgtgccccctgcaggccaggtccactgctccaattcctttagttctcctaggatccctggggagcagggctcattgtccccattttataggtggggaaactgaggctcggcaaccaaaagatgtggcaaggcccgggggctggccagaggcagagcgggattggagtcacgagacttgccacagagcagctggtggtccctcaggctgtgtaggccacctgctcatctgcacaagcccctcagagcccagcagggccatggtcactctccctgggggacagtcacagaagctggggcttggtgaggaggtgagcagaggtggccgggagcggtggctcctgcctgtaatcgcagcactttgggaggctgaggtgggcggagatcacttgaggtcaggagttcaaggccagcctgaacaacatggtgaaaccgcgactctaccaaaaaataaaaaaattagccgggcttggtgttggatgcctgtaatcccagctaccagctactcaggaggctgaggcaggagaatcgcttgaacccgggaggcggaggttgcagtgagccgagattgcgccactgcactccagcctcggcgacagagcaagactccgtctcaaaataagccagcaaggagggtcgccacgggggctggatgagagagtgcctcccagccgctccttctgctgcattctacccacttcctgtgagccagtctcaacccaaacactctttccccatcccacagggattctgagaatcagggcaccccagacccaaggcagccacatttcccttttccactgagagcggaaagaggcctcggcacttcctggggcagcccaggatttggccgtgtttctgcattagcaagaaaaggcgtaatggaatttggatagacaagaaaaggggatgtaagcgtgagcaaaaccacacactccatttcattgttagaaattccatgcgtgtcatcaaaacctcatcttgggacagaggccaagacgaactcactgtcacaaggaactttgtgcacaacaagtgtgctggctcccctgtcacccccgccctcacccccggcctgctggctgaccccagacacagcagccttgtgtttcctccctcctggtcagctggtgcctggtagctgcagcggtggtagctgcagtggtgtctctccagaaggttctgggggagagactgaaattcccatgcttagccttacaatgccccggccccgtgcaaacctccagatgaaaacacagccccggccagtgcggtggctcacgtctgtcatcccagcactttgggaggccgagacacgtggatcacaaggtcaggagttcaagaccagcctggccaagatagtgaaaccccgtctctactaaaaatacaaaaattagccgggtgcggtggcgggcgcctgtaatctcagctactcaggaggctgaggcagagaattgcttgaacccagggggtggaggttgcagtgagccgagatccgccactgcactccaacctgggtgacagagtgagactccatctaaaagaaaaaaaaaaaaacacagccctgtttaagccctccgtgcatgtcctcctccacctccacccccacggctgccatttttgccaaaacgtatatcctggacttgccttcttgccgtttgctgtgtttgagcgtcgagcgttgagccagacacagttgggttggcacaggagtcagggttctctccgggggtcctgacagtttgctgccaaaccttcatgtccagacctagtgtcccccctggggtccctcgggtttgcagttgccttggcattgaggattcaaggtgtgtggcaggaacagggacccaggaaaccctttggtggcctcagcctgcccagctttgtcacttgaacctgtcgggatgcaaacaacatgcacagttcacgagaaagccgctcctggctggaacatcccttcgaccagggtctctgggtatcagcatctctgacattagggtcagattattcttgagagggggttgtcgctgtttgtttgtttgttttgttgtgttttgttttttgagacagagtctcgctctgcacccaggctggagtgtagtggcacgatcttggctcactgcgacctccgccacgtgggttcaagcgattcttctgcctcagcctcccgagtagctggaatttcagacgagcgccaccaggcccggctaatttttgtatttttagtagagatggggtttcaccacgttggccaggctggtatcgaactcctgacctcaagtgagccacacacctcagccacccaaagtgctgggattacaggtgtgagccactgggcctggctaggttttttttttttttttttttttccagacagagcctcgctctgtcgcccgggctggagtgcaatggcgcgatctcaacccactgcaacctccgcctcccgagttcacggcattctcctgccttagcctcccgagtagctgggattacaggcgcccgccaccacacccagcaaatttcttttgtattttagtagagaccaggtttcaccacgttgcccaggctggtctcgaactcctgagctcaggcaatccgccctcctcggcctcccaaagtgctgggattacaggcgtgagccaccatacctggtttttgttttttgatttttgttttccattgttaacatgaaaacatccgtaatgatccctagccctcagggagaagctccctgggcctgtagttttccgggactttctaacaacaccagggctggagtggggtggccctggagatgtcacacatgatactggtgacctctagccattctgatgatgtgacctggagcccacgggccacagcagagaaccccaggctcgaggtccatccttggccatgtgtgtgcccggacgggccggcccctgctgcagagcccagaggggtgggcctaccaggccacgtgtgcccatgcacagcagcagcacctgctatggatggaggtggggcaggcacttcacatccgagggctgcctgggcctgggagcctctgtcctgggaaggagatcggccctgggaacagagtgggttccaggaagtaacaccctttgtgaactccctgcaccatggcctccagccccttccatccaagtggcatctttggtacccagcgtctgggatgtgctggggttggcagaacaaaggcctcaaagacatccatgtcctaatccctgggagctgtggctgtgtcaccacacatggaaaaagggactctgcaggtgggattgagtgaaggaccacctgagtcatgagagcaccaccgtggatgatccggggtgggggggcgcagtgacctcacaggatcctcacgagaggaggcaggagggtgagagtcagagagagactgaagaggctgtgctgtgtctgtgaagggggaggaagggtcccgagccgagggatacgggcacctctaggcgaaaggcaggaaagagattctcccctggagcctccaggagggaccagccctgcccgtgccttgattttaacccagtgaggcccatgttggactctgagcccagagctgtgagatgagaaacatgggtcgtgtgcagcagccacaatgtcacaggacacaacgaacgtccagggagctgccagtgtgcggagaaggggttttagtgcagcctggctgtgcatagatggttgcaatcaggggcttctcagaggggatgacatcggtggggctttgcaggatgtgtaggagttttctggggggggggcatgcgtggagaaagacccacctgtgctgaggtgggaaggcccggtactgccctctgttctcttcctaaccctcctgcccttcagctcccgagcaccaccgtcacgaggccggcgctgccccttgccctggcccggggccagggtgacagcatttcctcagccgggaagcccagaactggagtgacaggagccacggggttcagtgtcctggcccggccccggttcccgggcttgcaaactctcacatgaccgtggtcatcccccgcccccgccgaccccaccgccgggtggacagagagcagcttttcttttctcctgctcccgtcaccgcggcgaccaaacccacactggcggcgcgtcaccctctgtcgtcgcggcctctttgtctgaacaagccggctcattcttaggctccaagctccggctgaaggcagcggcgggacctgccccgctggtctatttttcactttctcgtgggcacctcattcattccctctctttagccccttctaaatatagctgccccggggaccgatttagcctgagagcaaagggcccacactgacagggacagtcacaaggcactattttccagccagtgcggccctcccttccatgtggcagaggccctcccgcccgcagccctgggccccacggccctgccttgaggtcacagagccaccaacggtcagagctggcacggaaggccccacacacagccgccctcccaggccctgctgggcgacctggccctggagaggctgcaggtgcagggtgggtgcccacgctgggtgcagggtctctgcatgcagaccctggttgctgagggggccctggggttctgtggagcgggcagcaggtgtggccagtctcagacctgtctcttgtattgaagtttccatttcagtcgggctccccgggctctgcgtgggtcccctctttggcgtcctggtgagaacatggcaggccgtggggggcctgcatcccagctgccaggggacacatcaacgcctgatcgttgccctgtgccttctcaccctgatgccctgtgtccgctctggaagctgtgtgcacctttctttttcgtttgtttgttttgttttgttttgttttgttttgttttgtttttgaggcagagtctcgctccgttgcccaggctggagtgcagtggcgcgattttggctcaccgcaacctttacctcccgggttcaagcaattctcctgcctcagactcctgagtagtggcattacaggtgcccaccaccactcacggctaatttttttgtatttttagtagagagggggtttcaccgtgttggccaggctggtctcaaactcctgatctcaggtgatccacccacctcagcctcccaaagtgctggtattacaggcatgagccactgcacctggcctttttttttttttttttttttttaagacagtttcgctcttgttgcttaggctggagtatagtggcacaatcttggctcactgcaacctctgcctcccaggttcaggcaattctcctgcctcagcctcctgagtagctgggattacaggcatgcgctaccatgcccagctaattttgattttttttttagtagagatggggtttcactatgttgaccaggctggtctcgaacccctgacgtcaagtgatccgcccgcctcggtctcccaaagtgctggaaatacaggcataagccaccgtgcccggcctatgtgtgcacctttctgcagagtctaaaccagggtcccctaggcactgtagacatggcggccagattgttctctgaggtgggcctgtcctgggcactgcagggtgctgagcagtatccctggcctccacccactccatgccaggagcaccccccagttacgacaaccacagatgtcgccagacagtgcccagggtcccctggggggcggaattacctctaggtgaaacccccagggataggggattccacggacccccaagagactctgcgtcccatgatcctctgctgtgctgaggtcccaggaggctgcacacaatgaaatccacaccgagctgggagggagagaggaggtgaatcccaggagttgggggtccccctggttcacaccatccatcccgttgggagcttattctagtgtgggtagggattgaaccccattttccccaaataattaactcagggtcttctccctcagcactgtggacagtggggtaagatccttctctggggtgaggctgtgctgggcacttacggttgctgagcagcgcccctggcctccacccactccatgccaggagctcccccaaccccgacaaccacagatgtctcaggcatcgcccagggtttcctggcggggctgaatcacccacccccccaattaagagccactgttggcccagcacggtggctcatgcctaaaatcccagcactttgagaggccaaggtgggcagatcacctgaggtcaggagtttgagaccaacctggccaacatggtgaaaccccatctctactaaaaatgcaaaaattagctgggcgtggtgggggtggggggcgcctataaccccagctactcaggaggctgaggcaggagaatctcctgaacccgggaggcggaggttgcagtgagccgagatcgcgccactgcacactgtcctcaggggcttctgtgagatgcactgaggtcctcatggctcccgggggtgctcatggctgaggccctcgtgcccacagcaggcgtgcagatgtgcacattgacgcaggtgcccagggacacagctctctgcaaacccagctgccccagccactgtacgaaggcgacttgttcctcacagtgcctcggagccttctcttctctcccaaactactgttccattttgtttgggtttggatcttttcctctctaaacataacaccctgtctctcttgtctctgaacactgtgttctcagaagcagtcatccctccacggggaagggctgacgtttccactccaagcattgtctcccctcctgccaaatctggttgctggttttgttgcttggggtttatttttctttcctttttcgaggcaggcagaggtttggaggggtgagaggtgggggattgccagacccccaggaggaaagagtccaggagctctgcgagctataaagctactggttctggaagttttagagccagatgaaggttgcttctgttctcacgttgctgctgcaggccggccgcccctcccgccttcaaggccaccttcccccggggctgactcaccccggcacgccgcgccacacaaggctggctctgctttgatgagcagactggaaaagcgcagccgcctcattgtggagctgcctggaagccgccagagcccgctctgagctggaattcgctgagcctgacttcctgtgccgtcaggagagcaaacgcccgctggccttaggagccggtttacaggaagcagccatgggaggacggtttgctcggctcatggagaagcagccaccctctgcacgggttttaatgctgcaccctcatctcagggctgtgaaaagaaaaattgcaggccgggagcgggggttcatgcccgggatcctagcactttgggaggccgaagcagagggattgcttgagcccaggagtttgagactggcctgagcaatacggtgaggccccagctctaaaagaaaaaatattaaaaattagccgggcatggtggtgcacacctgtagtcccagctactcagaaggctgaggtgggaggatctctggaggccaggaggtcaaggctgcagtgagctgtgattgcaccactgcactccagcctgggtgacagagcaagaccctgtgtcaaaaaaaaaaaaaaaaaggaggccaggcacggcgtctcatacatggaatcccaggactttgggaggccaaggcaggtggatcacttgagatcaggagtttgagaccagcctggccaacatggtgaaaccctgtctctacaaaaaaataaaaataaaaaataagcctggtgtggtggtggatgcctgtaatcccagctactcgggagactgaggcaggagaatcacttgaacctgggaggcggaggttgcagggagccgagatggcgtcattgcactccagcctgggtgacagagcgagactctgcctcaaaaacaaaacaaaacaaaacaaaaaccaccaaaaaaaaaaaaaaaaaaggaaaacagcagagatgatgtgtgcagcatgctcagtccagcgtctaacacctagcagcagcagatggcaaataagagctgaagctgtcctgggctgtgggaccccatgcctgctcaccggggggccctccagcctggagaccccaaccagtcccatcctggccttgcgtatcagctccttacactgcataagaaactactgcatatgtggtggcttagagcaacacgcctgcctgagcttacagttctggaggtcatggtgcaatgacgtcctctgcccagggtctcccaggctgaaactgaaacgtgagccgcctgctgtctgacgcgaagcttccagttgtcgtccccagctcattcaggttcttcctgaattcacttccttgcagtcgtagggcgcagtccccctttccttgctggctgtcagtaataaacattcagtgcacaaatgaaaaaacccaccccaggccaggcgcggtgactcgcacctgtaatcccagcactttgggaggccgcggtgggtggattgcttgaggccaggagttcaagaccagcctgggcaacatggtgaaaccccgtctcgactaaaaaatacaaaagttagctggatgtggttgtgagcgcctgtaatcgcagttactcgggaggctgaggcaggagaatcacttgaacctgggaggcggaggttgcggtgagccgagatcacgccattgcactccagcctgggtgacagagcaagactccatctcaaaaaaaaaaaaaaaaaaaaaaaaagaacacacagcgctgcctcccatgagcctagccaaggcccgactgtgcacctgccacagggagctctttggaagggccgccctgcagccagccccagacaggaggcccagcagcactgggtacagaagcaccatttcttcccatctcagccctcggccctgatcagcctttcttattttatttttattttcttgagacagagtctcactttgtcccccagtctggagtgcaatggtgaaaccctagctcactgcaacctcaaactcctggcctcaagccatcctcccgcctcagcctcccggagtagctgagactacaggcttgtgcgaccacacccagcttaccttttaatttttttttttttttttgatggagtcttgctgtgtcgcccaggctagagtgcagtggcgtgatctcggctcactgcaacctccgcctcccaggttcaagcgattctcctgcctcagcctcctgagtagctgggattacaggtgcccaccaccatgccaggctaatttttttgttttttgtatttttagtagagacggggtttcaccatcttggccaggctggtctcgaactcctgacctcgtgatccacccacctcggcctcccaacctgctgggattacaggcgtgagccactgcccccggccttgatttttttacttagaggcagggtctcgctgtattgcccaggctggagtgcagtggtgccatcccagctcactgcaccctcattatgttctcctgaaattcggcttcgcttccccaagaacatttatttttatttttttattttagagacagggtctcactgtgttgccccaggctggctttgaactcctggcctcaagcaattctcctgactcagcctcccaaagtgctgggattacaggcacgagccaccgcacccaacctgatcagcctcttttaacagggtctgggggactcaggaccttccctgccgatggaggaaccctcggtagctcccgctccctcgcctctctggccgccaggcccaggagccgctcggtaaagtccctgtctctgccaggccgggtgcattcttgacattcctgtccttttacgcaggccgccccggccagctctcagaagcctccaccggctgcatgctctctccctgctggtgagaagatggccctggcggcggcggctcctggtcggtttatcgagccgggagtggcactttcccaactatgagaactatgcttggaattcagagccaccgccagcctctctgggtctcgctgtcacggcttcctgtgcagctggaaaacacctccaagagtggccgtggcatcacagacctaaaaaaggagctgggtttgctccggcaggtctccccgggaggagggaagccagtctgtcccgctgcccggcgggcctcgctgtctgctcggcagagacaggccaggcaggtttggacttctcgggatgctccagcctcagcgcccccagggtccccgcaaaatctccaaccaccccaggcctgctgtctgcttcttggctttacagcccaggacacctggattcagcccacccacccccgagcaggggcccacgcacccaccctctgcacaggctgggcacgccgtcgggctaagggtcccggcaagaatcagtcttagagcacaggccgagtgtggaggctccgtctgtaatcccagcactttgggaggctgaggcaggaggatcaccggaggccaggagatcaaaaccagcctggacaacatagtgagacccccatctctacaaaaaattaaaaaattaggggggcatggtggtgtgtgcctgtggtcccagctacttgggaggctggggcaggagaacggcttaggcccaggagttcaagttttcagtgaggtgggatcacactactgtactctagcctgggcaacagagtaagaccccttctcagagaagaaaaagaaagaaagagagagagagacggaaggaaggaaggagaaaagaaaagaaagaaattgagaaagaaacagagagagagagagagggagggaggagggaaggaagggagggagggagggagggagagccagagagaaagagaaagaaagaagaaagaaaaaaggaaggaaagagagagagaaggagggagggaggaaggaaggaaggcaggaaggagagggagagagaagaaagaaagagaaagagggagggagggaaggaggaaggaaggaaggagagggagagagaaagaagaagggagggaggcaggaaggagaaaggagaggtgtgagttcctgcgatggtgtgtatttagaatgcagaactttaggccactggatgagcaaggcctctaggttgttctccctaaaccctttggccaatgagacagggcagctgggggagggacgacacccagcctccagcacagaggtccattcagggctccactgggaccgtgtcaggtgtgtgtccatcccccattggatatcgtatgtgtctaaaattgagcttatggccgggcgcagtgtctcccgcctgtaatcccagcgctttgggaggccgaggcgggcagatcacctgagttcaggagttcgagaccagcctggccaacatggtgaaaccccgtctctactaaaaatacaaaaattagccaggcgtggtggcggacacctgtaatcccagctgctcgggaggctgaggcaggagaatcgcttgaatcaggaagcaaaggttgcagtgagccgagatcacgcctttgtactccagcctgggtgacaagagggaaacaccatccaaaaaaaaaaaaaaagttggtatatatgtttatttctcagtttgtgaaaatatccttaatttattgtcgtcacaaacaaatttcaattctgattactatgcaaggaaaaaacagaagataatctgctttgcaacgcagtttatagttcatttgtttacaggaacatgcaatatatgaaaaattactaactaaactacaagtattaaatacctaaattagttaacagtttattataatttatttaacaatctagggctgggtgccgtggctcacgcctgtaatcccagcactttgggaggccgaggtgggcagatcatgaggtcaggagatcgagaccatcctggctaacacggtgaaaccctgtctctactaaaaatacaaaaaaaaattagccgggcatggtggcgggcgcctgtaatcccagctactcgggaggttgaggcaggagaatggcttgaacccaggacgcagagtttgcagtgagctgagattgcgccactgcactccagcctgggagacagagtgagactccgtctcaaaaaaaaagaaaaaaaagaaaaatatatatatctaggaagtctgaagccatcagcacttccaatgcagtgaggaattcaggaatctcagtggagctgttagagtagtgaaccttgtaagtaaaatatatgcatgcctttctattgtgtttttttaaagacagggtcttgctctgttgcccaggctggagtgcagcggtgcaatcatagctcacttcagcttccaactcctgggctcaagcagtcttcctgcctcagcctcccgggtagctggaactacaggtgtgcaccaccatgccaggctaatttttttttttttttttttttgcagagacgggggtctcactatgttgcccaggctggtctcaaactcctggcctcaaatgatcctccagccttggcctcccaaagtggtaggatcacaggcatgagtcaccaccactgctgatggcctgacgcatgctttggatagcatcgtggagggatctctctaaaattgacctggtcggtttcattctcagcagactgacctgggccactcagcacggctttccttattcctgatgctcgtgtatgttctctttttacaataaagtcatcatcgtcagaagataccagtttaccatccatggcatcagggcctccgtagccactgcagcttttctcctctccattcattgttgttttgttttgttttgttttgttttgtttgagagagagtcttgctctgttgtccaggctggagggcagtggcgcaatcatagctcactacagcctccgccttccaggttcaagcaattctcccacctcagcctcctgagtagctgggactacaggcatgcaccaccacatccggctgatgtttgtattttttggtagagatggggtttcaccgtgttggccaggctggtctggaactcctgaccgcaagtgatctgcctgcctcggcctcccaaagtgcattcattatgttcttttgaaattctgtgtcgcttccctcaagacctttcataatttcttgtcagccctgcagtcactgtaaccgggtcccagcctaacaccacaacccccactccagggccagtttcccgcctccagcttcaccacaacccccactccagggccagtttcccgcctccagcttcctgtcccatcagaaccgtacactttgagcatgctcagtgtattatatgttgattacatttatatattatgaccctattctatattctatatcagatttattttattatagccaggtgccatggctcacgcttgcagccccagtgatttgggaggctgaggcaggaggatcgcttgagaccagcctgggcaacatagctgtagagacttcatctctacaaaaaataaaaaactagccaggcctagtggcatgcacctgtagtcccagctactcaggaggcccaggcaggaggatcgcttgagcccgggagttggaggctgcagtgagctatgattgcaccactgcactccagcctggacaacagagtgagaacctggctctaaaaatatgtatgtggccgggcgcggtggctcatgcttgtaatcccagcactttgggaggccgaggcgggcggatcacgaggtcaggagatggagaccatcctggctaacacggtgaaaccccgtctctactaaacaaaatacaaaaaattagccgggcgcggtggcgggcacctgtagtcccagctactcgggaggctgaggcaggagaatggcgtgaacccgggaggcggagcttgcagtgagcagagatcacaccactgcactccagcctgggcgacagagcgagactccgtctcaaaaaaaaaaaataaaaataaaaataaaaatatgtatgtatatatattttattatctgtataataaaatatacacatacacaaatggagtccgaccaggaagcacagactgtaccccaaggccaagagagcccctcccgagaacccagggtggcccagcctctgcacagaacccctagggtgtcgtggagcacaggggaaaccgctgtctagttctgaactttacagccgagaaagctgaggctcagggaagtccaggggacgtgctcagaaccaggtctccggcccaagaaagtcctccctgtcgggacctcgctgcaggcctcctgtgctctgtcacatatacgacccacacacgcttcagtgcggcagtgctcttgtctgcaagccagaaacacagatcttatatttcttgctccaagacaaacaaaacatcgattgttttaatctttcactttagttctgattaggaagaaaacatgtggcttcagtttcaaaaacagcaagctgaggcccttttcttttcttttcttttctttttttttttgagatggagtttcgctcctgttgcccaggctggagtgcaatggtgcaatctcggctcactgcaaccgccgcctcccaggttcaagcaattctcctgcctcagcctcctgagtagctgggactacaggcgcccgccaccacacccagctactgtttttgtatttttagtagagacgggatttcatcatgttggccaggctggtctcaaactcctgacctcgtgatccgcccacctcggcctcccaaagtgctgggattacgggtgggagccaccgcgcccggccttcttttctttttgagatatgtctcactctgttgcccggctgaagtacagtggtgtggtcataactcaccgcagcctccaactcctggactcaagcgatcctcctgcctcagccatccaagtagctgagactataggcacacaccaccacacccagttaattttcttatttttgtacaggtggggtttcactctgttgctcgggctggtttcaaactcctgggctcaagtgaccctcccaccttggcctcccaaagcactggaattccaagcatgagccaccacacctggcccaggatttcaacatatgaacttgatggggtcagaggaggacacaaatatttagtctgcaacaaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcttatcaagctctttcctctctacaacatttttgttgtttttcacttcttcctgcattttctacctttcatctggaattatctttctctagttttaccttttaaaaggcaagtctgttggtgagaaagtctggttttgtttatctgaaaatgcccttatttccccctaattcttgaaggatattttcactgggtccacctaattgctgctgttttttcctctggcaacttttgtttgttgatttttgtttgtaattaactgattttatcaaagtccaactcaaatgcagtaagatgaacagatcttaaagatacagtttgatggattttagcaaatgtgtacacctgtgtacaccaacagctcaaccaacatagagaacatcgccatcaccctagaagttatttcatggccctttctagccaacaccctggccagaggcagcaacctctgttttcatttctatcaccatagttttgcctattcttgaactttatataaatggaattatataatatgcacctctaatatccagcttctgttgctttactttttttatttttgagaggcatttattttttaaatatttaatattaatatttaatatattaatattaattaaatactaatatttaatattgaataatgtattatcttttatttttttagaatacatttatatttttgagaatcatacacgttgcttgatctctcaatagtttattctttttttgtgtgcagccgtatttcattgtgtgaaatgccatggcttgtttattctctcgttgacaggcatttgggttgtttccaggttttgctgttatgagtaaaagcttatgaacatctcgtacaagtccttttatggagacatgtttttatttatcttgaataaatccctaggagtggaattgctgggtcataggtgaggtatgtgttcagccttataagaaactgctaagccattttccatggtggttgtactatttcacattcctgtcagtaatggatgatgcctccagttcttctacatcctcccaaatatttagtgttgtcagtcttttaaatttttgccactctagtggttgagaggcagtctctcttgatgactttaactcatatttccttcatgactaatcattagacaccatttcatgtgcttattggccatttctctgccactttttaggacatttcttttgcctgaggttctagggattctgaaatctgtggcttgaggtctttttatcagttttagaaagttattggtcattatctcttcaaagattgttcctgcttcattctctctctcctccttctggtgttccaataacacgtatattagacgtcactgcatcttctatgtcttttgctctttcttctgtagtttctttccctttgtgtcgtcttgcttcattctggatatttttctctgttctgtcttccagttcactaatttttatttcttccattgagttcttacttttcagatattgtcattttctccatatccactggttcctttttttccccattgttccaatttgcagcgaaaattccaatctcatctttttatctctttgaacgtaattaacacaattaatttaaagtctctgtcaattcccagtatatggaaaccctgtgggtctctttgtagtgctggtttttgttttttttttgtttttttttttttgagacggagtctcgttcttttgcccaggctgcagtgcagtggcgtgatctcagctcactgcaagctccgcctcccgggttcatgccattctcctgcttcagcctcccaagtagctgggactagaggcgcctgccatggcgcccggctaattttttgtgtttttagtagagacggggtttcaccgtgtcagccaggatggtcttgatctcctgacctcatgatccgcctgcctaggcctcccaaagtgctgggattacaggcgtgagccaccgcacctggcagtgctggttatttctgctgatttttgtttatgtggtcctggctcctcgtatgtcttacttgcatgccagatattgtattgtgcatttttttttttttttgggacggagtctcgctctgttacccaggctggagtgcagtggcacgatctcggttcactgcaagctccacctcccgggttcatgccactctcctgcctcagcctccggagtagctgggactacaggcgcctgccaccaagcctggctaattttttgtatttttagtagagacggggtttcaccatgttagccaggatggtcttgatctcctgacctcgtgagccaccgcgcccggcctgtattgcggatttgcatgtagaaataatctgaggcctgggatcgtattattttcctccagaggggatttatgtttacttcttccaggcatttggggccaccagcaatctcgcatcaccttaatccaatattagggattgagattattcaaaactctgctgtagttgctagaaggacctgtctgcttcctcttgatctttactcccttttttttttttttttttttttttgagacggaatctcactcagctgccaaagctggaatacagtggcacgatctcggttcactgcaaccaccgtctcccggattcaagggattctctcatctcagctcctgactagctgggattacaagaacccgccatcatgcccagctaatttttgtattttagtagagacggggtttcaccatgttgaccaggctagtcttgaactcccgacctcaggtcatccacctgcctcggtctcccaaagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaccccaaacccaggctctctttcgatcctcccctaaatcctggctggaaattctccattatcttaataaccctgcaggcccttgagcagatgctttgacattctgtccagcttttctttcttttttgagacagggtctcactctgtcacccaggctggagtgcagtggcacaacgtcagctcactgcaacctctgcctcccgggtttaagtgattgttgtacctcagcctcctgagtagctgggactacaggcacccgccaccacgtccagctaatttttgtattttaatagagacggggtttcaccatgttggccaggctggtctcaaactcccgacttcaagtgatcctcccacctcagcctcccaaagtgctgggattacaggcttgagccaccgcacccagccctgtccagcttttttttcttttttttgagacagggtctctctctgtcgcccaggctggagtgcagtggcacaatctcagctcactgcaaccactgcctcccgggtttaagtgattcttgtgcctcagcctcccaagtagctgggactacaggcacgtgccaccatgcccagctaatttttgtatttttagcagagatggggtttcaccatgttggccaggctggtctcaaactcccgacctcaagtgatcctcccgcctcgacctcccacagtgctgggatcacaggcgtgagccgccgcacccggccctgtccagcttttctagtggacctcagcaagagagtgggtttgtccttagctgctaatccaccattgtgcaagccaaaatctgccaagagagatttttaacccaaagtccaagtcgtttagaaggaggtcatggatattctagatcctcttgatcttggagccacaggatgacaaatggggacccatcctcagccttgagaggagccctctcatcttccagctgaggaagccaagacccaaaaaccaggagcagagccagagtgcgagcccggattttccatttccaggcaggcaccgtgtggtccctcttcaggagcaggtgtcagcccttatcccttgaacaagatccctggcaatgacctcacctctccctgaaacctgaatgttctgtcagttcagcaagaggctgatgcaactcacagtccccagaggcccttttgtctctcatcgagtccataaatgacacggaaatgatctaagcatgactggtcaccctggacttctggaactcatcacggagcttacaagactctcctctcacctttaccctatggctcagaagaagaagggatttgcccaagctcatgctttaagttcaacaacacaaaaatgggccgggcgtggtggctcacgcctgtcatcccagcactttgggaggcccaggcaggtggatcacctgaggtcaggagttcgagaccagcctggccaacatggcaaaaccctgtctccactaaaaatacaaaaattagccgggtgtggtggcgcatgcttgtaatcccagctactccagggggctgaggcaagagaatcgcttgaacctgggaggcggaggttgcagtgagccgagttggtgccactgcactccagcctgggcgacagagtgagccatcatctccaaaaaacaaacaaacaaacaaaaaaacccaccaacacaaaaatgggtaatttcaggacacccagtttgtggctctatcccgaatccgatccatgctgatttttaatctgatcagcttccagctctgcccaggtctctccagggccggcggtggggggctgttgcaattccctgctgcaccccagcctcagggcaggtcaggggagtggcgacagggtgcaagtccacggggagtgagatttctcaagagctccgggcaaaccggcccttccacattcgctgggtgcaggatgttccagccaccttgtctttccagcagctgtgtttatatttggcagttgccacaggtccctggaagagggtcctcttcctgcctgccagactctggaacccctgtttcctcacacaggaacctgggggccaggcctggtgcagagatgagagtgtccctctgagaattccaacagaggtcactggggctcagagagggaaggaaactttcccaaggccacacagcttggtagagccagggcagatttctggcctaccaccttcccgagttccctcctctgtgggagctgtggtctcactcccttcaaatgcaacggggctcacatctgggggaagactcccgccctgtggggcctctcctagtcacaaagcattctgggatgctaataaaattaaagcccttttggaaacacccctgtatttacttttttttttttttttgagaccattctcctgcctcagcctcctgagtagctgggactacaggtgcccgccgccatgcccggctaatttttttgtatttttttttttttttagtagagacagggtttcaccgtgttagccaggatggtctgtatctcctggcctcgtgatctgcccgcctcggcctcccaaagtgctgggattacaggcgtgagccactgagccaggcctttttttttttttttttttttagacagggtctcactctgtcacccaggccggagtgcagtggcgcgatcttggctcactgcaacctccacctcctgggttcaagcgattcttgtgcctcagcctcctgagtagctagaattacaggcacgcactaccatgcctggctcatttttttgtatttttagcagacgtgggggtttcaccatgttggccaggctggtcttgaactcctgacctcaaatgacccacccgcctcaacctcccaaagttctgggattacaggcatgagccaccacgcctagcatattttcattcagtaccatttatttttggggccttcagtcagctgggttcaaactctttgcgttttgcctaagggaaccactctgagctgcaggatttctcctgataagggagttccataaaggcctaaaattttcccccaggggacacctgtccaagtctggggacatttgtgctggtcatgactgtgggcgcactggtgggggggggggtttcctggcaaggagtgggtggagaccagggatgctgcccagcaccctgcagtgcccaggacagccccaccccagaaaaggatccagccagagggagagggcctgtactggagtgagttaaacttcccggtgtagatcaggtctctttaggattttaggaacttcggagttcagcccattttgcagactggggccctaggctgtgtctctctttactgacaccactgtcaattttgtcgcagttttgggtctttgtctgctcagccatctgctcagcaaacgtttaggccacacctcctcacctcctctcctcctcccagtggggacaggttcgagggcgggggcacagctccagaggggcgatgcctccaggcaggaacccaggcccccttcctggagggatgcgcgacaccaaaactccctctgcacccccagatgagggccggtgggagtggtgccgtctgagtgagacacagcattgggctgacctcagggtcccggttctgatagtgtctcatagtcacaggtgacgtcgccctggaggggaccgggagagggtgcgtggggctccctggactatgtttgcaactgcctgagtccataattgtttcaaaataaaaagttaagatagggccgggagcagtggctcacgcctgtaatcccagcactttgggaggctgaggcgggtggatcactaggtcaggagtttgagaccagcctgaccaacatggtgaaaccccgtctctactaaaaatacaaaaattagcccggtgtggtggcgcgcgcctgtagtcccagctactcgggaggctgaggcaggagaatggcatgaactcaggaggtggaggttgcagtgagccgagattgtgccactgcactccagcctgggcgacagagcgagactccctctcaaaaaaaaaaagttaagataaacaatattcaataaacctataacagattatataactatataatacatatatacagatataaaatagtaatctaaatatattataaatacaaatataaaatcaatagcaaacaatgtaaatgtcaaaatagaaatcaaactatataattaataatgtataaattatgtaaatgatgaataaatataaaatatgtatgcaataagtgtataatacatactaaatactaaaactatatattagtaatacaaaactgatatgaatatatagtgaatgaatcttcaaatatgtaataaatgcatgataaatgacataaatataaatatgagtataaatataaatatatgagtaaacaaatatataataaaatatataaatatgtaataaatgtataatactatagtataatatagtataagtttatattataaactaatagtagaccaggcgcggtggctcacgcctgtaatcccagcactttgggaggtcgaggcgggtggatcacctgaggtcaggcgtttgagaccagcctggccaacatggggaaaccccgtctctattaaaaatacaaaaattggccaggcgcagtggctcacgcctttaatcccagcactctgggaggccgaggcaggcggatcacaagatcaggagatcgagaccatcctggctaacacggtgaaaccccgtatctactaaaaatataaaaaattagccaggcgtggtggcgggcgcctgtagtctcagctacttgggaagctgaagcaggagaatggcgtgaaccctggaggaggaggttgcagtgagccaagatcgcgccgctgcactccagcctcggagacagagccacactctgtctcaaaaaaaaaaaaaaaaaaaaaaaattggcgtggaggcaggcacctgtaatcccagccactcgggaggctgaggcaagagaatcgcttgaacccggaaggcggaggttgcagtgagctgagatcgcgccaccgcacttcagcctgggcgacagagcgagactccgactcaaaaaaaaaagaggcagagcacttgctttcattctaacttttcactcttacacataacgcaattataaacgcctttctatatgtagatttttatttcttttcattttttgccctcgggataactgccggagcaaggggttagagggcggctgctccctgggggtccctgtggtcccacctccctccctgccggtgctgccagctcctgtcctgcggttttgttcagcccttctgtgcactggagcctcgtgtctgatcagctcaggtctgctctgtttcggggctggtcacccttccctgagcgaccacagatttccactatgtcctggagtggggggtaccctcatccttcttgactttcaggcgcgagtgggatttttctgcacgaggcgggcttagactcgggtgtggctatgagccttttgctaggaggccagcgcggggccgggcggcgtccctcttcagttttatttttggagagcctggcctggagccttgcctgcctgcaggagcctgtgcaccgaggcagagcccgaccgtcaggagggagccgtggggactgtgtgcacctttgaccacctggccctgcccccggagctgcctgctcccgcccctcccacagcttccccgggccacgggccccgaggcaagctcattcaggtcggggtgcccggcacccgtgcgcctctgcagggaggcagttgggaggggcgttcctggctgactcagtgcgtggccagttctgctgctgttggcttagtcctctgctgggggcatggctgctcctgagtcagtgccggctggtgacaccaccgagacggggacttagggaggcgactgcatgggtgatgcaatctgtgtctgagtctcggcatctcagcccaagcatccacatgcactcccgtgcgcacacacacgcacacgcatgtacacatgcagacacatgtacacacccacgcacgcacatatccacgcacctacagtgacgtacacacacgccaacacgcatgcacacacccatagtgacatgcatgcccacacacgtgtgcgcacacgcacatgcagtgccgtgtccacacacgtgcacatacacacgtgcacactggcatgcatgtccacacacatgcacgtatgcaaatgcacctatgcacacactcatatgcagacgcacacacgtagatgtgtacatgcactcatatagacacatgcacatgtacacacatgcaaggatgcacactcatatgcatgctgacgtgcacacccatgcatatgcaggtacacatacacatgcagatatgtgtgcacacacgcatatatgcacactcatgaatgccagtatacacatacacacatacatgcacacgcaaggtacacatacatgcacatgtgcacacacatacacatgtgcacactgacatgcacaccacgtgtacacacgtgtacagtcacatgtgcatcattgacatacatgcaaataaacatagacacacacacacagcgcagtcctctctggccttcctggcaggcctgggttattacccagcccaaagggagcatctcgcagggaatttcgcccaaaacagaaaagccagcacggctcaggacctgatgctcacatggaaattgcgggcggtggctgcccagggcagcaggggcccagggtctgggtggacactcctgactgtggatgctaaataggaccccctggccttccaaggaaaacaggaggtgcggccagcccgtttgttctctgcgtgcacgtatttttagcactgagtaatttaggtatttttaagcccaaccaagggcggttttccctgagttggatgttttgtggctgctttgaagctctctggaatcagagccctctgagcggccacacgtgggctctgcctccagagcagacagattgggccttctctgcccccaaaaagtgggggtgggacgtctgctggaaaccaaggaggctgggcggtgtcaaagggattttttgtttaattgccccttttattgagatcgccgtggagtcacagccagtgctaacaaagaatgtagaggaattctgtgtgtcattccccggccgtccctggtggtaacatttggtaaagctatgggcaggatcgcagccagacagtcacacacccaccagcctcactcaggttccgcagtattcagtattgtgcccgctggtgtgtgagtgtgtgaggctctctgtgagtttatcactcatgtaggcttgtggattcatcaccgtagttgaggcactaacagggatcattcgtgttgcccttttattatttattcagagatggggtctcactaaattgcccagtctggcctcaacctcccaggctcaagtgatcctcccacctcagcctcccaagtagctgggaccacaggagtgcgctacccatgcccagctaattttctaattttttgtagagagggggtcttgctatgttgcctaggctggcctcaaactcctggactcaagtgatcctcgcatctcagcctcccaaagtgctggtattacaggcaagagccaccatgcctggctgtgttgcccttttatacagagacctatctccctcccagcccctgcccctccctgatccctggcagccgctaatctgttctccatttctaaaatttcgtccttgggccgggcatggtggctcatgcctgtaatcccagcactttgggaggtcgagacaggcagatcacttgaggccaggagtttgagaccagcctggccaacatggtaaaaccatgtctctaccaaaaatacaaagattagccaggcatggtggcacatgcacctgtaatcccagctactcaggaggcagaagtgagagtatcgctggagctggagaagcggagcttgcagtgagctgagatcatgccactgcactccagcctgggcaacagagcgagactctgtctaaaaaaagtcctcttaaacacattacacaaacagaagcatgctacacatcccaggccctggagattcccctgcggtgtggtatgcatggatggtcctttccttcttttttttttttttttttttttttttttgagacagagtctcactctgtcccccaggctggagtgcagtggcgtgatctctgctcactgcaagctccgccttccgggttcaccccattctcctgcctcagcctcccgagtagctgggactacaggcacccgccaccacgcccgggagacggggtttcaccgtgttagccaggatggtcttgatctcctgaccttgtgacccgcccgcctcggcctcccaaagtgctgggattacaggcgtgagccaccgcgcccggccagtcctttccttcttatcactaagtaggcattttttgagaactctggaatctgccttgacttctctgcggctgcctggctctgcaaaacagacagcgatgccatgagttatgacagagacagggtgcggcttaattaactgctcacagacgcccggctgggactgcggctgcccaggactcttgaacctggcccctgcccctgccacccccatcagcaccaaccccctcactgggtcctacgaagcaggtttctctaggctggacactactgacacgtggggctggatcgttccctggagcggggccgtcctgggcactgcagggtgctgagcagcatccgtggcctccacccactccctgccaggagtacccccaagtcatgacagccacaaatgtcccagacatcacccagtgctccacggagggcagagtcacccccagatgagatctggggattccacggactcccaagagactctgcgtcctgtgatcgtctgccctgttgaggtcctgggtttttccaggagaattcaagaagcaacagcatgggctcctgactggttcaatatgaaggacacggaggagaggccgggctcacacctgtcatcccagcactttgagaggccgaggagggtggatcacctgaggtcaggagttcaagaccagcctggccaacatggtgaaacgctgtctgtactaaaaatacaaaaattagccgggtgtggtggcacgtgcctgtaatcccagctactcgggaggctgaggcaggagaatcgcttgaacccgggaggcagaggttgcagtgagccgagatcacaccactgcactccagcctgggcaacagagcaagactctgtctcaaaaaaaaaaaaaaaaaaaacacggagggggacagtcaccaggggttctgctgtgatccctgccctgacccagggtctcccctgggtactatggatatcgcgttcggatccttccctggcgtggggccgtccggggcactgcagggagctgagcaatgtccctggcctccacccaacccactccatgccaggagcaccccccacagccacagatgtccccagatatcacccagtgtcccctggagggcaagaacccctgccatggactgaggcaggccacccgggagcctgcgtgggtcctcccttctccagagggcctggcctattgcctttgccctttctttattttttctttatttttttttttgagacggagtcttgctctgtcgtccaggctggagtgcaggggcaccatctcggctcactgcaagctccacctcccgggttcacgtcattctcctgcctcagcctccagagtagctgggactataggcacccaccaccatgcctggctaatttttgtatttttttttttttttagtaacgatgaggtttcaccgtgttagccaggatggtctcgatctcctgacctcatgatccacctgcctcagcctcccaaagtgctgggattacaggcgtgagccaccacgcccagcctgccttcgccctttcattctctcgttctgcaaactcccacagaggattgtgacggctgaccgcgtgccaggctctatgctgagagttaaacgagtgccagctctttgtacacggaggcccctggtccccacccagaggcaaagtggccgtgcctagagtcgggaaggttgagccaaggcctggcgcccctgctgccacccagaggcctgacctgaactttgacccacacccctctgcttcccccacagctctctggacaacggggcccagagctgatggcagacaatgtcagccactaacaacatagcccaggcccggaagctggtggaacagctacgcatagaagccgggattgagcgcatcaaggtgagcccagcgggcatcaggaagaggaggggagagacccttgggggccccgcaaatgatgaacaggaggctcggcaggagggcagaggcttgcaccccaactgtgtctcttgctgtgtgaccttgaggccctcccttaacctctctgagcctccatttcctcggcagaaagaggcagctgatctaacacctatctcctgccttcgtgcagcaatgtaacgtgctttgtaaacacactggggccccgtggagacggtcatcgtgacagagcgctttgtcgtcctcatctgcattgatctgtccagctccttggcaatgacagatgcaaattaaactgagagacacagtcccaggcgggaggagactgcatgtcctatctacttttttcacttctgtgttgtttgaaggatttgtttgttttgtttgtttgagacggagtcttgctctgtcacccaggctggagtgcagtggtgcgatctcggctcactgcaacctctgcctcccgggttcaagcaattcttctgtctcaacctcccaaatagctgggattacaggcatgcaccaccatgcctggctaattttttgtatttttagtagagacggcgtttcgccatgttgcccaggctggtcttgaactcctaacttcaggtgatccgcctgcctcggcctcccaaagtcctgggattccaggcgtgagccaccatgcctggcccgtttgaagttttttacaaggatcacacttgaggctgcgccttgtcgagatttattttaaggcaagctctgaaatctgcagtgtaggccagcaggctggagacccagggaagagttggtgctgcagctggaaccccaaggccacctggaggcagagttccctcctcctggaaggaccccaggctttttctcttaagcccttcaactgattagatgaggcccatctgcattacagacggtcacctgctgtgcttgaagtctacggatttaaatgtgaatcacatcaaaaaaaaaaaaaaaattttgcatgtgaggcacagtggctcacagctgtaatcccagcacattgggaggccgaggcaggaggatcacttgaggtcaggcgttcaattccagcctgggcaacaacatagcaagaccccatctctacaaaataaaaaacaggctgagcgcggtgactcacacttataattccagcactttgggaagctgaggtgggcagatcacctgaggtcaggggttcgagaccagcctggccaacatggtgaaaccccgtctctcctaaaaatacaaaaaaaagattacccgggtatggtggtgcatgcctgtaatcccagctatttgggaggctgaggcaggagaatcacttgaacctgggaggtggaggttgcagtgagccgagatcgcaccattgcactccagcctggggaacagagcgagactctatctcaaaaaaaaaaaaaaaaaaaaaagaaacaagaaaaaaacaaccttcacagcaacatctaaaaaaacatttaactggccaggcacggtgactcacgcctggaatcgcagcactttgggaggctgaggtgggcggatcacaaggtcaggagttcgagaccagcctggccaatatggtgaaaccccgtctctactaaaattacaaaaaaattagccaggcgtggtggcaggctcctatagtcccagctacttgggagactgagtcaggagaatagcttgaacccgagaggcagaggttgcagtgagctgagattgcgccactgccctccaaccccaagcgacagggtgagactccatctcagaaaaaaaacaaaaacaaaaaaacatttaaccaaaccctggggcaccatggcccgccctagtgcacccataaaatcagccatcaccccacgtatccactcagaactcagctctccagcacctgtcaccagcttgtcattattggccacgggaatttattaggaaggggtgaccggcccttgctttgctcccagcggggaggcggacagagtcgtccctgctggccaggtggcacaggtggttctgatcggccggtgagtctccctccagcgcagctctgagccctcccagaccccatcacgctgctgctggccgggatccaaccagtaggggaggggtctgcctcccacgaggtgtctgaatgttccagcaatctgactgctgaggacagacctgagcattcaaagcattccttcgggctgaaaagagagaaagccctggttgaagtggttttccttttacgagtgggtgccagcccccagcccgggcggagggcggtgactcatcctgccctgtttgatgttgaggaggggcccccaccgcccctttgaatgtcgggcctcggggggagccaggatttgacccgtccccactcccagtcccgcctgaggttttacatccccagctccaacgcggcgaccagaaccacagaacctcaacggcgacgatcttggggctcaccagcccagcgcagtgggcatggggggtggtgccaaggtgccacgtgctggagccacaatgccagctattttcggggtctggaggctatttctgtcgtccaggagggccgcttcccaaatagaagtctagaaagcaggccaggtccgagtcatcacaggccgcggccggcgggctcactctgtgggcatgagcgtcccccggctgcccagctgggcaagaccccaaagctgtcccacaggctcctggccgtttgaggggcccaggtcccaggtatccttggggtccaaaggaggacagaggatctgggatgcagaggtactggccaggcgaggcggctcatgcctgtaaccccagcactttcagaggtctaggcgggagggtcgcctgagcctaggagttcgagaccagcctgagcaacatagtgagacctcatctgtaccagaaaattattctaaaaattatggccaggccaggcacggtggctcatgcctgtaatcccagcactttggcaggctgaggtgggcgggccacctgaggtcaggagattgagaccagcctggccaacatggtgaaaccccgtctctactaaaaatacaaaaattaccctggcgtggtggcgtgcgcctggagtcccagccacttgggaggctgaggtgggagaactgcttggacccagggggcggaggttgcagtgagccgagatcacgccactgcactccagcctggctgacagagtgagactctgtctcaaaaaaataaataaataataaaaatgaaaattatggccaggtgtagtggctcactcccgtagtcccagctactcaggtactcccagctgaggcgggagaatcacttgagcccaggaggtggaggctgcattgagctatgatagcaccactgcattccagcctgggggacagagcgagaccctgtctcaaaaacagataacaaaggcacctccgtgaagcgacactgcgatccttctcggatcatcccctcacctctgccacatctaatcctccccctgtgatcgccctctcgccttccaggaaagaaagcaaggagagaaaggtcgctgagtcccacagagacacagttaccggttacgggatgagatccagggccagatggacgtgtccccgtgtagcctgacccaggacaccggacaccccagccccagccctgctggggtgagctaagcggggagtggcagcggcacccccaaaggcatggccaggagagacgggcgtgtagcctggggcgggctggcagcagcccggggcagggggtccctcctgtgaccggaagcatcagcccctcagagggttggagtcatcagggggttcaggctgcaagagaaacatggagacgggcttatctcgtcctcaccgggcccagccccctggccgggtgtcaccgtgaaacctccctcaagctcatcaaatgtgcaggcagcgttttcctatcaggaccttccttccttggggtgagaatgaggtcttggactccgaaaacggggtccatctgtccctgaccctttgtgttcaaaatctggcaacgcttgctgaaggaagctcagccttttcttttttaaaaaaatattttttaggccaggtgccgtggctcacgcctgtaatcccagcactttgggaggctaaggcaggtggatcacttgaagttaggagtttgagaccagcctggccaacatgctgaaacccgtctctactaaaaatacaaaaattagctgggcgtggtggcaggcacctgtagtcccagctactcaggaggctgaggcaggagaattgcttgaacccggggagcaagagattgcagtgatcacaccactgcatttttctttttttaattttgggaaaagacacacataaatttatttatttgtttatttatcttaattgagacagggtcttgctccatcccccaggctggagtgcaatggtgtaatcttgactcactgcagccttaacctcccaggctcaagcaatcctccagcctcagccccccagttagctgggactacagatgcccacatcactatgcctggctcatttttgtattttttgtagagatagggcctcactgtgttgcctaggctggtctcaaactcctgggctcaagtgatcctcccgcctccgcctcccaacatgttgggattacaggtgtgagccaccgcacctggccaagacacatataaagtttaccactagtgatatttaatatagtcacaatgctgtgcatccaatcacgtttattccaggacattccatcaccccaaaaggaaaccctgtcccccatcagccatcactccccagcaccggcacccacgcatccccttcctgtctctgtggataggcctgtcctggacatttcatagaaatgggatcacacggccgggcgcagtggctcacacctgtaatcccagcactgtgggaggctgaggcaggcatatcgcgaggtcaggagttcgagaccagcctgatcaacatggtgaaaccctgtctctactaaaaatacaaaaattagctgggtgtggtggtgcatgaaggtaatcccagctactcgggaggctgaggcaggagaatcacttgaacccgcgaggtggaggttgcagtgagccgagatcgtgccactgcactagagcctgggcgacaaatagagtctctgtctcaaaaaaaaaaagaaagaaatgggatcacacactgtgtggccttctgtgtctggcatctctcactgagcatgaggcccttgagatgcatccacgttgtggcctatgtcagagcctcactccttttcatggctgagtaatattccagcgtgtggacgggccgcactgtttgcccacgcccccatcaatgggctcctgagctgtttccgcctgtggctcttgggaatggtgctgctgtgaacccgggtgtgccagcctcttcttatgtctcctctgtctcctccttgtgctcaaacacaggtctccaaagcggcgtctgacctcatgagctactgtgagcaacatgcccggaacgaccccctgctggtcggagtccctgcctcggagaacccctttaaggacaagaaaccttgtattattttataactgtgttctcatatgttctctctctctctctctctttctctctctctctctctgtctctgtctctgtctcaggcagggcatcattcagtaattagctcaaacaaaacatctcaagtccccaaaacctttaattccaaaagaaatcccccctctccccgccaaaaaaggcgttcccaccgcccggatggggtagaatggaccttgtaggtggagatgaattttcaggtccgaccccatggccctctcagtttgggccaaaagggatggaggctttacggccacttcccgttcggaataactgaaatcccccagcgatggggtaacaattttttaaaactctcgattgccgtttcaattgtggaccggcgccgagggggaaagggaggtgacttcgcccggtggcaatagttccgggagaattggccattggtaaaaagacttcatagggtcactggaatgctttgtgttgtttttaagtagaggtaaaattgagatggggggcgggaggtgacatcatgaagttttttggaaatatctctttatttaaaaaattgttactccatacggctaaactcggattgtgatggttgaacccgtcgctaaactgcacgatcctgcaatgaatgcacgatggagtgtgggggtcgggagggggcttcgtctatgaaaagttgccaagtgtgactcccctgcatgatgttagccatgggtcctttctgcagggtcccctctgtgccagaaatgggttttcgggacttgccccagggaagccgtcaccggcccggcccatcatgtttttggattttttttttttttctttttttgagatggagtttcattcttgttacccaggctggagtgcagctgcatgatttcagctcaccgcaacctccgcctccccggttcaagcgattctcctgcctcagcctcccgagtagctgagactacaggcgtgtgccactacgcccggctaattgttgtatttttagtagagacggggtttcaccgtattggccaggccgctctcaaactcctgacctcgggatccgcccacctcggcctcccaaagtgctgggattacaggcatgagccaccgcgcccagtggtgttttaagcatgaggcatccgcgtggctgggagaggctttgaccatccttggctcttccaggttgtcctaccctctggcatccaccatagacgtttttcaaacagaaaatgcaggctggggagccgcggcagggcgggtggggctaccctgtgctgctgtgtgtacaaaattgttccatgatcttggagtgactctgaaggactctgggaggtgagacgttgtcccggagatcaaaacgtccgctcaaaacgttaccctgtcgctcgaacccgatctttttgcttttccacccccgtgcaacccaggacggctgtctgaggccgggagatgccttagacgcaggatgggccactcctcccagcggcaagtggaaatcgaagatgtcatggggtcggggggaggcttctgaaagatgactgcgtcctcctctgcggcacggacgggagcaggtgcagccacatcttccagggcctgccggcatcacctgcggccacacctgagatggaccccacgcagccctgatcgcaggaggcctggccgccccgaccccctccacggggctggcctagaagcaagtagtagaataaaactagcctagtcctgtccctccggccccagtggagacaggcgtctaagaacccgtgccgagagggttcctggacggccgcccaggtcctccgtgcaggcccgtgaggcggggatccctgcttggctcacttcctgagctggtgactgccagggttcccacctcgccaaggctagagggctccgggtgtgtgtgcaggtgtcgggggagtgacctccactcctcaacctcgggcagctcccacaggccacagccgggctccccacccccggcacccagctctctacggcaggtccgggagggctggggcttcggggagccctacccgccaaacctgctgttggcccgggagagccccagaggctcccggagactgcagcctcctgtggttgggctgggagccggcagggtttggggtgtgggcgtccccaccacgcatagcaggaatggcaggaagggacaaaagcctgttccagagaccctgggaggaccccaggcagggagagcccgcctgcctccaccctttccaacgagccatcttggtaactgggaacaaacacaccccaccccgtttttccttaaaagaggccttaatccccgagcccccgctgccagggcagagggaggagggggcacagctgtgccaagcccggccccactggtgtgtcctcacaatgtgaccccagaaatgccagcagggaacggaggctgctgcagagatgcagccccaggcagccggggctcctaggctggtgcagatggtggggttaaacgggctgagcgttccaggtaaactgaggctcggggaggggaaggacaggctggcctctccttcactgtccacagggccttgggttccctgagctgtccagaccccaccat

SEQ ID NO: 12466 - DNA, 37385 bp, Human
tagacttctaaagtgtatctagaacctgtacacttcattttttggccactgccactaccctaggctaagccatcaccagctcttgcctgaattgctgtcatagcctctaatttgttctttacttcagctcttgccctttcctagtctattcttcacaaatcgattagattttttgcaaacacaaagccaatcatgctgttttcctacttaatactctccaattgtttcctatctcatgctgaagaacattcaaattcttcatcatgacttctaaggcctcatggtctggcctggccctctctcaaagaacatctcattctgctctctttaccaccacattctggtcacactggcctccctggagatttctacctggctcaagccatgcttctcacatgtaattcttctgcttggcactctgccaactcttccccgactacatctttgctgagcttttggtctcatctgaaatgtctcctcctcaaagaagctgttctatacaactccatctaactggagttccctaccctgctgtgcacaaatttttcttgatcacttcacccttttaagtagccttcatagacttatcactattgataattacttagttgttgtttactttatatcatttattttctccatcatattgttaattctgtaaaggcgcaggccatttctgtttgttccttgctgtatgtgatgcttcataggtatgtagcataggagatcctgaatacattttctgtcatccttaccctgactttatcttacctttttgggtttgttttccttatgttcttgttttcttactttgtattgaaatgagagaaaaactcacaacccccaggctctactcaaggttgggggccagaggaggtagagcttcctctgctcctgtctcttccacccgccatccactcactcgccattagtactgtgtgttgtgggcaaaagaaaagctttctactagtgtttcttcccagggaatgtgggattcatcctggaatgccaaaataaggatgaattgtctaaagagaaaaccagaatgcctttctggaccaaagattgaaattgctctgcctaataatgtaaacagtttattttcactgactgggggcagagtgttccttagcgagattaatatgatactagctgcttttttgtcttcctctggcaaaggctagagataacaaaaattggggttctagactctagggaggaaggacaacattcacagctccatttgtaggaggtgaggagggcccttgagaaaagtggggtgtgagcgagtataggacattcaggagagagatgatcagtaggggacaccctgggagaaagagattctgagctcttttcttttctccggagccctgacccttgagcagtggcacacagagtgtcttcctttattctctggtacagtagtcatgtttcttggcacagtgccttggaccttccatacatgctttcttccctccagagccttcgtctaagatgctggagagtagcttatagcctgggcatcaagtttgtcgattctccccaggacccttttctttataggtgccacatgtcatgatttatgcacaaacatgatttgcctgacagtgcagtctgggcctggaataattttaattaatgggaaaatggtcctcaatacaccgattagacctcttcaggtacaacaagataaaagcctgataatttggatggagtactcttcttaaatatctactctgtgcacggcagccaatgggaaagccaggctctctcccacctgatccaatgagtaattaagagagggctttttcttccctacctctcccctgcctccaccccgctccccaactaaagcttaacaggttggtggcataatgtggagacttttaaggggtgtcatcctaggagcttaggcaagagccagggtatcttctctccgctccccaagcactgttcaagtgggtttgaaaagcaggcaagtgagggaaggaagaagctagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcaggtgagtttatctgccgccccgcgtgggctggcagggcttggcaggagagatgagaccccttgaatattgaagaggctgccgctcttcactcagaggcggcgggatctgattaaacatgcttacaggaacgactgtctccaatggctttcctccagccaacttaattaatttatctgagatcatcagaggatgaagccacctgtcttatgtgcattttaaatggagaaattctggggaaattaccataaagtggggggcatgccccattgggatgggaaaatggacttaaatgtcagaaaataatattaatttgtgactagctgcataccctatcgcagacctgagccccaactccgtccagataaggtgaaagacaactttatttggaagctggatgatctcctcctaagtatagcaaacttgccagaaatgtttggctagttgaagattggaagcaaaagggcaaatgtaaactcattgcctatcacttcatctgcttccccgtgtgtgtttgtggtgagtgttcatttgagattgtgtgtgtttgtgatgatatgaaagctgttgcagtaatagtgaatgaaaacatattattctgctttagagaaaagaagatgccttctttcttatcagtgcaacaaatttagggattaactgaaactgatctctggtggcatttctcagattctattaaacctagtctgctaaggggctgtccaggtaatattagaagatttcacttcgtagaggagacgcaaatattttgaaacaaaatctcaccgctcgcagcttggccaaactggctccaacattcagctggtgttcacatagcttttcatacacatggtcacaaaagtacaaaatgctgaaaggcattttcagtaggcttagttttggctgaactctaattatgacaccctcgagagaattctgataaaagagaagagccgaggccatctgaacttctttctgtcaggcttttgtccttgtgcaaagtgcttccgttcctgatgtctcggttttctatattttaataaagcacagtatagaaaatgaactatttcttgtcaatcttgaagagttatgaactcgagagctgttacatggcattaaaatgctttctaaaatgaaagccatacctgaattagggcatttcaagaaattgcgattataccagtagcaggaatatcaaccttgcttgatttttatattttctttctcaaaatgggttccacacttatttcatatagatttattgcttttaatattgttactgtaattatagttccttctcttgacctgtatttacacattatttttagcttctttcatagaagaaaacataaaacatagttttaatttcacagaattacaccaaattcttaattggatttagtctctgaccctttaaaaatgggcaaagatgcaactgtaaaaattttattatatctgattataggtagaacattctgcttatttttctttgtattattggatactaattacagtaatacctagccttatgctattgattgggctgtcaaattggccatttattaaagtaaaaataagtacaattaccaagtcaatatatggttcatctatttcaataaggaataaataataaaagtttctgaaaccatgataaattccaatttaataatatgttacattggaatgtacttttaccatttaagaaaagttttatcttgcctttttattgcctatgtaattttcccctatatttaaaatgtaatattcttcacatcagcccagtgtggtggtgtgctcctgttgtcccagctacgcaggaggctgaggcaaggggtccttgagcccgggatcagtctgggcaacacggtgagaccctgtctttaaaaagcaaaatgaaatccttcatctttaacgtcatttaatattagctacatgaacaatattctttgtagaaaaagtctgattgcggtgaacttggctgttcttatctatggatgtcctgctgtgtttgccgtcttcctatagatgaaatctttttcttaaattctcctaagctctcggagccctttagggtcaagattttgccaggagatagaaagtttcctttatactttgattaaagaagggaagacaagtccataagaaattgatgtacttaataatgaatgaacttggtctgaaattacccccaacctcttagtttctcagattaaaccattagtcacactttacctttgttaatatagacatctttcttgcttcatcttctttactcccttcttccttctctcttttctccctaactatttattcctctatgcctcctttctacccattctcctatgtctatagactctttgtgtctccttcaaatccttgccctccacatcaactcccgcacctggtgcaggtagatttgtggcccttccctgtggagaagaatgttcctggtatggttacccagtcctagcctttttcattcataatgtcacctgggccctttttcattgacattgtcaccttgactttttaaaaaagcatcatttggggtggtaactcctatacacttgaggtctcattgttctgcactaaaatagcaaatcttgaaatagcgtaagatgggccgatgaaagagtgaaaagactcattgtcaagtggagatctactttcacatatataaataggaagcttgcctctgacattgatcagaagctgtaaagagaaaggcttttctctgaaaaacacggaattatctccagaaactgggatcctgatgttggcctctcttctttcgttccttcctttctctctctctcttcctccttttctttctttctctcccctcccccattctactacttcatttccctttcagccttttcttcctccctctctttttaaaattgaaaactttcagttattcatagttaatagtcctttagatataacagtaataagtataatacctccttagagctcatttgagtcatctctagtgtatccagccagtattccctttcatgtccatcctttaagctggaaacttatactttagtttgcagaaagaattcatttcagacttcagaggttaataaattaaattgcttgctagcatggcagctcatgtctgtgatcccagaactttgggaggctgaagtgggaggattgcttgagcccaggagtttgaaaccagactgggcagtatagggagacttcttctctacaaaaaatttaaacaactagccaggaggcccaggtaggttgatcacttgagctcagaagttttagaacagcctgggcaacatggagaaaccctgtctctccaaaaaatacaaaaaattagctgggcatggtgacacctacctgtagtcccagctacttgggaggctgaggtgggagatcacctgaccctggggaggtcaaggttgcagtgatcacaccactgcacacgagcctgggcaacagagtgagaccgtgtctcaaaaaaaaaaaaaaaaaaaaaaaaatcaaatctcttgcttttgttttctttacttgtaacattttcacctaaggggaaaatgccatatttcttgtcatcataaaataagaggtgggaattactaagtttaaatttgccgattagtttcgatgattcaccagtgcttgatgattaaggggtattggtgcagtgccactgagttgctgttcatagtctccagtaagggcagtacaagagaggagaaaagtaaagttgcacatcaggccaatacatttccatgtccctacagcccatgggtatttttctctgaagtttaaaattacagctcaagaagatcatatgtatttatgtaatctgcctttaaccaggccaccttgcttccctaatgctgttgtttttttcccttcgtttatttatctttaattgacacctgttgctattcttatgcctgctcaccttcacataaatgtcagcatccatgcaccatgtatgtcacacacacacacacacacacacacacacacacacacccctctaaaagttctgatgagtatttgataaatagtagagttttgaggagagatggaggaaagtgtttacaagtttaactttttgaatttgcttttaactctctgctgttccctcacctgtaaaatctgcctcatctctgcccctctttcttcttgcaaacctcacttctcatagcctcctccagcagcactgacttctggagattccctgtcagtgaaataaaactggaaagctggtctcataataaaagcccaacagtttatgggcaaagcccaaccacctgtggttcttcaggtgtggttttcttgaggagtgcttatttaccctgccacattttcctctctttctctccaaggaggctttctctccagggtggattaagtgaaattatgctgttacttagggactgatttacatatttcttatccctcacactctgggtttctctatgttagctacatctaggaaaaaaatggggaaaaaaatcaccttgattggaagtgcagttaattcctgaaaataaagcctgatcacgagtggtaatcacagatcaattagttactggatccctagataatgcatccctgtcattgtgagacaaaagaggggaaagtggggtgggaggaggggaacttggcttggaggcagggtgagttccattcccagttacaagaccttaggcaagttgactgacttttatttattcctcattgccataatagggaatgtattaaaaaatgtattaaaatagggaatggattaaaaaatagtcatttctcagtttatttacgtagtgataaaaacaaaaaataattataaagttcttggcaaatgcaatactaaagaaaatagagcaattaatcattctaccatttcccagatatgtcctccttctaagagacaagacactgtgacttctttgtttttattaacagctttgtgatgatataattcacatgccatacagctcatccatttgaagtgtatagttcagtggttctcagtaattcgcagagttgtgcatccatctccacaattaattttagaacatttttattgcttcaaaaggaagccctgcgcccttagcagtcacctcctctggcaaccactaatctactttctgtttctatagagttacctatttcatatcatggacatttgatatcctgggaatcatacaatatgtggtcctttgtcaacaacttcttttacttagcgtaatgtggtcaaggttcatcaatgttgtagcatgtatcagcacttcatcttttttattgacaaatactccattgtatggatataacacattttatttatccttcatcagttcatggacatttgcatttttctacattttagctattatgcataatgttgctatgtacctctgtgtacaaatgtttgcatggagctatgttttcatttttcttgtgtatatacctaggagtggaattgctggattattgagaaactgtatatttaaccaagtgaggaactgccagagtattttccaaagtggctgcatcattttacatccctgccagcaatgtatgaggattccaatttctctacatcttcaccaatgctttttattgtctgcttttcatattgcagccatcctagtggccatgaagtggcatctcactgtggtttggattttgcatttctctgatggctgatgaggttaagcatcttttgattgatcatggcttctttgaaacatcaggtacagctctgaccatagcatgaaagatggaaagccattacacattttcttattctggaacgaaaagtcatgctacactctttatgagacctcacataatatagttgagagagttaagaggagggcactctaacctattagcagtgaggataataattggaattttccccttactttgcctcagccactttggtcttctcttttagtttctgaatagagtggggctatttaaatctaagggccattgtacttgctatttcctttgcctctaagtgcacctcctctaacattttgcatgagtcattccttctcattatttaggtcttagctcaaatgtcacttcctgttcagatatggctaaagtagcttctcatcctttagtctccttctgtgacatcatgcattttagttccttcatgtcactcttgcaatttgaaatgattttttttttaatagagatggggtctcgctaaattgaccagactggtctcaaactctaggcctcaagtgatcctcccatcttggcctctcaaagtgctgggattattggcatgagccaccacacccagccccaaatgatcttacatgttaagaaacaacaaagatttattgacatgtttgttgcctgacttctttgttagaatgtaagcttcatgaacaagaagatactgggtctgcaatttttgtcattgaattcccacctagaacagttcctgggatagagcaggcactaaaaaaccatttgtcaaatgggcaaataaatctctaagtaggtattaagatttgggaaaactttgagggggacttttcctttcactgtggctcaaccatgttagctttgagaagctaataagaaaggaaaagagagtaaaaaaaaaaaaaaggagtagtgaatgaaatgtaatgtgtgctttctgagtcccagtttcctcatctataaaattggcataataacctccttgtgggtgaagtaagacttaagttgtatttcacttaagtgaaatattcacctacgcaaagtcctaggtgcagagtaaaactcagtacagccatcccttggcatccgcagaggattgtttccaggcccctgcaaatatcaaaatctgaggatgctgaagttccttatataaaatggactagaatattttgcatataacctatgcacatcctcccatatacttaagttatttctggattatttacaatacgtaatacaatgttaatgctatgtaaatagttatgccatattttttttttgtattattttttattgttgtattatttcttttcaaatttttcaatttgcatttggttgaatctacagatgcagaccctgggaatgtggaggcctgactgtacatgataactattatcattagaaaaacaatcttgcggttaggcactgtggcttgcacctgtagtcccagcactttgggaggctgaggtaggagttgagcccaggaatttgaaagcagcctgggcaacacagtcacacacctttaaataaaaataaaacaaacaaaagtgtctcgccttaagtcatttcttaaatcataagtcagaactttatgaaacatcctgacatttcttatcatgaagacaccagccatgctctcatgcttgaacaattgcatcattactctggcaatttagtgcatgagtaatatattatatgttttatgagtttttgttcttacttttatgtgtactatatagtcttattgagaaaagttttggtactttttttttttgagacacagtctcactctatcacccagcctggagtacagtggtgtgataatagctcactacagccccgaccttccatgctcaagtgatcctcctgcttcagcctccccaatagctggaactacaggtgtgcaccaccatgcctggctaaattttgtattttttatggagatggggttttgccatgttgcccaggctggacttaaactcctttggtactttttaactttagtatgcaaaatgacaattatacacatgccactcttgtgttttctttaaaataatataaaaagtaaactttagtacttcagaagaaacactggaccagaacacagagaccatgtctccatatacctcgtataaacgggtctgactcctggctgtcagaataaccctatatgatccctagaatcatttctgatgcccacttttatgattctttgcaaacggcatttgtgttctcaggatccttctgttttctacacttggccaatattattaacataattgaaaacattaaaatatatcgtaaaagggaatcgtttaatctgatagtaggagaaaataaaagacaataatccttctattgaagaaagaacaaaagaaaatgcaacatgaagattttacatcacacaggcagccgccctagaggaggtgtatcattttagttaatgtaaaagtgcaatcatctcactaagggacgaggagtgttgaggtggataatgcagttctcagcgaagacctggatttggaatgcatcgtctgatgcatttttctccctagaaattttacttaatttatatacttgtcctagcctcccatttaaattaattttctctccttgaacacaccaacacagcctcataaagttgttgtgaagaactcactgagttagttcatgcaaagtgcttattcccatgcctggcacctagtgagtgctctgtaagtgttggccgtattaccattacacccaagcccttcggctggcctggccttgctttggctccaaaatcttaccttaggcagtgactttggagttggaatcacaaaggacatcaactctgcctctctcctgcctagcaggcagaaactacttctctgtgctgtttttctggtgatatgaagtctaaatagaggccaagcatggtggctcacacctgtaatttcagcactttgggagtctgaggcaggtggatcgcctgaggttgagagtttgagaccagcctggccaacatggtgaaaccctgtctctactaaaaatccaaaaattagccaggcgtggtggcacacatctgtaatcccagctactctcctggaggctgaggcaggagaatcacttgaacccaggaggcagagactccatctgaaaaaaaaagaagtctaaatagaatagggagtaactgctaatggccgtggggtttcttttcgggatgatgaaaatgctctagacttataagccagctacttggatagtttctccaaatatttgtgagagtaaacttgttgttattattctagcatgtagaagaaggatcgatgaatctagatctgcatgtctcaaagtgtgttctttggacacaaattctcataaaatgcttagttaaatgataatcccactgtcacatacatttagggtgtgcacgtccccacgctttcttcaaaaagtcccatggtgtacatgggtatgttaaaggccctgcctgaggcatcctggaggaaagaactggtctcactttgtacagttaagagttcctctcactgacttaacatgtaaccctgttcttgtttttttgagacagggtctcactctgtcacccaggctggagtgcagtggcaccatcacagctcactgcagcctctaactcctgtgctcaagcaatcctcccacctcagcctcccgaataactgggattaccatgcccagctaatttcttttttttttgagatgggggtgtctcactatgttgcccaggctggcatgttttgctataaatgctattactattattcagaaatagtgttctttgtgaggttgggaagggctggtcagtggcatcagtgtgccagtgggaaatctttgaagagagctttctgtggggatgtggcatttgatacatcttgggcttcaggttcctgttgtgtcaaatgactccatcagtggttttcagactttaaaacggagcatgttttaaagtgaaaccctagtattaaattcatttataaaaagaagctccagtagaattggggttgtggacttgggccctgtttatttggcctcctcacagggcattccgtggaaggtctcagtattgagaggcccctggacaaggtgagagttcctctaacgtccctcctgtggctaagtttctgcctttccttttagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcaggtacgaatgaggcgggcaggcctggccacccgctccggcctccccacaacaccaatcaagaaatatcaagggtgcatttaggcaattagaggtgtcctcaccagcctcttctcccacagaagccaattattcccgggagtccaaatgtaaacaagaataaacagctcttaattggtgctttcagtttttaatggacttcctgatgttaagagagtgagagagcagtggtttacttaatcaccggggcccttttcatagtttcgtcttgtgtgctgtgctttttacccagctctaggagggagatgtttgtgggtaccagggttttgttagtccctctccccttttttagtataagtggcatgctggcaatagacaaataccttcataaaaagctgcttctaaatgaaataattactacctccacttgggcattatgataattatcaatagaatattgaatcagctttggtttttcaggaaaaaaaaatccaaacaaaccttccttaaacaaggaaggttttatttcaggtctccaattagagtaaacaagcatttggggctttttcctcttgttttctgtgttaggattgtgaatactagtctgctatagaaggttgctagttactttctgtaatgtaggcagtttctggggattggagacacagatgggagtaaagggtctggattcttctctttcccacctgcctgtttggctttccctcagcctcccaccctgtgcccatgtgccccttctctgatctctgtgctcagatggcagggaccataggagttcatgtgtccagaggtaacactacccgagtctgtgatactcagaagcttccagttccttattaaaacgggaaattgaacagtaaattgttactgcctaccagatttcacagcaggagactgtcattacacctttcatttgactcagagagagtgtagccatcagatgccagattttgccattctttagtcacttggaaaatgcacccattgtcagcattttgagttattaggattcctcaaatgaaaaaaaggcaaacaatatattttgatggattgaaatccacactgttgtgctgaaaataggggaaggaaaaaaggaagccaagattttggcagaaaactgaacactcttaagaataactcctcagccgggcgcggtggctcgcgcctgtaatcccagcactttgggaggccgaagtgggcggatcacgaggtcaggagatcgagaccatcctggctaatgtggtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatagcgccactgcactccagcctgggtgacagagcgagactccgtctcaaaaaaaaaaaaaaaaaaaaaaaaaggaatagctcctctctgacaacccacccctcacccttgtaaaggcttcaatgttatgcttcctggagcttctggaaaattcccttcatttgtttcttagaggtgtggtggcagctcaggtggcctaggatttgaaatgtgtgtccctaaccggggtggtgctaagcttgggaccaactggagatgctggctcctttatcacctgcgatacacggggctttgcttttctcctctttctcttctcctgcctcgacagataatgttgaattctctgcataaatatgaaccccaggttcacatagtgcgtgttggaagtgcccatcgaatggtaacaaactgctccttccctgaaacccagttcatagccgtgactgcctatcagaatgaggaggtaagagtgtgtgtgtgtgtgtgtgtgtgtgtgtgtgtgtgtgtgtgtgtaactgtcacctgggagatcatggcaggatgggcggggggggtccttttagatgaaaggtgggttttccaggatttggatacactcagcagacatgaagttaaacaatggagtagctgctctccctccctcttggctgtttgctaaaggctcaccagcatgtgctctcctggtgccaacaaggcacagctgtgcattgtcatgaaactcctgagttctgttgaaactctggagtctttgttgtcaggaccctatgtgtccttggcctgtgcagagctgagtgtgtcttgagtgggtacaattgggcaggagctgtcaggtctcctgctctagaagcaagtctgtagcaagtgatccaaacatgcaccctcccttgggttttattatgctatcattactgcttgttaatgttcaatatcagcacagttagtctgctgctgcccagtgacttgagccgcctggctgtgagggctgagtggttagcgcctggcctgtctgtgagctgctttgggtccgttcacatgatctgctgataatcagaagaacccagggagggttgaattctttttgattaaactttaaaaaaattttttaaagacaatatttatttatttaaaaacacataataaactgacagtacagaagtatataaagtaaacatgaagactacagggtaaagctatacgggtttcttccgcttttggaaactcactccccatggacacgacgaagaataacttagagtgtgtctttttgacaaattttctatgtatatgtaaatatatatgtgaatgtagatttcctcacataaattggctcatgttgtatatattattaatctgcaaatttctttttcctcagtttaagggtgtattatgattacctttctatgtaattatacctaggtatatctccttttctgtagtgcctgcagaatatttcattgtatgaatacactatttcacgtaatcagccccccaccaatggacatttaagttgtttccaactgttttcttttttttttttgagacagagtttcactcttgttgcgcaggctggagtgcaatggtgtgatctcagctcactgcaacctctgcctcctaggttcaagcgattctcctgcctcagccttccgagtagctaggattacaggcacctgccaccacgcctggctaatttttttttgtttttttttgagacagagtctcactctgtcacccaggctggagtgcagtggtgtgatctcagctcactgcaacctctgcctctgagattcaagtgattctcctgcctcagcctcccaagtagctgggactacagacatgcaccaccactcctgggtaatttttgtatttttagtagagacagggtttcactatgttggccaggcaggtctcgaactcctgacctcaggtgatccatccacctcggcttcccaaagtgttgggattacaggtgtgaaccaccgtgcccggccctttattttctattatagataatgctgcaatgaatatcctggtgcatctgtcatttgcttgcgtgggtgaacacctagaaacagatagacatggccaaattgcttccctcaaaatggcatctctatttgtagccccaacaccatgatcaacactattatcaatctttgtcatctttgacactctaataggttaaaaaaaataagatcttggccggacgtggtggctcacgtctctaatcccagcactttgggaggccaaggcgggcagatcatgaggtcaggagttccagaccagcctggccaacctggtgaaaccccgtctccactaaaaatacaaaaattagctgggtgcagtggcgggtgcctgtaatcccagctactcgggaggctgaggcaggagaattgcttgaacctgggaggcggaggttgcagtgagccgagattgcgccactgcactccatcctgggtgagagagcaagacttggtctcaggaaaaaaaaaaagatcttgttgttgcttccatctatatttatttggaagctttaaagacagattttgggctgccactcagccaactgagtcagaatctccaaggatgatgctcagattctgtagatttaaaagtctccccagaggattctattgatcatccaggtttggaagctactgtcttgtgcctacaggtgaaatgaagttgcagatttaactcacatcacagatgtgcagagaaaatgtcatttctataagtaaactggcctcttggcagagcccctgcagccagtcaatggaaacagaaatgaactagctaataatgtaaacagtccctcagctggtggccagtctttcgatgataaagtaattccattttgcagatagccctctctcccagcttttctccctgggctggagtctgggtctatgaggggaggtatggcctttgtaactctgggaaacggggtggtggggggtgcatgtggaattggagaccatgtcctaacctcctctggtctcccggcaaggcccctgcccactggtgtgctgttggtttagttggtggtgtgcggaacttgtcatttggctgctgacttggtaaaccctcagaagcttttcctggctgcaggtgctggacagttctctttgaaccacctgactggtcatttttgacccatccagcaatctcccggcctgactcgctactcctgggtcttgaacatgctccatggcaatcaagctctggaaagcctagccccagtgcctccctctgccaacaaagcttccctgccaagtccatgcagatgcaccccgagtggcgagtgggcgtgggggtgggtgaaggaggccagtgtttcctttgcaccccctgctagcttcttgtatgcttttctacctctccaggtttaagccaagagaaagaccaggttgtacctatctgaccccacacctctttttcctctttctcctgatttcttctcacaagttctgagccagaaggagttgggctctgtattagcccattttcacgctgctaataaagacatacctgagactgggtaatttataaagaaaaagaagtttaatggactcacagttccacatggctggggaggcctcaatcatggtggaaggcaaaagacacatcttacatggtgacaggcaaagagaatgagagccaagagaaaggggaaaccccttataaaaccatcagatctcgtgagacttattcactaccacgagaacagtatgggggaagctgccctcatgattcagttatctcccaccgggaccgtcccacaacacgtgggaattatgggagctacaattcaagatgaaatttgggtagggacatagccaaaccatatctgggtcttattttgctttccttcttccatcaagtctcagatccttgctgacataaatattctgtgagctgggtgtggtggctcatgcctgtaatcccagcactttgggaggctgaggcaggaaaatcacttgaacccaggtggcagaggttgaagtgagccaagattgagctactgtactccagcctgggagcaagactcccgtctcaaaaaaaatatatatatatgtgtgtgtatatatatattctgtaaatatttatttactcaacaaatatttgctgggcattactacatgctggatattgttctagatgctggaaatactgcaatgaataaaacagatgaataccctgtcttcaaggcacttacatcccagtggggagagatgaaaaataaatatttctttgtctctatctatctgttttatctctatcacgatcactatctatctatacgtcagatgtctctaatgagaaatgaagcaggctcaggctaaggcagatacagagagtgacagtgaatggcagtgatagtttgctttttgcattgacatggccccatgtgtaagtgattatttatgaatgagggactcgatgctagatggcactcatccagaggggcaggatcacacctgtgctgctctccactgtgtaccaagtaactagaaaagtaaatcacatgtagtaggggatcaaggattgttgaaaaaaataaatacatgagtaaaaaaatgaatgctaggtttcgcacatcagggctttgctcatttccagtgttttgccctttcttttctcactttacatggcattagcattttcaccacatgcaatgataaaatgtcctttgccagagacagcgcagtggtgattaagtgctggagtaagcaaagatggaaagggcctctgcctctcagagtgctgggattacaggcataagccatcgtgcctggtgggaaagggaaggaaaagagagggaattaaactggttttacagaagacaaagggttctgtttgcccatgtgtatcctacttttactaacacttcttgtctttgtaaatgcaagataacggctctcaaaatcaagtacaatccttttgccaaagccttcttggatgccaaggaaaggtaagtaaagaaattttagtgaaatcttctaatgaatgatttatgcaaatacaaatgtggaatttatgattatcttgaaaggaactagactagtagcactttcattaccttttatagaaataggctttcggccaggtgcggtggctcatgcctgtaatcccagcactttgggaggccgaggcgggcagattacgagatcaggagatcgagaccatcctggctaacatggtgaaaccccgtctctactaaaaatgcaaaaaattagccgggtgtggtggcgggcgcctgtagtcccagctactcgggaggctgaggcaggagaatggcgtgaacccgggaggcggagcttgcagtgagccgagatggcgccactgcattccagcctgggcgacagagcgagactccgtctcagaaaaaaaagaaataggctttcaatattcaattcaatattcaacaacatctagaaaattcaaatcataattatctattcgttataatagggatccgggagaactgttaactaacaattttttttaaagacctgttttactatgaattcttgaaagtagcacaatcacattaaaaaaattaaatgatttagatttataataattcactctgcctttttcctaattacttctgagtagcatggcattaataaattgcttttttaaaactacatttagcctaggaaaagtgaaaaatggagacaggttcacatttcctctgctgagaaaagaagtcggagacttctgggggtatgagtgatgattctgctacttcggggcagcgacctgccatctctatatcttttctttcttccttcctttctctcttttttcctttctttctttcccttctttccctttccttcttttccttccttccttctttttctttcttcctttccttccttcctttgcttccctcctttccttcctttccttcctagctttccttcttcccttcccttccattcccttcccttccgttccctccctcctctcctctcctcccctccctccctccctcccttcctttctttctccctctctttctttctttctttctttctttctttctttctttctttctttctttctttctttctttctctctctctctctttctttcattcttccttccttctttcttttttttttttgagacagagtcaggctggagtggcactatcttggctcactgcaacttctgcttcctgggtgcaagcgattctcatgtctcagcctccctagtagctgggattacaggtggccaccaccatgcccagctaattttttatgttttatttttagtggagacagggttttgccatgttggccaggctggtcttgaactcctgacctcaggtcatccactcgcctcggcctcccaaattgctgagatgacaggcttgagccaccgtgcccagactctatgtcttttgcatcccaggaaaaagaagatgatggtgcttatcactgactttttaattgacaaagcctacagtataatatgattatctttttaatgttcagattttattgcttgagtttcaaatcttttaaatagtttttataactgtctaatctttcctgttcaccttaaaggctctgataaggctctagattaatggacagatgttcataatgatgcatcacatgaccctgtcctgtccaatatttgaatatattattattattattttagagatggggtcttgctctatcacgcggactggagtacagtggtgtgatatagctcattgcagccttaaattcctgggctcaagctatcctcctgcttcagcctcccaagtagtggggactacaggcatgtgccaccatgcctggctatgtgttttttttaaagagacaggggctctcagtatgttgcccagacagtctcaaactcctggcctcaagtgatcctcctgcctccgcctccttagttgctgagattgcaggagtgagctactgtgcctagctccaatattggaataaattatgatgatatacaagacacacttataacgttttcagttaacaaaaggcctaaaggataaactgatatgtgagatgacacaatctagattcaaagtgacagtagcatggtataatacaaagaatttaggactttgagtaagaggtcctgactgaatccttgctctgtaatttactggctgtttgttcttgcataagtcagtttacctcctcgagatccacttttctaatctacaaaattagaaaaatatgttaatatttccctcacagggtcattggtggatctagcatatcacatatgtaattgtgccatggaattgtgctgttattattgcttgaatcttgtcagtcaggagcaatatccccaaattattcagatcaaaataaacagggatagctgtaaatgtggtaaagaggggtaaacagtaaaactgcaactccaagagcaattgcacaagtagagacagcaccccgaaggaaggagaatggggaaggacaggagcttaggaaaaaggtgtttggttttcttattctaagaaattgattgctcttcaaggagaattttgggtatgctttatagtggacatacataaaaagttggacagccatggtgcattttctttactctttcagaaatcacctaagagacgtaccggaggctatctctgagagccagcatgtgacctattctcactgtgagttgggtgtacatgaggcgggaggtgcgtggggctgtacctggagccagctccttccacactcagactctttgcctgtcaggactgcttaaggacttccaaatcaaaacccaacacacagtttattctattaaggacaaatttgtgccctttccagaattccagagagagagccaatggtcctaggcttaagagacttaaaaaaatcttaggcaggagataagaatgaaaatgatgaatttcttagactctggttttcttgtcagtaaggctctgagccctcaacagtgtgttctcggcttgcctcctaacgttatgcttgccactctggtctctctgttttggagttctcctgttcttagtgtttgctaattttggagttggttcccatagcaatgtgtcatgcaggctgtagcctccatggggaagagtctttatttgtgggctggaaggctgtaggaagaggtggagtaatatagctgggattctgaaggtagtgttggatgttcccatcagggtgttaccttgtccatgtcccaggatggtggagggaatcctctgcagctgcaatgcaacccacgatcagtgacatcagagtaggaaagttaaccctgatgtctgaaaccctctttaatttggattatattggcttgcaaagatcccttatgcagtttgccagctgcagagttctttacttcttccttcccttcaatcttactgcaccttccataacagacctgggagtatagccgcataaagagaagcagctctcagaaaagcactcttttttttttgagatggagtctcgctctgttgcccaggctggagtgcaatggcccagtcttggctcactgcaacctccgcctcccgggttcaagtgactcctctccctcagcctctcgagcagctgggcccacaggcatgtgccaccatgcccggctaatttttgtatttttggtagagatggggtttcaccatataggccaggctggtcttgaactcctgaccttgtgatccgcctgcctcgacctcccaaagtgccgggattacaggcatgagccattgcccccggccgaaaagcactctttaaaaatgactgtcaacctaaatgaaaaaactgaggcaacattaatataagtaaaaagtttatttgggtcaagtttgaggactacagcttgggagcacagattcaagttcccctgaatatatacttgggttagcagcagttacaagtggatttttaaagggaaaaataagaggtgattcataaactgtctactgtaacatgagctgctgattggttatatattgttctttgtatcacacattccaggaacgtgaagataatgggtgaggcagctagtcaggaacaaaaatgcctttaaagaattgcccccaggcatgggtgcagggggtgcccttgactgaagctgctcctcacactcacatccctctgggtctgataaattttgcatgcctcacataactcagactgttctgagctgtttttcttttatcacttccccctcagttttttcctttaggtggaatgaactggaataaaaacctcgttttctaggttagggccatgtgcagaaccataggagttcaaagttcatgtgttgcaatcttctcagcaaacttcttgaggtgtgtacattatatgtggcaaagtctggttctgaggggccacttgcctggttttgcccgctgggtgcatgaatcttgattctgttagtcagatggggaccccttgggccataagtttgtgcaactctgggaaaatgaagatgacaaaaggatttgttgggaatgattgtaatatgaactttgtacaatttgcttacttgtacttaaaaagtattaagcgaaggcggtgggttctaatatcaagctccatttcctcattgccgaagcccaggtgacaatccttagccaatgttcttaaggaacagctctgtttctatctgaatccccatccactgatcccttagctgaggcatggtcagcgggagaacaagcttcttgttttggggcctgcagtactaagtctcagtctttgcccataaactcactcgaaatagtcttctgttcagaatctttctacaaaacattttgcagtcgtccaaaatattctgcaaaatgcttgctgcctgccagtaaataagtggaatgaaaaagaagaaaaaaggaaaaaaaccccaaaaccaaaaaaaaaccccaaaatgcttgctgtcaagttgtgctaggccagctctccctttctgtgctgtcagaattctctttgtggggtggggttggaaggcatcatgatatctcttgcttagagtgagaactgaaggcaccttcacactcggcagaaatagagaggctttcactcttcctgcgtaaccacattaatcattccctaccttccctggtagctgaaggtccatgagttacatatacgtgtaatgcctcctagactgccttttattttaattaagcctgaagcaccttaactttgcatttctattaacttctgcattcagatagtatttctttttatttatttatttatttatttttgttatactttaagttctagggtacatgttcacaacgtgcaggtttgttacatatgtatacatgtgccatgttggtgtgctgtacccattaactcgtcatttacattagatatatctcctaatgctatccctccccactcccactaccccacgacaggtcctggtgtgtgatgttccccttcctgtgtccatgtgctctcattgttcaattcccacctatgagtgagaacatgcggtgtttggttttttgtccttgcgatagtttgctgagaatgatggtttccaccttcatccatgtccctacaaaggacatgaactcatcgtatttcatattgctatattccagtgttgctttagaggttttccaccctttgatagagtcctttgataggactgtaaccacctgataggttcttcctgctggttgcacaaaaagatgttactgagaaggggtcctgatccagaccccaacaaagggttcttggacctcatgcaagaaagaattcagggcaagtccacagagtaaagtgaaagcaagtttatttagaaagtaaaggaataaaagaatggctacttcataggcagaacagaggcatgggctgctcaactgagtatacttatagttatttcttgattatatgctatacagggggtggattattcataagtttttcaggaaaggggcgggcaattcccacagctgagggttgatttctcccctttttagaccgcatagggtaacttcctgacattgccatggcatttgtaaactatcatggtgcttgttgaagtgtcttttagcattctaatgcattatgattcgcatataactagcagtgaggataaccagaggtcattttcattgccatcttggttttggtgggttttggccggcttatttactgcatcctgttttatcagcaaggcctttgttgtatgttgtgctcacctcctatcttatcctgtgactaagaattcctaaccacctgggaatgcagcccagtaggtctcagcctcactttacccggcccctattcaagatggagtcactctggttcaaacacctctgacacaaagaccacagcgttgcaataaagaaagagtttaatagacatgaatctggccatgccattttggggacagagctcttactcaaatcaatctcttcaaaaacttgtaggttaggttacctttttcagaggcaatttcagggaagaagtgggggtagctagacaataggtgcttgctgctgattggttggatcagagatgaaatcacagggaattgaagctgtcctctggtgctgagtcacttctgggtggggccacaggtggggttggtgggtccaggtggagccactggtgtcagatatgccaaaaacctgaaaagatatctctaaaggcctatcttaggttctacaatagtgatgttatctgcaggagtaattgggaaagttgcgtatattgtaaagtctggaataatggctggcaatcatttgtgtctacatcttagcagaattcaggctcctctatgctcctagcctggtagtctttcattagctttacaaaggcagttgagttttagagaaggattactattatttaaactataagctaaatgtctcccaaagctagcttggcagcttgaaggctaaaggcaagagggagattgggtagatcagaagtcttcaactgccaaaattttctcactgatacaatttttgcaaaggcagtttcaggactggtcatgcatttccagagaagccaagttagctgctcatgggcaagggcagtggcagctaggggatggtaccaccacacaggctggcaccatcacacaggctggcatcagtgtcatttacaagaattgtagctgtgtaaagtagctggtcacctgatttttggtgtgggagttcacagactcagtcttggtgtattcctcttgtctattttagtgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcaggtctgtgactctgctgattaaacccttggggtatgggctggggtgggggcagtcaggagaaatggataaacagctaggaaaaggagtagctaaagatggaaccccgtcatctaatatacatctatgatatgattgtttttgtgttttattttattgttattttatgtacaaatatttgattaactaggtataacaatcttagttttttttaaaaaaattatttcataaaacccccagtctcctggtttctaatgagcgtgaaaggccaggacactgatattctgagcagttcaggcagatctctaaaagccatgtcaagttgtgtgggtctgaaacactcagctcatcaccttcgcatggctcttttctatagttgcattcatggctcagttcagggaatactgggtctagcattagggaattattaggaaggtctctgggaagctggatccctatatgttcaggccttagtctgattcagttggagacatgcaaacccaaccttagtattttaaaataatttttgctgtctgtttgttttaagttagcagtattgtttgtgtgcttttttctcattgactattgccttttccacctttgccttatgtaggcccagaccttgcctgattattagatttgtagaaagaagggagaaatgaaaacaatggttactttttcattaaattattcatgcaacaaatatttattgaggatcgactatatgccaggctctgtttcaagcacaggaatgaaatggacaaatgccctgcccttacggagattctatactaatatgaaaagattgacaataaaacaagtaaagttcatggcatgggagacagtggagagtatttggattccagcctccttccttcctcagtgacaccctgagctctgcatttgtagagggtcctcctggtcaccagctacctgtccctgtgtcccttagcctgctattcttggcaacctcaacagttgctgccaggtggggagattatgtagcttaccaatagcagaaactgagcagtggctcactctacttcctcattctttcctgcggtcagcatcaaatcacatcttctgagcacctactgtgtaccatgttcttctaggcagtgggataggaaagtgattaagacatagtttcagggccgggagcggtggttcacgcctgtaatcccagcactttgggaggctgaggcgggcggatcacaagatcaggagttcgagagtagcctggccaacatggcgaaaccccgtctctactaaaaatacaaaaactagccaggcgtggtcgttggcgcctgtaatcccagctacttgggaggctgaggcaggagaattgcttgaatccgggaggcagaggctgcagtgagccaagattgtgccactgcactctagcctgggcaacaagagcaagacgccatctcaaaaaaaaaaaaaaaaaaaaaagatatagcttcttccctggaggagctcggggttacacaaatacgtaaataatgaatcctaatgtaatgcagaaacatcacctgggaacttgttagaaatgtagactttcaggctctactcctgagtcagggtctgcattttaacaagatcaccaggggattcataagcgctctagaatttgagaaacagtctataaaacacataagtcagggtgccatgtgaatgaaggaaaaagagcagctagatatgcctggtggaggagcaaaggctgcccagaggggttaacatttaaatggagccttgaaagatgaatagaaaaggacagagtgggagtgggcaggggtaaaaggtggaggatgacatgtgccaaaggcagaggtgcagggcattccaggtagagagagtgggctgagcaaagatacagaaaggggaaagaccctaggttgtctgggaacagctttggagcagagtgtagggggagtggggacagatggaagatgtaagagttagggctggagagcttggaagtgccagatcgtaaaaagaagagacatggccaggtgtcttagtcccctttgtggcgctataacaaaatacttgagattgggtaatttataagcaatagacctttattttctcatagtcctggaggctggggagtttaagattaaggtgccagcatatggtaagggttttttggctgtatcataacattgcgaaaggcatcacatggatggtgggggaaagagggggagagggcaggaggctaaacccatccttttatcagaaacccattcctgcaatactgacattagcctattcctgagggtagagcccccatggcctagtcacctcttaaaggccccacctctcaacactcttgcattgggaattaagttcccaacacatgaaccttgggggacacattcaaaccatagcaccagagatagacgttggaatcttccttctctctctcccttctcccccttttcccttccttcctccctccctctgccttcttcctctctcttatttgtatactatttatgcaaatagagattcaaagaaatggaagacattcttcccccacccccataaaaactgtatatattcaaggtgtacaacatgacgttttgatatacatatgcatagtgaagtgattactgctgtcaagcaaattaacatgtccatctcctcacatagttactttttttcatgatgagagcacctgaaatctattctcttagcaaatttccagtacacagtacaatattattaactatagtcttcagattgtaagttagatctctagacttattcatcctacacaagtgcaactttatatcctttgaccaatatctcatttccccagcttcccacccctggtaaccactgttgtactctcagcttctatgtattcaactttcttagagtccacatataagtgagatcatattatgttcttctttttgtaaaaaggtatgtttttttcttaattttttttttttttaattgtagagatggtgtctctctgtgttgcccagagaggtctcaaattcctgggctcaagggattcccctgccttggactcccaaagtgccaggattacaggtgtgggcaccatgccgggccaaaaggcactgtgcttgagatatttaaacctactcagggatggccgagaagaataagttcctggacctcagaaatctcatctggggcactggtggcccttaggcttagcttgaggggaggctggtatggtcccttcttaaaagagagtgactgtggtgaaatgagttagacagatcggtgttacccagggcaaatcattctaccaccctgaggcgtatctataagatggagttaaggagtcactggtgtgaagattaaactatgaatgacacctggcatatggttgacattgaggaaacccacgtttctttttattttctatttccctgagaaagaactaacaaactgttggtgcctgtagtgcaagccatggttatattttgccctaggataatgtcactggtcaccatctttatgtcttctacatttgctatcaattcaactgttgttatttccccaagtgaatttgatagaaagctcaagcaataatctgcaagttttctcgggacctgacagctggacttccttatcctccacaccccatgccagcatcctgtctgtaccccacaccaacggaccaatcaatccagggcccaggtaagaccaacaccatcaactcgctcattggtcgtcttgggggtttactttagcactggggactcaagttcattctttttcctagggtggcttggtctaacctattgtcttgacttctaaaacactaagaagtcaaggtggcaacagggtggagttctttcataaggggagaaacagctcagtcatatactgtttcttttatttagaaggataggccgggtgcagtggctcacacctgtaatcccagcactttgggaggccaaggcaggtggatcacctgaggtcagcagttccagaccagcctggccaacatagtgtaaccccatgtctactaaaaatacaaaaattagctgggcatggtggcgcatgcctgtaatcctagctactcaggaggctgaggcaggagaatcgcttgaacccaggaggcagaggttgcagtgagctgagattgcgccattgcactccagcttgggcaacaagagtgaaactccgtctcaaaaaataaacaaataaataaataaaaggataaagacattatggcctgggatcatttgtcttaaaccagtcagaaatactttaaactatggtggtagcaaatagatactgactgtagaggaattgaagaggaaaagtataaatatacactgagaagtcaagacccatgattgtccattttcccatgagtcacccatcctaaaagggggacatattgtggatgcctggcctcacgaccctggtaacagagttaagtgtagcatgggggaccccatggtttaatcctcacactagcaacctgcattaagttctgacttctagaaatctgagtggtgaagtgggaagagaaggcccctttgagtctgacaggcaggggtttgagtcccagttctacctcttagtagtgattttgtggctttgggcaattttcttagccttactgagcttcagctttcttatcggtatcatggaaataatatgacctactttgcagagttactgtgagcatcaaatgcagaaatgagaaaatgcattaacgtgctttgtaagcagtaacattctgtgtaaatgtcagctattatgttcaatatggttatgcagaattttgagaaggtccaaagtggattcaaaattaaaagatgaggcttggcggggtgcggtggctaacacttgtaatctcagcactttgggaggccgaggcaggtagatcccctcaagtcaggagtttgaaaccagcctggccaacatggtgaaaccccatctctactaaaaatacaaaaattagccaggcgtggtggtgcatgcctgtaatcccagctacttgggaagctgaggcaggagtatcacttgaactcaggaggcggaggttgcagtgagctgaggcactgcactccagcctgggcaacaagagcgaaactctgcctccaaaaaaaaaaaaaggatgggatttgggaagacatcagatgacttgtgatttgtaagtccagaaaaagttaggaaaggttaggagaatgtagtggcttagaatcacctggggttgttgttaaaatgcagaatctgattggtaggtttgggtgggggcctgagattctgcatttctaccaagttcctgggtgttgctgatattgctgtggcccacaagggtgtagagctgtgctgtccagtgcagcagccaccagccacctgtagttgtcaaacacttgaaatgcagctagtccaagttgagtgtaatactcacataggattttgaagatttagtgtgaaacaaagaataaaaatcccagttttttatatatatatataaaaaaatataaaatatatataccactatattacatatatttttatatttttaaatataatatagacttatatataaaatagataatatatattttaatatatataatttgtataaaaatatatattttaatatctataaaatatatattaaaaatatataaatatataaaaatataacagtatatgtaaatatagatgttattatgtaaatattatgatgtaaatatatacatataaatatatatatttacatcaaatgcatgttgaaataatattttgaatatttttgttaaataaaatattaataaattaatttttttctaaatgtggctactagaaaatttaaacttacacatgtagttggcatttatggtttgcattttgacgctgatctagaggatcatttgcatttgacactgatctagaggatctgagggaaaaacattgatttgggctgtggtaggaagtgagaaagagagtgaagatgaggttccctgaagatattaaacaatcatgtgccaagttgtatactagatacttacatatatataagtcatccatatataagtcatctgtagtactcaaagacaactataaggcaggtattaaaattcctattttgctgatgaagaaactgaagctcagaggccttaaaaacttcctgaaggttctgcagtaagcagtacctctcagagcccatggttctcccactggcccaggaggcatcagaaagggtctgtaagagataatgtagaagagcatcttctgaagattggggccagaatccccataagctgagctagctcagagagagctcagaggatgggctgctgaaggtttcatatggtccaaagaggcctgtagcattgaaaaatggcaccaggtgaaggatggcattgccaactctggcttccctgttggtgtgtttaactcattcctgactccataaatattttgttagaaacaaaacaaaacaaatgtattcaatattgccattggataataagcatattatcaagcaatacagtgttgggcaatgcagaaactctaaaatgtaagaaacatagtgatgactacaggccgaaaacattgggttcattgcacctgttccaactgcatctatattaaggtgcaagcttggctgtacattacagtcacctgggaaacttaaaaaaatcctcgtactcaggctgcatgccagatcagttcaatcagaatctctggggcaggggagtggggtgagagtgggatccaggcaccaatattactttaaaaaccccccctagtgattccaatgtgccgaatgtgcaatcaagtgtgtgaacctgtgctacagaactagagaaggcaaagaaaatgttgtagctcccagcctttcagccaggcaccagagctcacaggcggagaccaggaatggaagaattaatgttaacaaccaccatttactgagtactacatgctaaggaccatatactcctcttatttaatccttgtagcaatctctgtaaggtaggtaaaattatgaatccacatcttgaagatgagaaattgacactcagagatattaaataatctagccaaggccacagagctaattaagtggtagagctgggatttaaacttaagtcttctgacagtgatgtttcctggttattatgccacattggccagggagagatcatatgcagaaatcatacagttttaatacctttttttctactgccctgccaattttacataggctgcaagggagcccagataaatgaaattctgtgtctaaaaccaaataattcgctggtggccgggccagtaccagaatacttaatcttatcattattccaccatactttgctgcttctcttagcttttctgcagaaacaggaccaatctgcgtcatagctagaaataaagccatggccagaagccctcctgtaaccatgcccttctcagcactgtgtacatgcttgtcaggtggcactccttccttggagtgccagtgaacattcccttcccctctttctctgtctctgcagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaattggtgtaatgtgcatgtgtgctacaaggacggtgtgaagtggctggggggcagatctcagagacacatgccccatgacacataggtgcatccgtgtgggagcctaggaacatgctggctgttagttacacgggcttctcatctgaggcaccaccaattgtcagtgaatgacaatcatatatggagacagggtgtgttagagtggttattcccaaatactggttcttggatcccctaagtcaggatcacctggaacaggggacccttgctagacatacagattcgtgggtataccccgtacctgttggatcagaatctttggggctggcgttcaggaatctgcatttcaaacaagagctccaggcattggccctgggctaggtttggaaactccttgcctagaagagagaaacaggatgataaatactccaggaaccttatttcagatgagtttttacctctgccccagccaaggtcattgctataacccgtgagcagaatcagtttcgtgagtcttcctcctctttttctacctactactggatgtgctaataaccttgggagtgaggtttccagacctgggtgatgagcagttctccaaacattgactttagactgcactggctgagcagcccttctcagggccgccacttgaggagtctgaagttccacttggagcctagcattggctcagctgcttccaccactattccatcagctgaacccgtgcaaacccagcccactccaaggcttagtctgaggggtccaaacatggtactattgagtccttggctctttctatagcgaaaggtcctttaacatgctatggtgtcacaactggtgtcactgcccaatatttctgtgctgttctgttttttggatctcaggaaacaatactactccagctacgtggtgtccagggaagactcattgcctgacttcaggttgcctggccagcgctctgggccactagttggcgtgtgagtggccaaggcacaatggatccatgcatttggaaagctgtctggtcagcatgcccctaaggcagcattgttcctgtttcccagtccctttacaataccattagaggtcactaaggtattaatatattagtatctctgcaagacagtactttggtaagttataacagatggtcatttctcaatctgctagaactttaggctactgtggcctgtaattgccacagcaggtctgaccaaggcctctttactggtcactgcagcaagtcttggcaccaagtccttcacatgtcctgtaccaagagctcagcaagtgtaattagggaataaaaacccaccttgagtctcacccttcctgcacttcccctagcctggagcagacagaagacctggcccagggacacagaacagaaagaagctcgtagcctccattatattttcatttatattgctcaggtgaatggggtcctctgcagcatgataacatgagcattagctgagtttggggtgatcacgtctctccgtcttgtaggatactcagcttggaacctgctgtgattcttaaacacacacaccatgatagctggttccacaaataggatctctatttgctgttagctatctagccagagacactttctatttttttctttaaatagtctagggctaatttctgatcagaagaaacaacactagttacataagtcagtttagtaagtgacagattagcttctgtaatgtgttagacaaactttggagttttgtataccatttccttgctcatgtatcttctctactcaactcactataaaacaaaaatggtgcctttcaggttttctggactatttcatgaaatttaagagaaactgaaatcccacctgaatagaagagttatgcaatacttttagccagatggtagagattctaactctccctgaagcctggcctattggaaagtgtcccctactgtggggcctttatttgagtctgtgtgacctcaccagccctcccttccctg

SEQ ID NO: 12467 - DNA, 79350 bp, Human
  misc_feature (1)...(79350): n = A,T,C or G
cgtgttagccaggatggtctcgatctcctgacctcgtgatccgtccgccttggcctcccaaagtgctgggattacaggcatgaaccaccgcgcctggccacattttggactttcagtcatgttttctttccccaatgaaatagaaaagttttatttcaaagaggaaaagggtgcaacagctgcaacatacataaaacctatttagttttacttgggagtgggaatcaggaaacctgggttctgtttttgacttagtttggataaagaagggtagttaagctgtccttatgtctcttaccaaatggagaaaatactgctgtagttcacagcaatttggggagttttagattctatggaaaatggaaatcctatttgtaacttagattttttctttggagaaggagtctcgctctgttgcccaggctggagtgcagtggcacgatctcggctcactgcaacctccaccttccaggttcaagcgattcactgactcagcctcctcagtagctgggattacaggcacgcgccaccatgcccagctaatgtttgtatttttagtagagaccaggttttgccattttggccaggctggtctcaaactcctgacctcaagtgatctgcccaccttggcctcccaaagtgctgggattacaggcgtgagctaccgctcccggtctaatttttaaatttttgttttgtagagatgagggtctccctttgttgctcaagctggtctctgtctcttgggatcaagggatcctcctgcctcagcctcccaaagtgctgggattacaggcctgggccactgcaacctggccttcatcacaaattcattgaacacactttctttattttatccttttttatttttaaaaatttttatttcagtagttttggaggaacaggttgcatggaaaagttctttagtggtcatttctgagattttggtgcacccatcacccgagcagtgtacactgtaccatgtggcacacactttcacttaaagcatttactagacctcgctagccagatttcccatccctgagacacctggaatgttcctgaggacttagtgactactgcctaaagctccacccaagtcaattttatgtttacaggcaaccggagcatccaatcacctttctctaagagagtacaaagatcagctcgcgagaaagttcagacgtctcatttcgtttctattacacggggccttcgcccaaccagacggagtcttgctctgctgcccaggctggagtgcagtagcgcgatctcggctcattgcaaccttcgctccccgggtttaagcaattctcctgcctcagccactggagtagctaggattacaggcgcacgccaccacgccaagctaattttttgtattcttaatagagacgggggtttcaccatgttggccaggctggtctcgaactcctgacctcatcatttgcccgcctcggcctcccaaagcgctgggattacaggcgtgagccaccgtgcccagcctcgccggggccttttaagtgacgttaaaaattgtacataaaatatgttttaggataatacttgtttttctttgaccaaaggcttggcttcagagaatgtttagccagaaatagaggggcgttaaatccccttttttctaatttccaatctgaggaggaaaataacgtagtaaagggacgcaagagcaaccttgcttcttccacaacaaggcccaggcgccgccttgcaacccggaaatgcagggtgcagtgcggggggtaagggaccggccaactatgttgacccgactcagagaaaccccgcccttgccgccaccgcccacccataacgtcctcctcgaccctccctcgaccatccctcgccccgcggccctcaccgaaaaggggagggcggtggaagagagaggagtcaagggagcgcacgcgaagccccgcccctgccgtgacgtctggagacgcgacgcgtcgcctcgcaatgcaaatcgggaaaagggggtgagctgggctggcttccgtcctggtagccaaggctaattctccctcgagttcttgggagatgggcatttggcgagaaggctggcgttagtgaagcgcgcccggcgtcacggtgagtgcgggtcttgggccctagcacctgttctctgggaagtcgtccgctgtgaacgatgaacgcctttccttccaccagctgctggttaccccggagacaagctctgtccgcggagaggagtgggacaactcctaaaggtagaatcagcttgtggagaggaaaggcccaaccttgagtcttttacgccatctacctaggattgccaagcgagtttcgtgtgtttttttggttttaaaaggtggctttgaccaatcttccgttctcttggacacttatacccgactttgacctctttcctcttgcttccggtttttttttttttctgcaatctgcctacaatcccaggccttactatagctcctaaaactgtttcccagtttctcttcttccccagtcacacttgattttagtgaagtttgagtttaaagaccctataagcttgtcagagttaaaactatgacttcctcaaatagaagattttttttttttcccctaaaaagtgccttccatcctagagttgtgggacaagttaatttcaccgccactccaccttggaaattatcagaatccttactagcagtgatgtgcattataaagctgcagaccaccctcctgggtttatttcttgcctccagttcattctgtgaccttgaacaagtcacttaatcactaacaaaaaatttacctgacacggaggtgttgcagagcctaaggaatttagtatttgttaagagacctgagggtttcagatgaaagggatttatatctaaaggatgttaccttttctgaatctgcaaagcatcgttagttttgtaaatatcttgctgcagccattaaaaatgccaagtggtatttgttaaggaagtattcctgttttaggcttgctctgctgcggctttgctatgtaagcagatttttgcatttcagccgattctgtttaagattcgttggtgaatgtcattcatgatggatttgggtagtttctccttacagcatatccctggactattaagcatatctggaaggtgatatcggttgtgttatgtctttatcatgttgatatggctgctttgaaatatgtattccttttcttgtgacacattggatgcatctttaatattagtgaagaccctgtagtagtttaaaaaaaaaatacacctctcattaatgaaattttgcacatagacatctgtttttttaagaaaacaatgtataagaaaaactaacaaaaatgttttaaaggtgccttttttagcatttcgttttttaatatatttacttggactttaatctttatgggcatttgtttattaatgtggacgtggctgggcgcagtggctcacatctgtaatcctagcactttgggaggcggaggtgggcggatcactgaggtcaggagttcgagatcagcctggccaacatggcgaaacccggtctctactaaaaatacaaaattagctgggcgtggtggtgcacgcctgtagtcccagctactctggaggctgaggcaggagaatcgcttgaacctggaaagcgaaggttgcagtgagccgagattgcgtcattgcactccagcctgggtgacaagagcaaaactccgtctcaaaaaataaaaaataaaaagcgtggacataatggaaaataatcaaaatgacttttgggtaagacagttggaaaataaagccagtacattaaatttttttcataagtctagcactatattacgaacttttctccatgaaaatgcactcatatttatggaagtgaaaggaaaaaaatgtcttcaggtatgtgttgctaataaaattagatataattaaggaaacatttaaaaaataccttgttgttgtcccagttacctattgctgcataacaaatcactccaaaacatagtgacttaaaactgtaatttagtatctctcctgtttctctggcctgcctggacttagctaagtggttttcacctagagtttaatgcgtttgtattcagataagcagctgagtttggagtcaaccgagagctcagctggtctggacatccaaaatggctaattcacgtgaaggcgtttgatgttggctaggagttcagctggaaatgtcaactggaatgcccacacatagcctcttcacgtgacttgaacagtatggcggctaggttccgagaatacatgtttgaggagtcaggaagtagaagctgccagtctcccaaaaagcctgagcccagaaattcgcacaacattacttccaacatactctgttggttagagcaaagaccagcgtacaaccctcacctttgaaaggaaaaatgtcaaagaatttgtggccgtgctttgcctactataattttgatgacaaagttgtattggactcttgtttgcatttatatagcagatgaagaatcaggtacacttccaatttccagtttctttctttcttcttcttctttttttttttttgagatggagtcttgctctgttgtcagcctggagtgcagtgtacgatctcagctcactgcaacctctgcctcctgggttcacgccattctcctgcctcagcctcccgagtagcatgtcaccaagcccagctaatttttgtatttttagtagagatggggtttcaccatgttggccaggatgatcttgatctcttgacctgtgatccacctgcctcaacctccgaaagtgctggaattacaggcgtgagccaccgcgcctgacccatttccaatttctttaaccgtaatactttatgttgtaatggcatattacagttttcaaagcatgtttttgtatattttttcacttgatacctatggtcaccctatagaagcagacaaatagttcctatttcattttgcagatgaaagtaaactgaagagtggtggtggtattgggagtgatttacggaatttgttcaaagtcatatgattaataaatggaaagtaaggcctgcaacagttccataatattaaatttattagtactgaatgatgaaatattatattaaacttatttggaattctacatttatagccgtactaatttttttttttttttttttttgagacggagtcttgctctgtcttctaggctggagtgcagtggtgagttctcggctcactgaaatgtccgcctcctgggtttaagcaattctgcttcagcctcccgagtagctgggactataggcacctgccaccatgcccggctaatttttgtattttagtagagatggggttttgccatgttggccaggctggtcttgaactcctgacctcaggtgatctgcccgcctcagcctcccaaagtgctgggattatagccgtgagccaccatacctggccctttttttttttaaactgagacaaggtcttgctctgtcacccaggctggagtgcagtggcatgaccttggctcactgtaacctctgcttcctgggctcaagtgatcctcctgcctcagcctcccaagtagctaggactgcaggcacacgccagcacacctgactaataccatactaattcaagtaaaacagttctcatgtatagtgaataagggttaactaagccttgtctcttttgactaacacattacaatttagttttttgtttgtttgtttttgagagggagtcttgctctgtcacctaggctggatgcagtggcatgatctcggctcactgcaccctccgtctgatgggttcaagcaattctcctgcctcagcctcccaagtagctgggatcacaggcatatgccgccacgcccagctaattttttgtgttttagtagagatggggtttcactgtgttgcccaggctggtcacgaactcctgagctcaggcaatccacctgcctcggcctcccaaagtgctgggattacaggcgttagctaccacgccgggcctacaatttagtttttaataatgcagcagtcttcctcttatctgcaggggatatgtttcaagacctccaatgaatgcctgaaaccacagatagtactgaaccctatatatactatgttttccctatatatacatttttatgataaagtttaacttataaattagtaacaagagattaacaacaataactaataataaaatagaataattacaacaatatagtgtaataaaagttatgccctgtggccataacttgtgcaacttgaggtgtgacagcaaaactagcacaaatttctttttccttcataattttgcagataaaagatcttaccatagatcttagcaacctcagcatgaggtttttggttttttttcttattaggttgagaactttcacctttttgcttaaaggaagcagtttacaacttctttttgacatacgtgaatctctgcttttacactttgaagccatgattaagtaaaatgagggttacttgaacacaagcactgtaatactgctatagtcagtctggtaactgagacggccacttagtgattaacaggcaggtagcatctacagtgtggatacactggacaaagggatgattcatgtcacagactgggcgaagtgaggtggtgcacaatttaaaacttatgaattgtttatttctggaattttttatttaatattcttggactgtggttgactgcaagtagctgaaaccatggaaagcgaaaccatggataaggggggactactacactaaattctgaaacataccaataatggtgtaaacccacatgtctttttaatagagtaaaatgaaataattacacattataataccaatttcagaacaagagttatgggcataagcatcctggaggtgtttttttttttttttttggaggtgttattttaatttctcaattacagagttttaaaaatgaaaatgattttttaaaattttggtaggttgaatgatttaagatgctgatttcagctggaaacaaattgttgccttcatattattttgttgctcctagcagcatgtttatattcattcttatattgatggttcccagtcttgactggtgttagaattcatttgggaagctttttaaaaatacctatgtgggcaaggcgaggttggctcatgcctgtaatcccagcactttgggagacctaggcaggaggatcacttgagcccaagagtttgagactatcctggacaacatagtgagactctgtatttttttaaatatataaataagaaaataaatacctgtgtgtatgtctcatccatagagattctgatttaattgtttaggagtgggatctgagcatcaatatttttttaaagttctctaggtaactgattctaacatacagctgggattgagaactatgtttttggtgcatgttaagtacgatctggctccctacttaatgattttgcatctgttaaaaaattaatgaggtagaagacaaaagaaatggattaaagttataaatgtagatagacatctattctggaaaacagttacccttttgttagtttctgggaatggtccttaataaaacaaacagacattggcctggtttgctaagtgcctatatcacagcattaagccacactttactttgttaccgttatgtacttaactttcattttaagaggcagaaactttattaagagttgtatttttttagtatcccctgtatcacaacactgcaccttgtgtatagtaggtatctattgtttacctaattgaagccagtttagacagtcactctttagaactagggctagttcagctccttgggaggctgaggcaagagaatcgcttgaaccggggaggtggaggttttggtgagccgagattgcgccactgctctccagcctggacagcagagtgagacgtcatctcaaaaaaataaagaactagggctagtttattcttttcttttctttttttctcatggcattctaagactcccccaattagacagggtctccctctattgctcaggctggagtgcaatggtgtaatcatggttcattgcaagctcaacctcccaggctcaaggaaggcctcagccttccgagaagctgggaccacaggcgcatgccaccatgccctgctaattttttatttttttattttttttttgtagtgataaggtctcactgtgttgcccagcagttcaccaaatcctagataacataattttggtgtcaatacttaattatcttccaaaacaatagggattatcaaagtcaacattgatgccttattagttgataaacagatttaatatctgtctgctctcacatataactgatttctagttaatatttacatcttaagatgttcctttggcatacactcaacattttccacatcgaattacctactttgctgtaaaccagtggttcttgttgggggtaattttgccttccaggacacattcggcaatgactgtagacagttttggttgttacaactggaagggaaggatgatagtaaactggcgtctagtagaggttagggatgctgctaaacatcctgcagtgcacattgcacagagcagcctctcacaacaaatgtttatctggtccaaaatgtgagtgatggcaaggttgagaaacgctgctgtaaactgatcagttttaaactgcagtattactttttttgttaatagcactactgctcttcatattttgcagggtacagtgtgtgtgcctctgtgtgtgtgtgtgtgtgtgtgtgtgtgtgtgtgtgtgtgtgtaagcaagagaaaatactgtttcgatcaaccagttaccaaagcatgtttctaccattttgtgttcttttctgcagtgaccttgtagttactcttttccatagtatcattcccttgttctcatctcctttcaatcttacttacatatccctaatttgaccatcttgagataatatttttcccatcaggaactggcttttattgcctgctgaatcaaatataaagaattctggatggcttccaaagtcttccataatgtgactccatctcctacataatataatttagttattcttgttagtcaacatttttgtttccttttagttaaattcagctgacagggagaaacatttattaaagtggtgactatgtgaggactattgagataggtgccagggatccaaagacatgtcaacattttccctctatccgattgattatttcccaataacttctgtaatattccttattattactattttttccgagatggagtttcactcttgttgcccaggctggagtgcagtggtgcgatcttggctcactgcaacctctgccccctgggttcaagagattctcctgcctcagcctcctgagtaggtggaattacaggcgtccaccaccatgcccagctaatttggtatttttagtagagacggggtttctccatattggtcaggctggtcttgaacttctgacctcaggtgatctgcctgcctcagcctcccaaagtgctgggattacaggtgtcagccaccatgcccagccagatgtcctcctttcttaccctgttcttagctaaattctgtcctcaaggccaggttctctctctcatcacatcatcatgagcactgcgtgtgtatgaggattttaaagccttatagtaattgtctgttgatcccattactgtatttaaggaatgatatagatcacaagcattgtaggattcacatgaagaaacaaattccaagaactgggaccataaaggatggaagagatggaacttaagtttgtttcttcttgtagctgagacctcagatgtgcaccactacgcccagctaatttttaaattttttgtaaaattttttgtctttactttgttgcccactttgttggctacctaccatttctccctatctctgccctttaggcaacaacaatactcaacataaatatctgttcttgaactcctgggctcaagcagtcctcccacctcagtctcccagagtgttgggattacagctgtgaggcaccacgcccagtcagtgcactgctttttgcatggagaaagtcttgctgctactttaaaaaggtcagtgtgcttaattgatctacattctgtcacaaacttcttattttatcacaaactgataacaaacagttccccaatcagcactggtcattggaccatacttggagttacattgctgtagtgtgagactttcatactttttttaaaattgtcacctgtattaagaaatacattttacattttcatccagtgttatatcatatacacatgtacataactgaaacaattttacgaagcagtacctaaccttactatgtgtgacatagtctgatgtttgctatttttttaatgctgatcatgaccttctaatggattttaaaaacactgccctcaagcatttagcacagtgctagagacatagtagttgctcagaaaataccatacattttagcagtgattaaatcttgagagggttgagccttcttaatacttgaggattactttaaaatgttatttcattggccgggcacgatggctcacgcctgtaatcccaccactttgggaggccgaggcgggcggatcacctgaggtcaggagttcgagaccagcctggccaacatggagaaaccctgtctctactaaaatacaaaaattagtggggcatggtggcggggcgcctgtaatctcagttacttgggaggctgaggctgcttgaatctgggaagtggaggttgcagtgagccaagttcatgccactgcactccagcttgggcgacagagtgagactccgtctccaaaaaaaaaaaaagttatttaatcaatacttagttgtttgtggcaccttatacagaacgagtgtagagtggattatgagatttaagacagcgagaagatacttatgttgagtattgttgctgcctaagggcagaaatagagagagatggtgggtgaccaacaaagacaacttttgctttcctttcaatattgccaaagaccttaggagtggctggtgtgaatccctgcttaaaatcaggaccagtttgaatgactgcaaacctcatttttcactttttaccttttagtcttcactttgtggttccagtcatcaaatccctactctttgtcttagaaaggagcagaaggatgtcagagaaagaacattttctctttatttatttatttttttttgagatggagtctctgttgcccaggctgcagtgcagtggcgcgatctcagctcactgcaagctccacctcccaggttcgtgccattctcctgcctcagcctcctgagtagctgggactacaggtgcccgccaccgtgcccggctaattttttgtctttttagtagagacggggtttcaccgtgttagccgggatggtcttgatctcctgacctcgtgatccgcccgccttggcctcccaaagtgttgggattacaggcgtgagccactgtgcacggctgcattttctctttgttaactcattttcaacacttttgggtttcacttttggagcactgctgtttgactaaggctgaagttctttgtcaggtttacacatcttaagaatttttattttttgttgttagaagcatgttaatttttcttgcatatacttagttatttttttttcacttgcaatccttcttgaagcataaggttttttgttttgttttgttttgttttgttttgttttgttttaaaagacagagtcttgctctgtcgcccagactccgctcactgcaatctccacctcctgggttcaagcgatttttctgcctcagcctcctgaatagctgggattacaggtgtgcgccaccacgtccggctaatttttgtatttttagtagagatgaggtttcaccatgttggccaggctggtctcaaactcccgacctcaagcagtccacctgcctcagcctcccgaagtgctaggattacaggcctgagccaccacgcccggctgcattttctctttgttaactcattttcaacacttttggatttcacttttggagcactgctgtttgactaaggctgaagttctttatctttgtcaggtttacacgtcttaagaatttttattttttgttgttagaagcacgttaatttttcttacatatacttagttattttttttttccacttgcaatcctttttgaagcataagttttgctttgttttgttttgttttaaaagacagggtcttgctgtgtcgcccaggttgaagttgtagtgctgcaatctccactcactgcaacctccacctcctgggttcaagtgatttttctgcctcagcctcctgaatagctggaattacaggcatgtgccaccaccacgcctggctaatttttgtatttttaatagagatgaggtttcaccatgttggccaggctggtctcaaactcccaacctcaaggaatccacctgcctcggcctcccaaagtgctaggattacaggtgtgagccactgcacccggccacataagataatttcaatgtgttgtatcttatggtttgtcctagatctaaacaaataaattctgcaaattatttgacttctgtagttaatgaacacttctgtataagtatcaatgggtttgttgttgctgctgctgttttattttttttaaacgattgtagccaaaataaggcaattgagttcattcagtcattctagtcaatatattttatgtcagtctattttcagatttctttaatggcaaaatgcagcagaatgacttatcaaaaatgtaacatgttaaattcacatagattgaggttggatacacagtcagccttctgtatctgtgaattcaaccaatggccgattggaaatattttaaaaaaataattggatctgtactgaaccatgtacagagttttttcttgtctttattccctaaccaatacaatgtaacaactgtttatataacatttacattgtattaggtattataagtaatcttgagatgatttaaagtaaggttatatgcaaatcttacaccattttatatcagggatttgaacatctgcagatttttggtacttgtgggaaaagtcctggaaccactctcctacagatactgaggaattactatatatgttttgctttctcacttgatgagcggaaaataccctttaccttctgtttgacttctgcagaaacgtgtgtgattgtagaggctcaaatagcaattaaaacaatactgaaagtatttttaacactaggcatccttaagtgacggtataacttacatgattttgttaataaaaatagaaacaactatggtttttaatggactttagacattatcagagaagattgttacttatttgaactgtttccaaaaatcaaatggggacagaaaaggaagcttttaaaaagtacagtctttctcctagaaacccttcctaaaatctttggtgacatcgtaatcttatccctgtactttccctccttgtgtctaatcatttgccaagtcctgtcattctacctttgcagcatctcttattatatctgcttcctctattccatctctactgccctagttctgacctttgtcatctttccctaggatcattataatagataactagtgttttccctatctagtttgtcacttaccgcctaactttatactcttcttagttttaatcacttacctccctacttcagaaccctgctacctttagaaaacaaagtaaatgctttagtaacattcaaggccttccccgttccctgttccaagtctgtttttttttccactgccatgtagatctttgttcattctatgtagtggctaattcctaaagatgttctttactttcttttcttcatcctgcttttcatctctttgaaaaaccttcccccaccaagactcaaatcaaatgttgtctctttgatgatgacttccaagatccttctagtcatacttaatcttctctcttaatttttcttatactgtaatatttgtaactctatagtttgatatcatactatgctgtattactactgcttaaaactttctcttccacattagttttttaaactttgttggtttttttgttttgtttttgagacggaatctcactttgttgcccaggctggagtgcagtggtgcgatctcggctcactgcaacctcacctcccgggttcaagtgagtctcctacttcagcctcctgagtagctgggattacaggtgcctgacatcatgcccagctaattttttttgtttgttttttgttttttgagacagtcttgttctgtcacccaggctggagtgcagggtgtgatctcagctcactgcaacctccaccctctgggttcaagcaattctcctgccttagcctcccaagtagctgggattataggcatgcactaccatgcctggctaatttttgtatttttagtagagatagggtttcaccatgttgaccaggctggacttgaactcatgacctcaagtgatctgtccactttggcctcccaaagtgctgggattacaggtgtgagccaccatgcccagccccaatgttccaagtcttttttttttaaatcaatatgtttttttaaatgtgtattttttgttacttgcttgtttaacccataacttcctaacttttacatctctctggatactctcttcatatttatgtatgttgcattgctttactcacgtttgcgttgttatgctcatattatttctttccttccttaaaactttaagtacatttcatatattcttttatatgttataaagcatgatactaaaatgatcacctgtgcacatactacccaatttgagaactagaaccttgctgtacccctgaagctccttatatgtatctccctgattacaactctccctctcccaagaaatataatgttgcgtttaacattttctgctttctttatagttttacctcatttatatctttaagcaatatattgttcaattcaatttgatttttaaactttatatagagtatcgtattacacatattcttggtttttcattcaacattgcgggggatgggcagaagatgatgaggtgagaaggcgggcagggtatgttttctggttaaactatttattcttggagaatcagagaccatatcttatatacccctttaataacctctgtttaacacgaggcctactgttgcaagctaagtctcctgatgatttgcactgacattgaaacattgctgttgtctctataagtatgaggaaacccaggggaaccctgtcatactctttcctcaatggatgcttttagcaagtttgatgaattgttgatgaattagatacctcgctagaaggacatatttgatatcagttgatccatttgggagtgatagtgtggtctagagaccttttctcccctatcactacagctttagacacaggacccagggtggatggtaaagtgtagaaaatgtttgtatattagatcgttgtttctaaatgcatagatctgaaagtacaaattaaagtgtttggttcaacatgtgtttatagatacctggagcaagtatagatagaaaaaaagtgaaaatgataaaaatgaaatactcagaacaaaatggtttggtgactaagacagtggactaatgtgcacagggttagaagggatgagtaccaataaatcacaaagtattaatatttaatataaaatgttactagaattaaagcaaattggggtgcttttggaattttcataggtgagcagcagccttcccatcccctgctccaagttgtactttacttagctttttaggattagatgttcattgatgtccatttgtttaatgatagtgaactggtagaatgaagattattaagagattggaaagaagtagccagacgtggtggcttacgcctgtaatcccagcactttgggaggccaaggcaggtggatcacttaaggccaggagtttgagaccagcctggccaatatgacgaaaccccgtatctactgaaaacacaaaaactagctgggggcatggtggcgaacgcctggaattccagctacttggaggcttaggtaggaggattgcttgagctcgggaggtgaaggttacagtaagccgagattgtgccattgcactacagccagggtgacagggtgagaccctatctcaaataaataaataaataagaggaagaagtcacttaaaaaataaatggatatcaatgagaaaagagaaatatttctagataaaaattccatctacttatgatctaaacattaatgctattttaacaaaagaaacatgtaaacgctttgattattcttactgctagttcctttgacaggtaagattcccaactcttaaggcaaaatgatacaaaaagtaattcatttggttaatgaaaatttgaaaaaaattattacattcttcactcatattctgcatatcttaaactcctgaaatagatattctaaacaatttaaaattaaccctgttagcaaaggatatggtttaggaatttttttttttaaactgctcacttgttttattgtgaatgaggaaaattagtataattatttgtatttgtttcaggaaagaagcacttgtaaggaaatatagcatccattgtgaaagtggaaaagtaaagataattcatcatgcctgctgtggcttcagttcctaaagaactctacctcagttcttcactaaaagaccttaataagaagacagaagttaaaccagagaaaataagcactaagaggtatgatgtatccttcgctagtttgattgaatcaaatattaatttttagttcgtttccatattaaagttagatgaatgttaaagtttatttgaaaaataacaccatcacacgaataaagtaggacctccttagagaaagttgtaatgtaatcgtagcacaatacatatatattctgctcatatgcatattatctactctccagacagatcatacagatatgatctctaggtcataaagtttaagaggcaaagattatgaggcttctaaaaaaaaattcagccagaagtcattgtcttttcataaaacgatacaaaaataattcctttttggccgggtgcggtggctcacgcttgtaatcccagcactttgggaggccaaggtgggcggatcacctaaggtcaggagtttgagacaagcctggctaacatggtgaaaccccatttctactaaaaatacaaaaaattagccgggcgtggtggcgcacatctgtaatcccagctactcgggaggctgaggcaagagaattgcttgaacccgggaggcggaggtttcggtgagccgagattgtgcgattgcactgcagcttgggcaataagagcgaaactctgtctcaataataataataataataataataataataattttttttttccactttgggaggccaaggtgggcggatcacctgaggtcaggagttcgataccagcctcggcaacatggtgaaaccccgtctctactaaaaatacaaaaattaacttggcatggtggcataggcctataatcccagctagtggggggctgagggatccctgagtccaggaagtggaggttgcagtgagtcaagattgcaccgttgcactccagcctgggtgacagagtgagactctgcctcaaaataaaattaaaaagatcttttgaagggcagaaagtaagagagggattgggctatttatcttgcgaagttgggaagttgatgaggtgacagaaaacaactctaactcctgttgaatgattttcagatgggaaacaatgggaaagataaagccacctttagataagacaaggtcaggcctaagaccgtttattcctttctagtaatgtctggtttacctctagcactacccttatcccagaggaagtggtatatgtaagttggttgtatccaaacttgcatctaactttgtatcagttctgaagtagtggaacctaaataatgaaatttgctttatcaagatcagtggtccccagcctttttggcaccagggactggttttgtggaagacagtttttcaatggaccagggttagggaggatagttttgggatgagtcaagtgcactacatttattgtgcactttatttctattattattactctgtaatgtataatgaaattattatataactcaccataatgtagaaccagtggtatccctgagcttgttttcctgcaactggaccatcacatctgggggtgatggtcgacagtgacagatcatcaggccttagattctcataaagaatgcgcaaccttggctaggcgcggtggctcatgcctgtaatccgagcactttgggaggctgagatgggaggatcacttgaggtcaggagttcaagaccagcctgactaacatggtgaaacctcgtctctactaaaactaaaaaattagccaggcatggtggtacactcctgtaatcccagctacttgggaggctgaggcaggagaatcacttgaatccgggaggcagaggttgcagtgagccaagatagcccattgcactccagcctgggcaagaagagctagaccccatctcaaaaaaaaaaaaaaggagtgcacaacctagatccctcacatgtgcagttcacaatagggttcgtgctcctatgggaatctaatgccaccatgatctgacaggaggtggagctcaggtggtaatgcgagcaatggggagtgactgtaaatacagatgacactttgctggctaacccaccactcatcgtctgctgtgcgtcctggttcataacaggccgtgaaccagtaccaatctgtggccctggggttggggatccctgataaagattatctgtggactttgtatatgacctgtattttttcccagatgtcaattgctttaattattattttttctctaattttaagttatgtgcacagtgccctgaagatctttaagacagcagaagaatgcagattagatcgtgatgaggaaagggcctatgtactatatatgaaatacgtgactgtttataatcttatcaaaaaaagacctgatttcaagcaacagcaggtaccttttatttttgcattgttatttcctaagttattttgcataatggagctattgatttttttctaaaaattttaagtaataatgaaatgtagctcaaattatatgcagcatgatctcatgtagatagaaaaagggaactaaagatacagtgttattatttacaaatgtgtataatgtgtgaactcgtacacattcttggatttgccatggattagtacaagtttatagcaacatacagattcataatttttttctgaggtaattaataattgccaggtcaagtagaaggattgagtttgctcattaagtaagaaaacatgactgtgtttttttttatagtacttttattgcgctttcttaagagtcaaggtttagtctcttgtttttatgtgacagctttttatatatgactgacattgtacccatattacaaatgtcagtttgcaaaattgatactgatcactccctaaatcttttttttttttttttttttttttgagacggagtttcactcttgttgtccaggctggagtgcagtggcgtgatatcggctcactgcaacctgtctcctgggttcaagcaattctcctgcctcagcctcccgagtaactgggattacaggcatgtgccaccaagcctggctaattttgtatttttggtagagatggggtttctccatgttggtcaggctggtctcaaactcccagcctcagttgatctgcctgcctcggcctcccaaagtgctgggattagaggcataagcctctgcatccagcccactcaccaaatctttaaacttctttttgcttttaatcctttgaacaggtgcttgtcttccatttgattgaagccatggatagggagggcaggggcaatataaatgaatagaaaaaattgatgactaggataagtgttgatagagaaaatagatgtatttcaattgtattagaaactagcaaaagaatgctgggcacggtggttcacacctgtaatcccagcacttttaggaggccaaggtgggtggatcacctgaggtcaggagttcgagaccagcctggccaacatggtgaaaccccatctgtactaaaagtaaaaaaaactagctgggcgtagtggcgggcgcctgtaatccaagctgcttgggaggctgagacaggagaaccacttgaatctgggaggcagaggttgcagtgagccgagattgcaccactgcactccagctccagcccaggtgggcgatagactccatctcaaaaaacaaacaaaaacaaactagcaaaaaaagaatatgaagaatgtagaggttcattaaacaaaagtgaagaatgttgtgttgctgggtttacctttacttagaaacaatcttattacctgtcagtagtaacaaaatactgcctatagaattttcacctggtagagaagccaccctcaattaataatgagattttattttgttctctggtggtagaattggcttctattgtttaaattgacttactgaaataacaaaatttcgtttgttctttgatgatctttttaaatttttttaatttatttactttgagagagtctcgccctgtcacccaggctggagtgcggtggcacattctcagctcactgcaacctccacctttcgggttcaagcgattctcctgcctcagcctcctgagtaggtgggattacaggctcttgccaccatgcctagctaatttttttgtatctttagtagagacggagtttcaccatgttggcccagctggtatcgaactcctgaccttgtgatccgcccctctcgttctcccaaagtgctgggattacaggcgtgatcctgtgagccactgtgcctggccacttatttttatttttagaggagtgtgacttttggttgttaaggaatgactttaatattttacttaatggtgataaatcattgctggtatttcttctcattagcaaagttattctaataatagttactaggttttttttgttttttgtttttttaaagacggagtctcactctgtcgcccagactggagtgcggtagctcaatctcggctcactgcaacctctgcctcccaggttcaagcggttctcctgcctcagcctcccgagtagctgggactacaggtgtgcaccaccacgtccagctaatttttgtgtttttagtagagatgggctttcaccatattggccaggctggtcttgaactcctgacctcatgatccgcctgcctctgccttccaaagtgctgggattccaggcttgagccatcatgcctggccaattactaggttttaaatctgtctttgaagagggggccccttgcatttggaggttcattcatctgtccacaatggatgaattagtcctgccctgggaaaaatactgtttaatatttttggccatacttatctgcaggtaagagacagaggccttcctaaattcaaacaagtttttgcacgctctgtgaaatatgttaaagtggaattgcttaaaacgcagtgtaagtggtgctcactaaagtaaatatttttgaaagtcttaaaatttggataactttggtagttttgttgtttgctgttttgtttgtgtggtaggtttttttttttttttttttttttaaggtgacagtcttgttctgtcacccaggctggagcgcgatggcatgattttggctcactgcaacctccacctcccaagttcaagtgattctcctgcttcagcctcccgagtagctgggattacaggcacccgccaccacgcctggcctaatttttgtatttttagtagagacagggtttcaccgtgttggtcaggctgatctcgaactcctgaccctcggtgatccacctaccttggcctcccaaagtgctgggattacaggcatgagccaccatgcccaaccagttttttttttttaatggtcttgtttactttttgctttattttggaagttaatagttattttttttctatgacaaaattgggaatatttttgtagccgcctttttttttctcttcttgagaaggtagtgagtacatttaaacagatgagatttttccatttccagagtctctattgcatttccaaagggagtatgtaggcagagaagtccaggctgagacgctccctgcaaaggctcaggtaacttaggccattatttcatatgattcagtagttcatttcctgtttttcagtaaaaggatcattttcatttgctctgtccagaggatctcatctgcttctgtcttagaactgttttttgtttgttctgagacagaatctcacttccgtcacccaggttggagtgcggtgggcacagtcatggttcactgcagcctcgacttcctgggctcagctgattctctcacctcagcctccagagtagctgggagtacagacacgcaccaccacacctggctaattttttaatttttagtggaaacgaggtcttaccctgttgcccaggttagtcttgaactcctgggctcaggtggtctgcctgcctcggcctcccaaagtgctgggattacaggtgtgagccaccttgcccagttgcagaactgttttctgttttttgttatatttttctgtagcccagcctctctagtgtacttcagctatgtgaggtgctaaatttactaacaagatattttctattttttaccctttagatgaggtagggactgaatgtatgtcattgaacttccttagaaacttgtattttcactcttattttatactagaaaatgttagagatttaggctgggcgcaatggctcacccctgtaatcccagcactttgggaggctgaggcaggtggatcacttgcggtcaggagtttgagaccagcctggccaacatggtgaaaccccatctctactaaaaatacaaaaattagcagggtgtggtggtatgcatctgtagttccagctactcgggaggctgaggcaggggaatcgcttgaacctgggaggcggaggttgcagtgagccgagatcgcaccactgcactccagcctgggcgacagagcaagagtctgtctcaaaaaaaaaaaaaaaaaaaaaaaagcctgggcacagtggctcacgcctgtagtcccagcactttgggaggcagaggcaggtggatcacaaggtcaggagttcaagaccagcctggccaacatggtgaaaccccatctctactaaaaatacgtaaaaaaaaaattagctaggtgtggtggcaggcgcctgtaatcccagctacttggaaggccgaggcaggcgaattgcttgaacctgagaggtggaggttgcagtgagctgagattgcaccactgcactccagcctgggcaacagagcaagactccgtctcaaaaaaaaaaaaaaaaattgagatttagataaaacattaatttagcaagctctctcaatagtagagaaggacactacattttattacttatcaaaaagtcatcttatgaataattctttcagggttatctgaaaaagtggggaaagaaaatgtattgaaaatattagtgtagcgaattctagataaaattagaattgtattttaaaatttttatggtattcttgataattcttcattggtaaacctatttttgtttaggaaatcatgaaagttgtttgaattcatatattcaggaatcaggaaagttctggtaaacctcagaagcaaacatttttagttatgtaataattggatgttatctttttcttctgtcaattatcatactattgaaattttggaagtatttatatttactttaactgtgctcctttaagagcacagagataaataattgacaggaaatctcactaatattaggggaatgtctgatagtgtgtaacagacatgcccaaccataaacaattttttgtgtttaaataggtttaagctgggcttacaggctggctttttggtgagttcatgtgtaaaaatgaataaaacaagttatagcatttttggttttactttgtattttgtatttattcagaatgattacattatgatttctgttaaatggttctgttaatgtaatgattacattgtattttctgttgagagaattgcatcagtagtcaggacatggtgtgctaactgaaattattgtaatgttcaattgatacgatattgaacaaactgtacacttttattggaattacatagtgaagggtccttctagtatatttaggctttagaagaatcagccaaacaaagcatgatctacttttaggctagatagacatatgataactcttatcaacagactttttttgagacagggtctcactctgttgctcaggctgaagtacagtggcactatcatggctccctaaagccttgacctcctgggtacaagctatccacctgctttggcctcccaaagtgctgggattacaagcgtgagccacctggcctggccatcaacagatttttcttcttaaaaataagtcttatgttaactgggacacaaaaattaaatcttttgctatatcactcatattctgttcttgtgttaccacatacttttttgaaattaaaaagtgtttagaatgatagattattgagcactggtatattgaattagagctcaggtccagtttttctaagttatttataataatatttgtaaatgtctggcagttttctttagaaaaatttaattcttcatatgctccaggttgtattgtgctactggacgctggtcttatgggaatgaattatttactgttagtttttgttgttgttttcaaacggagtcttgctctgttgcccagactggagttcagtggcactgtctctgctcactgcaacctccacttcttgggttcaagcaattctcttgcctcagccttccaagttgctgggactacaggcacgtgcctccacgcctggctaattttcatatttttagtagaaacgggggtttgccatgttggccaggctggtcttgaactcctgacctcaggtgatccacccacctcagcctcccaatgtgctgggattacatgtgtgagcccctgcacccagcctactgttagttttttttttcttttctttttttcccctccgagacagagtttgactcttgttgcccggggtagagtacaatggcgtgatctcagctcactgcaacctctgcctcccgggttcaggtgattctcctgcctcagcctcccgagtagctgggattacaggcgcacgccaccatgcctggctaatttttgcatttttacgcttattttttttttgtcttttttttttcttcctttttgtggggaacggggtctcactatatgcccaggcaggtctcaaactcctgggctcaagctatcctcctgcctctgcctccctgagagctgggattacaggcgtgagctaccgtgcccagcctaatttttgcatttttagtggagacagggtttcaccatgttgctcaggctggtgtcaaactcctgacatcagatagatgatccagccgccccagcctcccaaagtgctgggattacagatgtgagccaccgcacatggcctactgttagttttgatctgcctagttacagaagttatgtttgtttatttgtatcatcagtaatctagaagttatatatatttatatgggctgttagatatgtttatatggctccaccattgcagctcttcatgactgagagccaaagataggtacttctgacctacaacccttctttttacaaattatgattattataatttgtaatgaactgtgctagtaggctctatttgcaaagtcatattgacatgttgtggcaaattggatccagtaatcatttaactgacttaactaactactgcaatgtcataccaaccttgatttgaaaatatctgattgtagtatctaatgattgacctcttgtatctaatgattgacctcttggagtagtgatttaaaaaacaacaacaacaacttcattgtacttgttagtaaattatatgccaaatcttttaccttttgcattttttaaaggtggaattttttttttttttttaagacagagtttcgttctgtcgcccaggctggagtgcagtggcgcaatctcggctcactgcaacctccgcctcctgggttcaagtgattctcctgcgtcagcttcctgagtagctgggattacaggcacataccaccacacccagctggtttttctatttttagtagacatggggtttcaccatgttggccgggctggtcttgacctcctgtcctcaagtgatgtgcccgcctcggcctcccaaagttctgggattacaggtttgagccactgcacccggcctagattatactattaattatttattttctatcatttggtttttagttgcttagagtttcctaatgtgtaaaacttgttttatgtatcaaaagtgttttgactccagttgggatgtgagtagctattctaaagtacaggtggaagcaaaaatatctgtttagaacaagtaaacaaaacacattccatgttgtgtctgtacacaatttgctttattgtgagactggagaaaaaactaggtacatatttttaataagaaaatatactttattcttgaaagctttgctctttggcgcttactcaaaaataacaatgttatttatactttttaacagagacttacaaataagtcaaatttatgaactagtggatctttttaacttactaatggtatgaagacatacttttgagacatttggagaataaattatacatttacataggttaaaagtttttaaaaatcttccattgtaataaaacaaacttccctttatataagcaccatgattttaatgattttaacactagtgtcacatgcaatgccgagaactaacaatatgggatgggtttcctataattttaggattatttccattcaatacttggacctggaaacatcaaaaaagctgtcgaagaagctgaaagactctctgaaagccttaaattaaggtgaagatattatgaaatatttaaaataatgtaaatttagaagataaaaataatatttaagatttaccgatttatatctgacgattcatataatattccaatttttttttgagacagagtctcgcgctgtctgtcgcccatgctggagtgcagtggcgcgatctcggctccctgcaagctccacttcctgggttcacgccattctcctgcctcaacctcccaagtagctgggactataggcacccaccaccacgcccggctaattttttgtatttttagtagagacagggtttcaccatgttagccaggatggtctcgatctcctgaccttctgatcctcctgcctcggcctcccaaagtgctgggattacaggtgtgggccaccatgcctggccccaatatttctttttttttttttttttttttctgagacggagtctcactgttgcccaggctggagtgcagtggcgcgatctcagctcactgcagactccgcccctggggttcacgccattctcctgcctcagcctcccgagtagctgggactacaggcgcccgccacctcgcccggctaattttttgtatttttagtagagacggggtttcactgtgttagccaggatggtctcgagctcctgacctcaagtgatccgcccgcctcagcctcccaaagtgctgagattacaggcgtgagccacccggccccaatatttctaatttataatatttgtaagtttctggcattattctttagaaaaattcaattcttcatatgttctttggtggattctgctcctggatactgtgcgtataggaatgaagtatttactgttacttttgatctgcttagttacagaagttatttaaatttggaaaaaaaaactgattctggtatttgccatgacttgcttaccaggtttacaaaaataattacaaaacaaaaacagtatgtttcagtttttagtcgttagtcattcttttttttttttttttttttttttggagacggagttttgcctcttgtttcccaggctggagtacaatggcctgatctcagctcactgcaacatttgcctctcaggttcaagtcattctcctgcctcagcctcctgagtagctggtattacaggcatgtgccaccatgcctggctaattttgtatttttagtcgagacggggtttctccatgttggtcaggctggtcttgaactcctgacctccgatgatctgcctgcctcggcctcccaaagtgctgggattatagccatgagccactgtacccggccattagtcatgctttaaaatttaaattgtttcccttatcaacaacataatgctgttatgtagatcctagtagataaatttctgcctgtatctgtagcataaaaaatgttaatagataaaaccaaaagcattctcagcaatatgatacagaaggagagaacaatggaactggttttaagtgatacaaggtgccaaagcctggttagtgaaaaacagcaaactgagagctgtttgatgcaaataataaatagaaggaggaaactgaaagatttaaccagggtgacatatttctttactggcttgaatttttttttttcactaagaatgtatcatgttacttgtatttaaaaatattctgaccaggagcaatggctcagtcctgtaatgcctgcactttggtaggcccaggcgggcggattacttgaggccaggagtttgtgaccagcctggccaacatggtaaagccccgtctctactgaaaatgcaaaaaaagttagccgggtggggtggcaggcagctgtagtcccagctactcaggaggctgaggcaggagaatcgcttcagcctgggaggcagaggttgcagtgaactgagatcttgccactgcactctagcctgggcgacagagtgagactctgtctcaaaaaaagaaaataactctcaacttataaaggaagtcattaagaaaatgattcattatttagatatttacttcttatggcctgatagaatggcccatctttcagtgtaataaagtccctgttgctaaataacctctgggtcctttccaattctaaggctttttaaatgtactttgaattttcctctgtataggttattttgcagctagatgtggagaaccttttcactgtttttctccctgtctgtcctctcccagcctcctgccccatgttggtgtctttcatggacatttagagcaaccctgtgtgaacatatcttcatatctgtcctgtcctaattctgtaataagtcaaccacaaagctcttttcctcctttaagtctctgaaatctgcatgactagaatttctcttgtcaggccggcagtctgagaatgggcatgagggagggtatatgctctctaggtttggagaatagattataactttaaagtgaaagcccttaacatcttggggtagattttctgctaaattctgcctaatcatctgatgtcatggtctatgaccacggaggcgtgtgtgccgagtggggtccgtggcctgctggcccctgtcctaggggtggccgcatggtcccaggtgcggccgctatagacatagccccagattctgaaaaaaatgctttagcaaaaagacctagtgagtggctagaaaatagatttcagtatcacctgccattaaggaatacttgttaagcatttatttgcctgtcccgtttcttattattatcttttttcatggacacctctcataacatagacttaatccatttctgttacattcatgttaggggaggtcttagaggtaattttgaccaaatctggaagtatcagaatcctagtaaaagggattaagtgggtaaaaggatcagaagttagtttcagagagcatgcctcgctctcacttcagcttaccaactgaaattggaaagtaggagagacatcagctctatttaattagatttatggagactgtagaacaaatccaaggtagggggtaaggtgtggataagagaagaaaataggaaaaaagagaatcttaaagttttttcatttctgccctcaaattggatttaggctgactgtgcttacttcttagggcagacagttcacatactgttccagcatagagcactactagagaagaaatatagagcagtaggtaagtgtacggagccagactccctgggtatggatcccagtttttttcttattaattgtgtgagcttgggcaaattacttagcctccctctgcctcagtttcctcatctgtaactaggataatcataaaacctacctcatagtgcattaagaaaattaacatttacaaacacttagatggtgtctggcacataccaaataataagtttttgtgctattattttcgttgttattaacagtggaagcattcttgttctgtaacacctttcgtcctggcactctagtgatttgcattgaggaggcaaggtaaaacagttgcataattttgctcttgttccaaatctttcacttctgtttctaacagtgaaatgatgctagcatatgagataggcaggaaagtggtgttgatgtttccatagagataataggaatacatgcttgctattctgtgaccaagttcttaacacagtgcagtagagaagtgggggaagtgagcataccagtaagcaaggtcctgctggagatttgagaatccattatccctggttattgcctaagcagatggaatatgatgaaacatctgtttttgtaaaattctatctgaagttactctgtttttcttttctcctctcacatctattgatgggttcatcattcacttttgttccatttattttattttaacacactgattttcataaatctattgttttcccagtagaactttataatttattttgaaatattttctaatttccctttcttccttgacccatgggtcatttagaaatgtgttgtttaatttccacatatgtgggattcttcttatatcttattgatttctaatttaatttcattgtggctaaagatgttgcgtccttttaaatgtattcttgttttatggctcagcatatggtctcttggtgaacgtaccatgtgcacttgcaaagaaaatgtggttgttgaatatactgttctctatatgtcatttaggtcagaatggctgataatgttcagatcttctttatctttactgactgtgggatgggggttcaagttgtaacaattactgagagagtcatgttaaaatatttaactgtatctatttatgcctttagttctctcagcttttgtttcatgtattttgaaattctatttttaggcacatagttacagtttcttgatgaattgacctttttatcattatgtccctctttacctctgggaatattctttttttttttttttttttttttgagacagggtctcactgtcctgaaggctggagtgcagtggcatgatcttggctcactgcaactcccgcccccaggttcaagcgatcctcccacctcagcctccccaagtagctgggactacaggcgcacaccaccatgcctggctaatttttgtattttttggtagagatggggttttaccatgttggccaggctggtcttgaattcctgacttcaggtgatccgcctgccttggcctcccaaagtgctgcgatcacaggcgtgagctaccacaccccgccctcatcttcattcttaagggattttaactagatacaggattctaggttggcaggttttaattttcccttttgtcacttcagagctgctattccactgtcttctggcctccattgtttctgatattaagcatttttctgcctcatttttattttcttgctggaactccagctctacatacgatagactttttgattttgtccaatgaatccctaaggatttgttctttttattttgttttgttttgttttaatcattttctctttgtttttcagattggataattttcttttcttttttttttttttcagatggagtctcactctgtctcacccaggctggagtgcagtggcacacgatcttggcttgctgcagcctccacctcctgggttcaagcaattctcctatcttagcctcccaagtagctggtactacaggtgtgtgccaccacacctggctaattttgtatttttactagagataggggtttaccatgttggccaggctggtctcaaactcctgacctcaggtgatccacccacctcggcctcccagagtgctgggattacagatgtgagccaccacgcccagcctggattgaataatatttatcactctttcatcctttttttcttttgagacaatgtctcactctgttgcccaggccgaagtgcagtggcatgatcccagctcactgcatcctcaaactcctgggctcaagcaatcccacctcagcctcctgagtaggtgggactaaaggcacacacctctgctcctggctaattttattttttatagagatggggtctttctgtgttgcccaggatggttctcccttcaaatactgactctttactttgtcatctccaattttgtgttgagtgaatttttttcagttatatgtttcaattctagaatttcttcctttttttgagacagagtctcactctgttgtcgaggttggagtacagtggcgtgatcacatctcactgcaacctcagcctcctggcctcaagtgattctcccgccttcacctcctgaacaactggaactacagatgcacaccaccaggcccagttagtttttttgtgtttttttgtagagacagggtttcaccatgttgcccaaactggtctcaagctctgggctcaagcagtcctcctaccagggcctcccaaagagttaggattataggcatgagccactgcgcccagcccaattctagaatttctgtgtggttcttttttatagcgtctattatttttttacagagatttcctatttgttcatttattacaagcacattttcatttacgcccttgagcatagttataacagctgctctaaaatctttgtatgctaaatgcatcatcttagagtcagtgtgcagcaccttttctcttttattgttgtcctatttttctttttttggtactagtaactttggacattgtgaacaataaaattataggctctgcattcttctttagtcctctgaatagttttgttgttgttgttgttgttgttttgtcccactaggcagttaacttggctatactcaaacgttaagttttctgtcttgcctatggtaggtggcaactgacattcttttcaattcttctaaacttagctgggctccttagtatctgctgcaggtgtgcttaattcaggtgtcaggtggcaatttgggcaagtctatacaaagaatttggaactctggttctctgagattggggtctttattggaattttagctgttttcagcagtaaggcctgccttaggtgtgaaaccataaaaaatgggaatcttactaatgcccttcctttctttcaagtgtcaacccccatctactttcttcctgattatggcagttttccaatgccttcaggtagttataggttacccagagtttatagttgtctgtgagaggttcagaacaatggaaactactaagtcattaccagaattagaattctctttcctacctttattttttaaggcgaaaggatagcatttttaaagtagagtgtcgtgatcaccatgttcctgtcaatattagtgatcatttctgtcaatggaatacataattcagaaggaattgctaagcgtaaagatagaaactgcttaggccaggcggggtggctcatgcctgtaatcccagcactttgggaggccgaggcaggtggatcacaaggtcaggagttcaagaccggcctagccaacatagtgaaaccccatctctactaaaaatacaaaaataagtagctggccgtggtggtgggagcttgtcatcccagccactcgagaggcggaggcaaggagaaacgcttgaacctgagatgcagaggtttcagtgagccgagatcccaccactgctctccagcccaggtgacagtgtgagactccgtctcaaaaaaaaaaaaaaaaattaactgcttaatggccgggtgtggtggctcgcccctgtaatcccagcactttgggaggccgacgagggtggatcactttagaccaggagttcgagaccagcctggccaacatggtgagaccccttttctactaaaaatgcaaaaattagctgggcacaatggcatgcgcctgtaatcccagctactcgggaggctgaggcaggagaattgcttgaacctggaaggtggaggttgcagtgagctgagatcatgcctctgcactcctgcctgggcagcagagcgagactctgtgaaaaaaagaaaaagaaaaaaaagaaaagaaattaactgcttaaatatttagaggagaagcactgttttccttatatttcttccacttgaggaatagcacagctttgtgtgacatgctaatttcttctccaagagctaaagatgtaattcttgctaagtgcatgaatgatcttattgatagatggcacgtttttggtcactattaacatgatgttgaaaatgtgtggtacaaaataattttgagttcagaagtcatttttaaagtaaacttaaaattttaaatatgtgaagctggcacagttatttgaatagtcaccatttctattgtatagttttatctgtttatttagaaatttttcattttggaatattcactcaaaagagcatataagaccaggtgcggtggctcacacacctgtaatctcagccttttgggaggccgaggcaggtggatcacctgaggtcaggagttcgagaccagcctggccaacatagtgaaaccccacctctactaaaaatacaaaaattaggtgggtatggtggcacacaccggtagtcccagctacttgggaggttgaggcaggagaatcgcttgaacccaggaggcagaggttgcagtgagctgagatcatgggactgtaccccagcctgggtgacagagtgagactctgtctcaaaaaagaaaaaaaaaaaaaaacagccagccacggtggctcacacctataatcccagcactttggaaggctgaggcaggtgggtcacctgaggttaggagtttgagacaagcctggccacatggtgaaccctgtctctactaaaaatacacaaattagccaggcatggtggtgtgtgcctctagtcccagctactcaggaggctgagtcaggagaattacttgaacctgggagatggaggttgcagtgaaccgagatcatgccagtgcactccagcctgggtgacagagcaagactctgtctcaaaaaaaaaaagaaaagaaaagaaaaaaaaaagaaaaaaagagcatataaaatgtaaagatacaataaagagaataataaaatggaaactattgattcgtcttttactaattattgaccctagtcaattatttatttttttcctttacatctgttttatcttctctctctctgtctttaaatttgaagctcacagacattgccaagcattgataattagggcaaacaagattgcaggtctatgataacgtacagtctgtcctggcaataatagcaaacattgccattcgttcatttatttatttatttagagatggagtctcactctgttacctaggctggagtgcagtcacgtgatctcggctcactgcatcctccgccttcccagttcaagtgattctcctgcctcagcctcccaagtagctgggattacagacatgcaccaccacgcccagctaattttgtatatttagtagagatgggatttcaccatgttggtcaggctggtctcgaactcctgacctcacatgatccgcctgccttggcctcccaaagtcctggattacagatgtgagccaccgcaccccagccacctataatttagtagggaatagttctaaattcctcagatatctgctaactgtagttcagatagctgtttaactgccaacaagttggaaatttcagtgaagtcatcctttaaaaaaatgtaacttgggaccttggtaagactttccacagctttttgaatgtttgttttcacatttttattctaaattatcaacataagtgtgatatttgggctgtttcttttgcagaaaaaattaggatttttcctttgaaaagcaaattgcagcagatttgaatcaatataaaaggttgaaattagtaggagagaaagagcaaaaagcactaaataatttcaacttgagaacatacagtttctttttaatagttctgggcaatttgaagtaaatctacagatggcctcaggtggcagatgtgtgaattgtggtggagggagaaagcatatagccatgaaatacctcaaggcaggatactaattttacagaactgaaactcctttaatttccacgattaacgccaataaaagacaatcttgacttattttttcaactagatatgaagaagctgaagtccggaaaaaacttgaggaaaaagacaggcaggaggaagcacagcggctacaacaaaaaaggcaggaaacaggaagagaggatggtggcacattggctaaaggctctttggagaatgttttggattccaaagacaaaacccaaaaggtatttcaaatttaatgtgtgagttaaaagactgtttctgcttgttagatgatttgcttaaaaagagttgagataccactataaagttcttttaggcaacaaggatgaaatttaatgttttaattagaaatttatttaaggctgggcacggtggctcacgcctgtaatcccagcactttgggaggccgaggcgggcagatcacttgaggccaggagctcaaaaccagcccggccaacatagcgaaaccccgactctactaaaaatacaaaagttagctggatgtggtggtgcatgcctgtagtcccagctactcgagaggctaaagtaggagaattgcttgaacccaggaggcagaggctgcagtgagctgagatcgtaccactccactccagcctgggcaacagagcaacactcttgtctcaaaaaaaaagaaaagaatttgaattaaatattctagcctcagttgacttcagatttttctgtgaatttctatggcaatattttctctgcattaattcgttttttagcagacattataaacttaattagagcaatagaaaaatcatttgagctgagctgtgatttattatatctgcattctggtcctatgtcaaaacttttttaaccactctgggactcagttttcttgtttcccaaattatagtcttgaaatagacaatttttaagtttcttctttctaatcatgtaatttacattaaaagatttagtatactactttgtttggtaccaagccttttatctgtttctgaggtctcattctttttcctttgctttctccttctttttctcccccagttcccccacccccccccttttttttttttttttttgagacagagtctcattcttgtcgcccaggctggaatgcaatggcgtgatctcggctcactgcaacctctgcctcccaggttcaagcgattctcctgcctcagcttcccaagtagctgggattacaggcgcccgccaccacacccggctaatttttgtatttttagtagagatggggtttcaccatgttggccaggctggtctcgaactcctgacctccagtgatctgcctgcctcagccttccaaagtgctgggattacaggcatgagccaccacacctggctcttctttttttttttttttttttttttgagacagagttttactctgtcgctcaggctggagtgcagtggtgcgatttcagctcgctgcaacctctgcttcccgggttcaactaattctcctaggcttcagccttttgagtagctgggattacaggcacccaccaccatgcccagctaattttcgtatttttagtagagatggggtttcaccatattggccaggctgttcttgaactcctgacctcaagcgatctacccaccttggcctcccaaagtgttgggattataggagtgagccaccactcctggcttctcccattttttcacatctatttagtgactacttgtggtcttttcagctacatcatctctttgctaaaagccatcagtgacttagtctgtagctgccagctatcaccgtacctcccttcctttacctcctcagaaactactcttcctaaaatataagttgaaatccatgggaaaatttctgctttgatttttttcttagacattttgtagctttcagttatcattctgtgtggatcatcattcctttcattaaaaagtcgttgttggctgggtgtggtggctcacacctgtaatcccagctctttgggaggccaaggtgggcaggtcatttgagtccaggaatttgagaccagcctgggcaacatggaaaaaccctgtctctacaaacttttttttttttgagatgcagtttcgcttttgttgcccaggctggagtgcagtggcgcgatctcagctcactgcaacctccacctcccaggttgaagcaattctcctccctcagccttccaagtaactggaattataggaatgcaccaccacgcccggctaattttatatttttagtagagacaaggtttctccatgttggtcaggctggtcttgaactcccaacctcaggtgacccgcccactttggcctcccacagtgctgggattacaggcgtcagcaaccgtgcctggcctctacaaacattttttaaaaaattagccagtcatgatagtgcacacctgtagtcccagctactcaggaggccaaggtgggaggatcacttgagcccaggaggtccaggctgcagtgatcatgcaactgcactccagcttgagcattagagtgagaccctatctccaaaaaaaaaaaaaaaaaagggtctagtggggtctttgtttccccatgggaaaaaggggtaagtaccatacaggggtaatcccaaggtggccttgggtaaaaaaaggaagtaccataaggcccgggcaaaaggggcaaaaggcataaatcccaccactttgggagggctggggaaggannnnnnnnnnnnnnnnnnnngtcaagagatcaagaccagcctggccaacatagcaaaaccccatctctactaaaaatacaaaaattagctgggcgtggtagcacacgcctgtaatcccagctactcaggaggctgaggcaggagaattgcttgaacctgagaggcagaggttgcagtgtgccaagatggcaccattgcaatccagcctggccacggagcaagactccgtctcaaaaaaaaaaaaaaaatgtaaactacataagcaatactttgtattagttcattttgctttaattatgtggtggaggacactgaatgggatagccagaatttttgtttgattgtaagaagtactttctaatcaaattaaatattaaatttctgtagcagtttgtgctgttaaattatatttggtctttaattgaagtaaattttgaggaaatgttctatgattctgaaagattgctagttattttagctgttgtctactgccaaagaaaccttttaatatcattattattcatctgcgtttttataaaaggccagtactctgcacagttcgtttcttagagtttccatttaagagaagtaaatgaagtattaaagttgaattttttgtgtctatgaaagttgaaactttttttttttcctatgcaatagagcaatggtgaaaagaatgaaaaatgtgagaccaaagagaaaggtaagtgtgtacagaaggaggaagttgttttaggttctgactgagatcttttaatcagaataagcatcaggttttatacaatgagattcttagcattgttgtctaatctctatgtaagctttatcatttttcctagtctgtacaattatattgaaaatgtctgaggttatttttatgtatttatcatggggggatattttatgaataattttaaccttacatgttaaactggtcatatgcagttgaaaaaatgtcaaaacccaaagcttgtacttgttttcttttcaacatgcagtttagcaataatggttaagagcatggactctcagaagtcaaactgccggagtttgaatactggttcctcctctccctttcggcctggttttcagaatgttgcttaaacattctacctttgtttccttgtctgtaaagtggagataataatagtacttatttcatagggttgttgtcagggttgaatgagctaatatatgtaaattcttagaatacatggtaaactttaagtaggacttattatcatttatgactaggttgtagatttaattttttctccccccatccatcctgtggtcaaagactaaattatttaacagtcatttacatcccccataaaaaaaaatcgaggccaggcacagtggctcactcctgtaatcccagcactttgggaggctcaggaaggaggattgcttgagcccaggagttcaagaccagcctaggtaacatggtgaaacccctgtctctacaaaaaatacaaaaattagctgggtgtggtggtggatgcccttagtcccatctgctcaggaggttgaggtgggagaattgttcgagcccgggaggttgaggctgcagtgagccacgatcacaccactgtactgcagcctatgacagtgagaccctgtctcaaatccaaaccagtaatatggaaattatccataggtggcgttgatgctctagtgacaaatatgtgacctaaacaagactttggaattcctcttcatctgctagagacgttttcctctctcagaaaaggtttaccttgtctacagccataccacctaacgcgcccgatctcgggagcgaagcagggtcaggcctggttagtacttggatcagagaaaaggttgaacttaaacataattataggtaacagtaaaataaattctctacttaaaatattgccatacaacaattacaaaagtaaactgagtgtgctataaggtacttccctaaaagctgttactgattcattccaagattagtttttatgcatttgttcctttgtatgtcatcctgcttaaatgttgtccttctcagtggtttgttaacaacttttttagtctgttttgttagcatacacttgatggctagagatggaaggaggacgattgttagcagctataggtcttttagcataggagctactgagactacttttcttctcacagctcactgctgaaacagcttattatataatctcaactctcttgtagtgccttttaatctttcacttcagtagagctaaggaaaaatagtaacatagggaatatttattttgacagattgctgccctcccccaaaagtaaataaattaaatattgcattagctttacttagtttcctttttgttagccttcttagaaaacaaaataatcttttttccttctggctgggagctaacaaatgaacatcaagtagaatgacaattggcaaatttttcttaaagggatagatggtaaacattttaggcttggggaaccttatgggcttggagagtcctgtggtctctgacacaactattgatctctgctgttgcagtatgaaaaaatgtgtaaacaaactagtgtggcagtgatccagtaaaaacagatggccatagtttttcaacctctgatgtagaatagcaagcttttgacttgttattctaagaatacttggatatctaagtttttcaaaaagctaccgtaagactgccatcagagaccttttgaatttagaacttttccagaattttagaaccatagatatttctttcttccagttagcatttttctaatgtcttaatttttgaaaacatactattttcctgagacacatatattaatgttctttattttatgttggtaacagagtcaataccaggtgtagctgtaaactcaacagaaagttttgatttttaagtctttgtaaacagagcatcgaactggtttcttgataaatgttaaaaacacaaggtcaggtatgtggtggctcacgcctgtaatcccaacactttgggacgccaaggtgggcagatcgcttgaggtcaggagttccagaccagcctagtcaacatggtgaaaccccatctctactaaaaatacaaaaattagccaggcgtggtaacagcctgtgttcccagctactcaggaggctgaggcaggagaatcacttgaacctgggaggtggaggttgcagtgagctgagatcatgccactgcactccagcctgggttacagaacgagaccctgtctcaagaaaaaaaacaagttgtatttaatgttagtttacaagataataaatggtatgatggagtagtaaatatgtggcatccatatatattcagtatactttgctcttctagaaaaagcggtttgtcctgtgttttgtgatgtcagcacatcttgtgctgtttcttgtcacttacactgtctctctcaattccaaggagcaatcacagcaaaggaactatacacaatgatgacggataaaaacatcagcttgattataatggatgctcgaagaatgcaggattatcaggattcctgtattttacattctctcagtgttcctgaagaagccatcagtccagggtgggttattgtgtagtaaagtagtaaactgtgtagtaagtagtaaactgtggaccttagtaaatgttactacttagcatccaagctaaatgtgataaagtagtcttttcctggtaactttttaaatctttgcctctttttatgtgtgtgggtggtgggggagggggagggggaggtaccattttaggagcagaggtttaataggcaaaagaaagagaaagaagaactgctctctcacttttgagagtgaggggtgcccaagtgggatttccctaaatctttgcttcttaaagacacacctccaccctttttgaaggttgaagttacggatttgccaacttttgatttggctgttttctcctattggtggtatttagaatcttatcaaaagagaaatgaagttgccttttccctctctccccagatgtttgttaactgatttttcctattattttctgtttataagcatgtgaatcgtatgtaccaaattgattaaaataatgaactaattgaattgttttacatactgaaattccctatatttactgtgatacacgctacacaaatactttgtgtgtgcttaagttaaaagagtatagtctctgatgccagactctattcaaataactgtcacttactagttgcattattactaggtagtgacctaacatttctaagctcaggtttccatctgtaaaatggggataatagtagaacatatcttacagaggtttcaggagatttaaatgagaaacattatatacacatacacactttagcacaggtcctggcacgagtaaggacttaatttaaatttttttctttcttttttggtaagaaggcctttaacctatgaaataatttaaagtgacttgcatgggtatattgtatattggaaatcatggcatagtggcagagctaaacctccagataaagggctattttcactatttcgagcattcttatgcagatcctattacctctcttggtcttggtttaaaattatatatttttaaaattaggtaataaaatctgtatagttcttggcatattgcagatgcttgataaatgtttgacctgaagcgtagagtgctttgtaaataagctatttaaaaattagagctcttaggccgggcacactggctcacacctgtaatcccagcacttggggaagccaaggcaggcggatcacttgaggtcaggagttccagaccagcctggccaacatggtgaaaccccatctttactaaaaatacttcagccaggtgaggtggcgcatgcctataatcccagctactcgggaggctgaggcaggagagtggcatgaacccgggaggcggaggttgcagtgagccgagatcacggcactgcactccagcctgggctacagagggagactctgtctcaaaaaaaaaaaaaaaaaaattagagctctttgaggaagacgctgttgaaggtagtgctgagctgtggtcagcccgctcctgctcctgctgtactgctgttgctctcgcagaggaaccggtcggtcaggaagccgcacagcagccgtggcttttaaagatgctggaaaaacacccatggagccggagatagcaattcactgaattcgaatcactctctatgagccacagcataaaatccctggagaaggtgtgtgctgacttgatcagaggagcaaagaaaaagaatctcaaagtgaaaggaccagttcaaatgcctactaagactttgagaatcgctacaagaaaaactccttttggtgacggttctaagacatgggatcatttccatatgagaatccacaaacaactcattgacttgcacatcctttctgagattgttaagcagattacttccatcagtactgagccaggagttgaggtggaagtcaccattggagatgcttaagtcaactattttaataaattgattactggttgttaaaaatatatatattagagtactcagtctaattaaacatgtgaatatattcccaggatttgaacagacgaagttataattagtctttgggtagtctagtctgtattaatagagagctggtggtcgttattactgagtttacatggaagtttcccaaaatgtgagatttggactactatgaaactcaagatgattttaggttgaagattaaagaacaatgaaatgcatactgagaaaattattctcttttaatttatgttacagtccttttgagttagtttaaaggagtttcagtttggtgctagtatatcttttaaatacttgcttatctctcttaactgaagggaacaggtctcagagctttctgtaggttacagtacctacaactagctgatagtgattactgtattttttcattatctatttttatttatttatttttgagacagggtctcactctgtgcctgggttggagtgcagtggcatgattacagctcaccgcagccttgacctcctgggtttagatgatcctctcacctcagcctcctgggtagctgggaatacaggcacatgccaccatgcccagctgatttttgtatttttttgtagagacggggttttgccacattgcccagacagctctcaaactcctgggctcaaacagtcctcccaccgtagcctcccagagtgctgggattatagatgtgagccattgcacccggcctatctgttcttaaaattttaagctttttattttattgtatttattttaattttttaaattttaatttaatttatttatttttatttatttatttttgagacagagtcttgctctgtcgcccaggctggagtgcaatggtgtgatctcggccaactgcagcctccacctcccgggttcaagagatttcttctgcctcagccccctgagtagctgggattacaggcacgtgtcaccttgcccagctaattttttaatttttactagacactgggtttcaccatgttggccaggctggtctcgaactcctgacctcaaatgatccacctgccttggcctcccaaagtgctgggattacaggtgtgagccactgtacctggccttttttttttttttttttgagacagggtcttgctgtgttgctcaggctggagtgcagttgtacaatcttggctcactgcaacctctgccttctgggttcaattgatcctcatgtctcatgtctcagcctcccaagtggctgggattataggtgtgcgccaccacacccggctaatttttgtatttttagtagacacagggtttcactatgttggccaggctggtcttgaactcctggcctcaagtgatccaccggcatcggcttcccaaagtgctgggattacaggtgtgagccacggtgcccagcctatttcttttttaaacttttattttaggtttggtggtacatgtgaaggtttgttacataggtaaacgttttcacgggggtttgttgtacatacatattttatcaccgaggtattaagctcagtacccaatagttatcttttctgctcctctccctcctcttacactcccccctcaagtagaccccagtgtctgttgtttccttctttgtgttcataagttcttaccgtttagctcccatattcttaacttttaatacattatagtatatataccgaagtactcctgtcttaagtgtctagcccaatgaattttcattaactgaatgcacccacttaattggcatccagaccaagaaacaatgttatcatcccccctgaacccgatataccccctgtaagttactacccgtatcccactgcccaaggaaaccaccagtttctgacagaatatattctttttgtctgcttttgtactttatataaatggaatttataatatgtagtcttttatatctgtcttctatacccaacctgtgtttgtgacagtcatctttgttattgtgtgtagttgtagtttgttcattctcattgccatatgatgttctgttgtgtgaatatagcgcaatttacttaaatattttatttatcttcagacataccttttacttactggatatgatttcgttttttcatgtatttagggctatacaatttcctattaaatttatttaagtaaaaaattatttttaattaaattaattaaatttaataaaagacaagtagagcagagttggagcagattgtgaagatggtacataaaagacagaagtttgagaaatgttggctgatactgttgtttcccaaagtgttttctgtagaatactaatcctgaaaacagtatttaggtaaatatacccctagggttggaaatagtctttaagaatatcacattttattttttttccttctttgttgaccaagcatccttctgatctgtgtacatcaggagaggatattagtagacaatattttatatttcttctacttctttacttcctggaagatacagtaaccaacattattatataggaactggatttcaaaattaaaatgatcttatttggttttacttgtggataaaagttgtaccagtccggcccagcttgccagtatcatcagttaaatattgaaatgccacgatatactaagtgctttgctaagaataatatggagctccttacccagaggtgtaaatctgtattattcactcattcaattattaaatccaatttttttttttttttttttgagacagagtctcgctcttcacccaggctggagtgcagtggcgtgatctcggctcactgcaacccccacctcccaggttcaagctattcttctgcctcagcctcctgagtagctgagactccagtcatgcaccaccacttccagctaatttttgtatttttaattagagacagggtttcgccatgttggccaggctggtctcgaactcctgacctcaagggatcagccagccttggcctcccaaagggctgggattacaggtgtgagccaccgcgtccagctgattaaaccaatattcactgaacactttctgtgggctgggttactgtgttctaagtgctgggctaagccattgaacaaacaaaaaattgtctttggagcttttaacagagaggtgagataggtaagacgtacaataaaagcttgaaatgtttagtttgtcttatgttgagtgccttggaaatgggaatatcatgtgtgcgtgtgcatgtgtgtgtgtttagaaaggcctcacagagaagttattagcaaatcttgaagaaataagggaaatgagtgatgcagctatctgagggaagcagattccagacagggaaaaagccagagcagaggcccttagggaagagcatgcctggatgaaccaggaataacaagccagtggctggagcgagtgaagggggccagtagttagagatgaggacattgaggcttgagggtgtatgtctgtggcaggccattgtgaggactttagcttttttttttttttttttgagacagagtcttgctttgtcgcccaggctggagtgcagtggcatgatcttggctcactgcagcctccgcctcccaggttcaagcaattctgcctcagcctcctcagtagctgggattacaggcgcctgccaccatgcccggctaatttttgtatttagtagagatggggttttaccatgttggccaggctggtcttgaactcctgacctcaggtgatccacccgcctcagcctcccaaagtgctgggattacaggcatgagccaccatgcccagccggactttagtttttatgtgagcaaacgatgatgtgaacattgtgctttaatggagagttggtgttattcacagttgacggttttaagaggcagcatagcaaagaacatgtacatgagccagattgcctgaattttaattctggctccacttaccttgagcgagtcacttaatctgttcgtgcctcagtttccccaaaatagaaataataatgttcgtcttacaggattgttgtgaagactcaatgagttcaatgagaataaagcatttagaacagtatctggcacatggtaaatgctatatgtgtttgttgaataaacatcctggtatatggtggactattaattatataggtataagagaactgaaatatgaataatactacccaggtgattccccagtttatatttggctgaaagaggagctcagataattttctctgttttcagttttgctccccccttgactttttttaaaaggtcagaatgaaaagaattcagtcttcttttatagtctctaataactactaaaactatgttccaatattatacagtagtgaaggggttaaacatgttaggctgtttaatatcttaatatataacctcaccttagaaaggaatctacttaaaatttgctatggtgtggtaaagactgtggaacaaaactgagtgtcttctgttagtatattaggacctcttgttgacttttgccccaatttaaatattaatacatttcagagtcactgctagttggattgaagcacacctgccagatgattctaaagacacatggaagaagagggggaatgtggagtatgtggtacttcttgactggtttagttctgccaaagatttacagattggaacaactctccggagtctgaaagatgcacttttcaaggtttgcaagtttcattgttagtttattgtaattgcagggcatctctggttgttagaaaggcatgttaactagttgtttatcttaaatactaaaagattcatcatgccttttttttttttttttgagactgagtctcactctgttgcccaagctagagtacagtggcgtgatctcagctcactgcaacctccgcgtcccaggttcaagcgattctcctgcctcagcctcctgagtagctgggactgcaggcgtgagccaccacaccaggctaatttttgtatttttagaagagagggggtttcaccatgttggccaggctggtctcgaactcctgacctcagttgatccacctgccttggcatcccaaagtgctgggattacaggcttgagcagctgcgcccagcccatcatgctttgattgtagaattttttataaattcaggtttaaaagatttgttttggctgggtgtggtaaaattaaaacttaggtggaaaaagatcttataagattacaagatggccaggcgcggtggctcaagcctgtaaccccagcactttgggaggctgaggtgggtggatcacgaggtcaggagatcgagaccatcctggctaacacagtgaaaccccatctctactaaaaattacaaaaaaattagccgggcgcagtggcgggggcctgtagtcccagctactcgggaggctgaggcaggagaatggcaggaacccgggaggcagagtttgcagtgagcagagatcgcaccactgcactccagcctgggagacagagcgagactctgtctggaaaaaaaaaaaaaaaaaatattgcaaggcagggccaggcgtggtggctcatgcctgtaatcccaacactttgggaagctgaggcgggcagatcacctgaggtcaggagttcaagaccagcttgaccaacatgcagaaacctcgtctctgctaaaaacaaaaaattagtcgggcatggtggtgtgcacctgtaatcccagctactcagaaggctgaggtaggagaatcgattgaacccgggaggtggaggttgcggtcagccaagatcacaccattgcactccagcctgggcagcaagagcagaactgtgtcttacacacacacaaaaaaagattacaaggcagaagacaggcagaaatatttacaacacatatggcagtggtttaaaatacctaaaatccaaagagcttctacaaataagaaaaatacttaagataaaatagtaaaataagtcgtgggcacagatagccatgaacagaaagtgaaatgcaagtggacgtaaccataaaaatggcaactttactagtatcagataaatgcatattaaaacgagtgccattttcactgatcaagttaacaaaggtttaaaaaataatacggttgtcctcagtatttgtgggggattgatgctaggaccccccacaaataacaaaatccatggatattcaagtttcttacataaaatggtatagtatttgcatataaactacacatattctctcatgtaatttaaatcttctgtagattccttataataactaataaaaagtaagtgctttgtaaatagttgttataccatattgtttggagaatagtgacaagaaaaaagtctgtacatgctcagtacagacataaccatcataggcctaactatatattttttaaatttatttgttttaattttaatttttatttttttaagagacaaggtttttctcagtcacctagacttgagtgcagtggcacaatcatagctcactgcagccttgaactcctggctcaagtgatcctactgcctcagcctcctgagtagctgggactacaggtacgcaccatgcctggctaattttttaaaattttctagtagagacaaggtattgctatgttgcccaggctagtctcaaactcctggcctcaagcattcctcccaccttggccacccaaagtgttgggattacaggcgtgcaccactgtgttgggcatctaagtatatatatatatatatttttttaatttaatttaattttatttatttcgagatggagtctcactctgtcacccaggctggagtgcagtggtgcaatcttggcccactgcaacctctgcctcccaggttcaagcaattctcctgcctcgtcctttccaagtagctgggattacaggcgcccaccatcatgcacagctaattttttacttactgttttttgaagacatatcttactctgttgcccaggccaaagtgcagtggtgccttctcagctcactgcagccttgacatcctgtgctcaggtagtcctcccaactcagcctcctgagtagctgaggcgtgcgtcaccatcctagctaattttattttattttatttttgtagagatgagatttcactatgttgcccaggctggtctcaaaactcctgggctcaaacaatctcctgcctcagcctcccacagtgctggtattacaggtgtgagccaccacacccagtcaatttgttaaattattaacaatgatagcactgaatgctggtgagcatgtggtgagaagaaaactcattctgctggtaggagggtcagctgattgccgttgagaaagtcggtcttaaaagccttagaacaattcatgctatgacatagggaacccagaaatatacctaagtatgggacaattatatgaaactgccagtattcaactggcattgacctacaaatggcagtttggcagtttcataaagttcaaactaagatatgtgaatgattagtgtatgataaaggtgacataaatcaatgaagaaaagatggattgaaatgaatggtttggggacaactgcccagccagtaaataaaagagaatggatccctaccttatttcttagaccaagctacatctcaaatgaatagacgatataaatgtatagattgaaacagcgaactattaggagaaagcattggtattttttagtaccttgatgtcaaatcaagatgtcataaaggaaaatgaagactgtgtttatggctggccgcggtggctcacacctgtgatcccagcactttgggaggctgaggcaggtggatcacttgaggtcagaagttggagaccagcctggccaacatggcgaaaccccatctctactaaaattacaaaaatttgccgggcatgatggcgggcgcctgtgatcccaggtactgaggaggctgaggcaggagaattgctggaacccagtgggcagaggttgcaatgagccgagatcgcaccacttcactccagcctgggcaaaagaacaaaagtccatctcaaaaagaaaagacatttaactatgtttaaaaaacaaaaacataaagtaaaaatcaggaaaaatgtttgcaatatatatgacaaagacctgttttccctaatattcagagtacattcactgtttactaaaaaaattgcaaataactatagaaaaaggggcaaaggatacaattattaaatagttaagtcatagaacaatataaatccatagtaaataaatgaaaaaatgtccaacttcaccaataaagaaatgcttattaaaacaagataccattttatgttcatcagttttgtaaaaattataaagatgtataatgggcattctcatatcctgttggttaagtgtataaattggtatagcctttctgaagggcaactgggcatcatattaaaccagcaattctactcctaggtaattatcctaaagaaatacatatatatacatgtatatatacacacacatatatgtacacacacacatatatatatatttatttacttatttatttttcgagatgaagtctcactcttatcccccaggctggagtgcagtggcgctatcttggctcactgcaacctccgcctctcgggttcaagcgattctcttgcctcagcctcccaagtagctgggattataggcgcctgccaccacgcctggctaatttttgtatgtttagtagagacggggtttcaccatgttggtcaggctggtctcgaactcctgacctcaggtgatcctcccgcctcggccttccaaagtgctgggattacaggcatgagccaccgtgcccgaccaatatatttatatatatttttaagtgatcatttctaagattagcaatatattgaaaaccttaaaatgttcgtgtaccttagcttaagcaactccctttctgggagttttccttaaggaggtgactaggtatgtgcatgtataaggatcttttgtgtttatttcagcattgcttataattaaatggggaaaaaacccaaatgttcaaacgattgactcagttttggggtctgtgtataaagtagaataggccatgtgcagcggctcacgcctataaatcccagcactttgggctgagccaggtcgatcacttaagcccaggagttcgagaccagcctgggcaacatggcgaaaccccagctcacgaaaagtacaaaaattagctggccgtgttggcgcgtgcttgtaagtcccagctactgggaaggctgaggtgggaggatcaatagagcccaagaggtcaaggctgcagtgagtcgtgattatgccgttgcattccaacttgggtgatagagtgagaccttgtcaatcagtcaaccagtagtcgaatattacctagcattgcaaatgatgatatagctctatagtgatgaaagatgttcatagaaaagcaacatcataaaggttttattgaaaactctctataagagtaaactccagaatgtaaagtggtattggggtggtgaggttatgggtcatttttgttttatatttagtaatttattttctaatttttcttctaagatcattgattatttgtatggtttttaaaacctcacctatataaccatttcatttaatgttgaattttgaattcagttctcattttgtcattatttagaagataaattttgtccttaagggaacaactttaaaatttagatttgttgtgtttttagctgttgaaagattgctgccctatttaaaatatgatttccttatttatagtgggaaagtaaaactgtcctgcgcaatgagcctttggttttagagggaggctatgaaaactggctcctttgttatccccagtatacaacaaatgctaaggtcactccacccccacgacgccagaatgaagaggtgtctatctcatgtatgtatgtgaaaatttttgtttaaaattgctttggtaaaatatggtttaaaattgttttcccggtaacattcttggttgtgtgtgtatttgtcctattagagagcagtttgttttcaggcataaaaatataagcctggaagttcacattttctttaagactgttgtaattgttttttcacttagtttacatttaattactgcattaacacgcatgagaaatgtaagtactgtgtatggggtttgctattctaaaaaacatttttatttttggaattttagtggattttacttatccctcattggaagaatcaattccttctaaacctgctgcccagacgccacctgcatctatagaagtagatgaaaatatagaattgataagtggtcaaaatgagagaatgggaccactgaatatatcaactccagttgaaccagttgctgcttctaaatctgatgtttcacccataattcagccagtgcctagtataaagaatgttccacaggtatgttcttgattttaacattattctcgcttttgttttaatattaaatatatagtatagctgggcacagtgcctcacgcctgtaatcccagcactttgggaggctgagaggggcagatcacctgaggtcaggagtttgagaccaacctggccaacatggtgaaacccccctctctactaataatacaaaaattagctgggcatggtggtgggtgcctataaatccagctgtttgggaggctgaggcatgagaattgtctgaacccaggaagcggaggttgcagtgagtcgagattgcaccactgcaccccagcctgggtgacagcaagactctgtctcaaaaaaaaaaaaaagaattaaatacatagtatagaaacgaagtttaatatataacctttaacatcttagaaaaaagtatcgatgagaacagtctgtatgttttgataaattttttgtttaaaaatttttcatcataattcagcattaccgccacgcctatattagagtagataattaaggggtttccaagccagttggcgatccatttgctacaaacaatgccaatgaaagattgcattatcacagtgaattagaatagcccttttgggattttttgtattataatttgacccatattattttcataaatagcttggcttacatatgataggtatgtgatgtcagtattttggttttaaaacagtgctttagtttcatttccttagaatttgacacgcaaataacaggcatgtttaacaataatcatgtaaaagtttttaaataaccaagacattacaaataaaaaaattttagtttttatatccttcatttggctttatttaaagaaaggttaactaatgttccccctccatgcatttcccaataacattttttagcattcatttttaattttttccccagatatatttaaaacagtatttcacatttaaagtggatgacgtttgatttgtggagcaggtattgaatagaaaatctggtaattttttgttataaactgaagtggttcatttcttcatttttttaaggtcttttagtattgcagaataaattgcagactaaatagatgtgattaaacaacttttcttaaagggtgaatttaggaaagtctaaaaagagcttctctatgttattgcatttcctttcaacttaatctatttaaacgctaatccttttgtgtcccaacataactttatgagatacgtacaattttcagacatattttgaagatcttctatataaaaaacagcatgagggctgggtgccatggctcgtgcctgtaatcccaacactttaggaggcggaggcaggtgggtcacctgaggtcaggagttccagaccagcctggtcaacatggtgaaaccccatctctactgaaaataccaaaattagccaggcgtggtggtgcgtgcctgcagtcccagctactcaggaggctgaggcaggagaatcacatgaacccaggaagcagagttgtagtgagccgagatcaggccactgcactccagcctgggtgagagtgagactctgtctcaaaaaaaaataaaaataaaaataagacagcatgaaagtttgtatatacaagagatgggttcttctgatgtttggaaggagagatctgtataaaatcagccacagcataaggcagaatatcataattgctctacaaggcactggagcacagagcaaggagaatattctagctgagaagatcaaggacgtcttcatggaggagacagtattttatctgggctttaagagtaggattggaggatagaagaaacaagtagaaaattgtatgaccaaaggcatagggcatgctctggggccagtgaacagttttggcatatgtgggcgctagtctctgttggagagaggaagttatgatagtagataagattagaaggatggacaagagtcatcaagagagacttggatcaaatttgaattttgtcctgtaggcacaaggaaccattaaagaattttaaacttgagagtaacatgatcataactatacttttaaaattagggaaaaatagatcaagccaccaaaatgtaaatggaaacaacatttatttttgtttctgttccacctcttattgttaacctcatccccatagtggttcttcctactttattctcaaatacatgcaaaaaaaaagacaaaggattttttttaagaggcagaaagagaagtgaacaggaaaaaaattattttttctacactaacctcgttttctttttcttttcttttttttttgaaaacggtctcactctctcacccaggctggagtgcagtggcgtgatcacagctcactgcagcctcgacttcctgggttcaagcaatcctcccacctcagcctcctgagtagctgggattataggcacatgccaccacgcccggctaatttttgtattttttttgtagagatggggttttgccatgttgcccaggctggtctcgaactcctggcctcaagtgatctatccggctcggcctcccaaagtgctggtattacaggcgtgagtcactgcgcctggcaacttcttttattttctagtagaaaaacataaattcgttttgtaagaacactatgtagattgttattggcacatgttcttataagtttttatttttctttcagtacacagtattctcaagaaatgatgttagggtcacttctctagtgttaacatgctgttaaattgaggtaataaacatttaactcattaaatcaggaacttaggtagtttattacacaacctgaaggaaactagttagtattttacctcatgtaaaagtttttagggaagattgcatttgttccctcagtaacatagttactaactgtgccaggcacagtctttatccttttagagcttatattctaggagggaagaaaaattttaaataagtaattatagttatttgatcagaattccggtagagaagaataaagtattataagagcatgtatcaggggacttggctagttctaggaaccagggaagtcttttcagagggagagatgtgtaagccaagacctaatgtgggcattatctagatgaacagctgatagacctaagttgggaaggagcatggcatcttggaataattttttttttaaggcaagtatagctggtatacacagccatatgactggagaggtaggcagatgtaagaccatacagggcattacagactatggtaaagattttaggtgtactgagagcatagtgggtagcaaatcaaatttgttttaaaatgagtcctctggctataatgtggagaaacagattggggggcgggggcaagagaagagatgggcaactagttgaaagctatgctgtagtcctggtgagagaggaggttgacatggtcttagcctgtggtagaagagatggagggacagatataggaggaaaattaacagcgtgcagaaggatatgggaagaacatatcatgggactcaggtttttgatttgtgcaactattgggagagtgagagtggttacatccatgagattaggaccatgtttgtcggggtggggggaatcgtgaatccgttttggctgtatggggtttgagatacatgtgttgacactcaaatggaaatattgggtaggcatttggatacctggaagtggaacttaagtctaagtatgcccaggtctaggttttatgttttagaataaaagacatttttaactcttttgtatacaaaacactcaggaagaattggaagtgttgaatcaagaggatgtaagttccagtgatgtttgaatatctaccattcaagttctgttttatgagaaatcttgacactgagtaattaacaaatagatgtgctgatagatgttgtctccacaaagtgacacttcttttatcacaacttgatctcaagaactgaggttatttcctgatttttgacaaaaatgttttgctctggttttgttgctctagattgatcgtactaaaaaaccagcagtcaaattgcctgaagagcatagaataaaatctgaaagtacaaaccatgagcagcaatctcctcagagtggaaaagttattcctgatcgttccaccaagccagtagttttttctccaactctcatgttaacagatgaagaaaaggctcgtattcatgcagaaactgctcttctaatggaaaaaaacaaacaagaaaaagaacttcgggaaaggcagcaagaggaacagaaagagaaactgaggaaggaagaacaagaacaaaaagccaaaaagaaacaagaagctgaagaaaatgaaattacagagaagcaacaaaaagcaaaagaagaaatggagaagaaagaaagtgaacaggccaagaaagaagataaagaaacctcagcaaagaggggcaaagaaataacaggagtaaaaagacaaagtaaaagtgaacatgaaacttctgatgccaagaaatctgtagaagatagggggaaaaggtgtccaaccccagaaatacagaaaaagtcaacaggagatgtgccccatacatctgtgacaggggattcaggttcaggcaaggtaagcagaaacagtacaaattgccaacgaagtgaaagaaaatgtatatgaaaatgtgaaaacaccagtggcattccataaaagggcaggcatttcaaatagtcttttcaggggtgatagaatgtactgatctatccacatttgctcatctattctcctttgaggccagtgccatacatttatgaaatgattggttgggaatgaaattgctttttgtatattacatctataaaatgcaatatatttcaaataattgagataaatagctacattcttcatttttatgtttgatgtatgatcatgggaagactagagtgaaatataatctccttctcagtatggggaaactagatgctaatatttgtatgatagaatttatatctgtttagaatatatccaaaatcagtgacatctaaatggcctaacatttatctttgcatatagtgattttttggtcagatcggtgtcattttgtttcttgctttatctatttaaataatattggcaaataacccaattaattttgcccttggctacacacccaaaattgatagccgtaattttaggggactttttttgttattctttttcaatctctaataatgctatgcttttctttttttcttcattatgtcattaacaatgccttttccttttgaacaccaagtatatgtttataataccaagaacagttatggtcctttttacatatgtataaatggaaaaaacatttttagtagtgtggaaatgacttctaatggaaggcgggataccatctttacagaatgtcaatttctatacttctcaaacacaattcaggcatgttaccaaaattaattcatagtcaagctgctcttatccagggaacacttatctggtaacctctgctattaaaaaagatagcttccatccaaaaaccttctaaacaccccaaattggggatatgaagcccatgtactaaaactctctaattttattcacaggaggagcaaaacatgtgcactccaagatacaatttaagtattattcattgagtagctactatatgccaagtattttcactgcattgtcttatttacccctaatgataaccccataaggtatttaatttacaagtgaaactgaagtttagaggttaagtatttgcctaggatcacatagacagtgagattccaaagccacttcttttccatcttgctatactagaggcatgcagtctttagaacttaaatcattcatatttgtggagtcatttagtatataggtgccaaatattcctacacatctaagattgcattccttgtgtgctccttttaaaagtaggagaaatatgtaatttattctagaataaattttgttaaaattatcactaattttaaaaagtttttagtagagttattttaaaataagatataaaacaaaaatgagtttttaaaaagaatctacgggccgggcgcgttggcccacgcctataatcccagcactttgggaggcctagacgagcggatcacttggtcaggagatcaagatgatcctggctaacacggtaaaaccctgtctccactaaaaatataaaaaattagccaggtgtggtggcgggcgcctgtagtcccagctgcttgggaggctgaagcaggagaatcacttgaacccatgaggcagaggttgcagtgagccaagatcgtgccactgcactccagcctgggtgacagagcgagactcggtctccaaaaaaaaaaaaagaatctgtgatgttataagaagatatgaatatagatttttgcattttttactattggtctgtatcttaatttcttctttctcttgaatacttcaaattttttgaagcacaactcctttcaagataaccaaaatcgtaatagtatttaaataaaagaataatgttcaaattaggtcatggtgaatatacattaatgatcagcattttatacttggccatgtagtgtgaaccagtgcttcacagtccactttgattttcatcttttttttttcttcactgattcatcagagttctttagttttttaagtattttgaatgtgacagtaaaatataataaaattttcagaggccttttttttctccttttacattttcattctcatagattcggttgtgttagctagtagctttatgttgggaggagaattaaagttttctttcacttctgtaattttaataattttacagccatttaagattaaaggacaaccagaaagtggaattctaaggacaggaacttttagagaggatacagacgataccgaaagaaataaagtaagtagtttattgcaggaaaaaactggaaaaaaaagccaaacatggattataactatgtgattatcttaccacactgctatcttttatcatgagatctacagtgtaaggggatcgttgccatctttggtagctggtgttttgcttgtttttgcatgatcaatccatttatatgctaaaggaaatagtttgtcttcctgtttaaagtgtgacagcgtattctatttattttatgaaagtaaaaaatgtttaggccttaccatatgatccagcaattctacttcagggtatatacccaaaagaattgcaaacaagaagtatttgtacacccatgttcttagagtattattcataatagccaaaaaatggaagcaacccaaatgtccatcagcaggtgaatgcataaacaaatatggtatgtacatgtaatggaatattattcagccttaaaaaggaaagaaattctgacacgttacaacatggatgaatcttgaggtcatttgctaagtgaaataagccagtttcaggataaatactgaatgattccatttctatgaggtttgtaaagtaggcaaatgtatagagacagaaagtagaatggtggttgtcagagctggagaaaggggaaatggggagttattgttcagtaggtacagagtttcagttttacaagatgaaaagagttctggagattgttggcacagcaatatacttagtatcactaaccagtgcacctaaaaatggttaagatggtaaattttatgttatgtgtatttcatcacaattttttaaatacataggctttgtataagacatctttgctgggagcggtggctcacgcttgtaatcccaggcaggcagatcacgaggtcaggagatcgagatcatcctggctaacatggtgaaacgccgtctctactaaaaatacaaaaaaaaaaattagccgggcgtggtggcaggcacctgtagttccagctactcgggaggctgaggcaggagaatggcatgaaccagggaggcggagcttgcagtgagtcgagatcgggccactgcactccagcctgggcaacagagtgagactccatttcaaaaaaaaaaaaaggcttctttgcctttgtttttccttcagagcttgagatacaatttgcataccataaaattcacccatttttagcatgcagtttagtgattttttttttttttttttttttttttttttttttagtaatttagtgttgggaaaccattaatacaatccaattttagaacattgccgtcacaccaaaatgaccccatgcccaatttagtctaccctaaagcccaggcaacactgagtctactctgtctccatagatctgccttctctgggatatatatacagtcttcccttggtatctgtagatgactggttccactacctccctctcataccaaaatctgaggatgctcaagtcccttatataaaatggtatagtgtttgcatataacctatacacatcctcctatatactttaaatcatctctagattacatacctaacacaatgtaaatgctatgaaagtagatgttatcctgtattgtttaggggataataaaagcctgcacatgttcagtacacccagagttatttttttcaagtattttcaatctgtggatggttgaattcacagatgcagaaccgatgaatacagaggactgactccatatccaatctaaatctatgtgaatttaacatgttaaatttttgttaggtcattctgctgtattttgccattaaaaaaatctgagaccagccttggcaacatagcaagaccccatttctccacagaaagagggggaaaaaagggtatggttgctcctgcctgtaattccagcactttgggaggctgaggcaggtggatcgcttgagccccaggagttcaagaccagcctgggcaacatggcaaaaccctgtctctagaaaaaaatattaaaaaattagctgggtttggtggcgcctgcctgtagtcccagctagttgagaggctgaggtgggaggatcacctgatcctgggaaggtcaaggatacagtgagccatgatcatgctactgcattccagcctgggcaacaagggtgagaccctgtctcaaacaaaaggggaaaaaatgacataaaatatattaaggctagaatgactgactgaattcacagttttcttatttttgactgcaacagttaaagagccacagcaacaacaaacccattgatatttatacaaaaaaagttcattaactacagaagtcaaataatttatacaatttatttgtttagatctaagattaactaaacataacacataacccattaaaaccatgttgtgtaagaatgatacaatggactttggggacttgggggcaagagataaaagactacaaatagggtgcagtgtatactgctcaggtgatgggtgcactaaaatctcacaaatcaccactaaagaacttactaatggccgggtgcggtggttcacacctgtaatcccaacactttgggaggctgaagtgggaggatcatttgagttcaggagttcgagaccagcctggccaacatgatgaaattctgtctcaacaaaaagtagccgggtgtggtggcgtgtgcctgtagtcccagctacttgggaggctgaggcaggagaaccgcttgaacccaggaggcagaggttgcagtgagcctagatcacgctactgcactccagcctgggcaacagagcaagactccatctggggaaaaaaaaaaaacaacttattaatgtaaccaaatatcacctgtaccccaataacctatggaaaaataaaaacagaaaaaaacacgttttattaaagttcttctaagaacgaaaaataaaatttcttaagatgtgtaagccttacaaaaattaagaacttaagccttagtcaaacagcagtgctccaaaagtgaaacccaaaggagctgaaaatgagttaacaataagagaaaatgaagagagagagagagagagagacacacacacatgccttctcttcttctgacatccttctgttccttttaaagagaaagagtagggattagatgactggaaccacaaagtgaagactaaaaaatagaaagtgaaaattgaggtttgcagttactcccactggtcctgacattctaagcagggcttcacaccagctacagccaaggtctttggcaacattgaaaggaaaactaaagtgtctttgttggccacccaccatcttgccccatctctgcccttcaggaagcaagggtactcaatatatcttctggctgtcttaaatctcatactgtatgatccactctacactcattctgtgtaaaatgccacagacaactaagtattgatgaaatagcattttaaagtaattctcacgcattaagaaggctcaataaaacttactgtatttgctgagcaactactatgtctctagcactgtgctaaatgcttgagggcagtgtttttaaaatccctaaggtcataatcagtataagtataagcctaggtgtggtggcacaagcctgcagacccagctacttgtgagagtgaggcaagagaatcatttgtgccaagggttcaagaacagcctcggcaatgtagtgaaaccccatctctaaactttttttaaatgacatttgcaaacattttctcccaatatgtggcttatcttttcgttttcttgatggagtttcttgaagcacagaagtttttgtggaagtccattctgtcatatttttcacatgtggattgtgctgttggtattgtatctaaggaacattttttctgacccaaagtcctaaagtaatgaagatgttttcttcttaaggtttcagttttggtgcttagatctatgatccatttcaagttaatttttatatacagtgtggtaaggatctaaatccatctttttgcatgtggatatttagttgtgccatttgccttcattttgacagaatttttttccagcacacatattctatttattacatgtttgtattcaacagaatttgtcaccaggcaggagtacagtggcatgatcatagctcacctgaccacctgggctcaagccttgaccacttgcctcaagcgatcctcccacctcggcttcctgagtagctaggaccacaggtgcatgccatcacatcaaggttggctttttttttttttttttttttttttttggagatggagtctcgctctgccacccaggcgggagtgcagtgacacaaactcagctcactgcaacctccgcctcccaggttcaagcaattctcctgccacagtctcccaagtagctggaattataggtgcataccaccatggctggctaatttttggatttttttttttttagtagagatggggtttcaccatgttgcccaggctggtctcgaactcctgacctcaggtgatccacctgcctcggcctcccaaagcgctgggattacaggcgtgagccactgtgcccggccaaacctggctaattttaaaaatttttttatagagacggggtctgtgttgcccaggccgatctcaaaactcctgggctcaagagatcctcctgtcttggcctcgcaaagtgctggattacaggcatgagccaccctgcctggcctagaatgtatgtatcttaagacatgaagaatataaaaatagaaatgggtggttcatcaggcgtttttgttttctattaattttttaaaggaagtggaagtatcacattcaattatattgaggttgatgcctcaatatattggcttgtttttacttatataacatttcatcagtattttgtgggatgaatgaatatagaagaagaaatgttaggagagcaagatgactttaggtagatttagaataagccaagataatgaagttttgtagcctttcttgtgaatattcatttgctaggatactataacgtctattctctacttacacctcttagcatatagagaaaaggcacacttagtcctaaagaatacattaggtttatattttacgtaatcgtttgctgtggaaaactaaaaaaaaaattttgactaaaataccttgagatgcaaaattaaaaaaaaaaatgtggcctttcttatttgcttggatccactgtcttcctccccgtgaactaccacagaaggccatctacctccaccttgccacctgctatcattacaggcttagacatactcctctacaccttggtatagtaatatttgtactttgagaaaaagataatttttttcatctctgaatctgttttttaaaatatgaagggcagccaaggcaaggttttttgattctttggtacaagtagcttaagtttttatatgacaaaatttaattgaaaaatcagatttaaaaaaaaattttttttaattttttttattttattttaattaggctcaacgagaacctttgacaagagcacgaagtgaagaaatggggaggatcgtaccaggactgccttcaggctgggccaaggtaaaagtcagaattagcagtaaaatagccactgtgttcctaaaaaatgttttatttgtttattttacatcttctgtaatgcagagtcaattccatttctccattatagagaacatagcttattcccctaattataacagggtgagatttctcaatacccaacctgagatgctggctacaatatatgagcattctggcatttatcatttagaaatagtgtattactttaaaacctaaatttcttttgaagtttatcgccattttattcgaattattttaatccaaaagtaaatttagcagaatactttggagtgatttctttgtttatataatgctaattttgggttttgaacctgtttttttttttcttttccatctaagtttcttgacccaatcactggaacctttcgttattatcattcacccaccaacactgttcatatgtacccaccggaaatggctccttcatctgcacctccttccacccctccaactcataaagccaagccacagattcctgctgagcgggatagggaaccttccaaactgaagcgctcctactcctccccagatataacccaggctattcaagaggaagagaagaggaagccaacagtaactccaacagttaatcgggaaaacaagtatgtttatcttaactcctagaactaaaataatgtgctgtatttcaaagtttctactctgaatctgtcagtatgttagtgtcagggagttggaaatttctgtggatggctataccagccgttattatttaccacagagaacaaaacaaatgaatagagaaaatgttgttggtttttctcccaagtgctcacttaatatcataccagagaggattattttaagtgttaatgtagatataaaatcattgttatgttttacagtttcatgccagagtaccctcacgtttttcatagaccgcctgtggtcccggaatctccctttgaggaccataattttcagcaatattgagcttgccttgttgcagcactcaagttccaaactttttttccccttagccaataatgtaagcgaagttttcctatagtattaaaataacaagcactttagtatatcatcctctaatccttattctgttcccttttccttcgttgtagttttgctattctgtttacaaatattgaccaataggttaggtttcccaaaatagtttcatttagctatacttctggcttcgtcccttttggaatcctcttagcttatgactgatagggctatgaggagatgatttaagtctgtgtaccacttctaatctttacttacttttttgggaggaggggggcaataggtggaagtataaataaatgatttttttcccatttattatacacttgtatttgctaaggaattttaattaggctcttttaagcctaatcctaagtaagttgaacacatcctaagaaagttgaaattttttcttcctgagaacttaccctgccaggtgcagacttattcgaaggagcttttaaaaattctattaatcttgttatagattttagagttcattataataactagtgagatttaatttcttcttgaatcattcttaagtgtgttaatttgataatgttttaaggactgtatgctgtttgtgtatttttttatatattgaacagaaaaagcacacgagtacatgcacctgagtacaggtaaagaggagctgattgaaatatagtttaatctgttctcagtattacttttaggggtggaagaacgttaaggattaattaaaaaagaaaaaagacctatcagttaagattttccttatgcttcagcagttctagtagttccacatataaatcaaacacaccatattacagaagtctagaaggcattctctgccccagcactgtccagcagatctttccatggtgatagaaatgtactgtatctgtgctgtccagtatggtttgtgtctactttgaaacgtgattagtgcaactaaggaattttttttttttgagacggaatctcaccctgttgcccaggctgaagtgcagtggcatgatctcagttcactgcaacgtctgcctcctcaagcgattctcctgcctcagcctcctgagtagctgggactatagacgtccactatcatgcccagctactttttgtatttttagtagagacggggtttcaccatgttggccaggctggtctcaaactcctgacctcaggtgatctgcccacctcggcctcccaaagtggtgggattatagacagccattgagcccagctggaactgtatttttttactgtgattgtgtatccatccgtgaatagtcaacacactctagaatttaagtaatagtacccaaataacctctgcttcccttgatatctactccacggtatggttttttttgtttttgtttttatttttttattattcctcatttggcattctgggtgagttcaaacatttgataatgccaaacttccagggatcatttaaaggagtttaaaagagccttctctactagagctcctagttcatgagaagtgagataatctatctcaaggtgtctctaagaaccatgacccacattaagaggttaaaggtatgtgtttcatgggaaggtctgagaccttagtcgtatgactaatgttaacctaaatattaaatgtcctggaaggcccagcatcttatgagttaacatattaactgtttacaagatgcctgtggtacaggtgctacagtttgctgccatttatagtatagaaccttaatttcatatgctcagcattttaagacatcttgtatcctttttcttcctcaggccaacatgttatcctaaagctgagatctcaaggctttctgcttctcagattcggaacctcaatcctgtttttggaggttctggaccagctcttactggacttcgtaacttaggaaatacttgttatatgaactcaatattgcagtgcctatgtaacgctccacatttggctgattatttcaaccgaaactgttatcaggatgatattaacaggtaaatacatgtcatactttttgcattataatgctaaaaggatgatctaaccatatttactgtcttagtccattagttttctgctgctataacaaaatacctaagactagataatttgtaaagaacaaaaatttattttctcttagttcttgactgggaaggccatcgtctaggtgccggcatctggtgcgcttttttgctgcatcctcacagggtagaaggtggaagcgaaagaggacagactcgtcctgtcgagccctaaacggcacctaatcctgttcacccgggaggggagccctcatggccttatcacctctttaaaggccccatctcttaatcctgtcacattggcaacacctgaattttggaatatttgacgtgaatctggtggtaacctatgaataagtaagcattttggtgtagggctacagtatgtgaataatttcatgttgacatcaagaacccattttacctttcaaaccatagtacttaccactcagctccagaaaagtcaaattaggaaaggggaaaatatctttatccttaggaataatgaaggctgggcatggtggctcacactggtaatcctagcactttgggaggctgacgtgggcagatcacttggggcccaggagtttgagaccagtctgggcaacaaggcaaaactccgtctctacaaaaattagctaggtgtggtgatacatgcctatagtccctgctacttgggaggctaaggtgggaggatcacctgagcccagaaggtcaaggctgcagtgagccgtgattgtgccgctatactccaccagcctgggtgacagaatgagaccctatctcaaaaaagagtaaagccttctctgattagtaaaggacagacaggatgagagcagtgccagaaggcagaacctcgctgtcatgaactggagcctgttgatgatgaggagaccatgcagggcttgcagccaaaagaaggaagctgaagggatgtaagcaagtcagattcagatgagaatctggtggtgagcctgcaaataaataagtagtttaatgtagtgctacagtatgtgaataatttcatgttgacatcaagaatctactgtaccttgcttaacttttaaatttcctttattgtcttttgtaacaacttttatttgcacaggtcaaatttgttggggcataaaggtgaagtggcagaagaatttggtataatcatgaaagccctgtggacaggacagtatagatatatcagtccaaaggactttaaaatcaccattgggaagatcaatgaccagtttgcaggatacagtcagcaagattcacaagaattgcttctgttcctaatggatggtctccatgaagatctaaataaagtaagaaatttgatttttctaagttgcagagactctttagggttgctcagtagcactgtatttttatagcagtttaaaattctagttggtgatagttcagtgcttgtttattcaaatagtgactgtataagagaattataaaacatcaggtaagtgtaatatttgaagcatatacagttggtatttactaattaacaagcagtattgctgagaaatttgcaaatgttaaaatagttattggcgtttgtgacccacatgtatgtgaaagtaaaatcataaacaaatgatcttataaaagattatagacagtttgagcatttttattgtatgttatgtttatataatatgtatatgttattgtacatatccttattcttttctttttcccagtcccttgctgaaagtggaacatgcctttattcttacacatccttctaaaataagaattacttggctgggcacagtggcttatgcctgtaatcccagtactttgggaggccaaggctggtggatcacctgaggtcaggagtttgagcccagcctggccaacatggcaaaacctcgtctctactaaaaatacaaaaattggctgggtgtagtggcatgtgcctgtaatcccagctactcaggtggctgaagcaggagaatcgcttgaacctgggaggcagaagttgcagtgagccgagattgcagtgaccactgcactccagcctgggcgacagagtgagactctttctaaaaaaaaaaaaaaaaaaaattactccatgtaaccaaatgactcatgtgactagttattataaaggcatgtatgtatacataaatgaccaccctccatttacatactacaacttctttttagcactttttgtctcacatattttggggtcaccattcttaaccactgaacagatatatatatatatacacacacacctacacaaaaatatttgtgtgtatatatatatacgtgtatatatacatacatatatacacatatatatacacatacatatatacatatagagagagagagaggctagggcaacaaaattatatatgtccagttgtagccctaattcccagctatatgtgggatatcttttctaaaaaccaaactttttagctttttctttttttagtagagattggaggggggggtctcactatgttgcacaagttggtctcgaactcctggccccaagcagtcctcctgccttggcttcccagaatgctgggattacaagcatgaaccaccacatctggcccttttcagctttttaaataaaaatttgggaaatttcaacaagtcacattccttcaataaagtgagtgagttttttttggtatttttggctagaattattttttgccacactcagtgagatcagaactcctttatgagaactacaggtgtttctaaatctggcaagtgtttgtattcacttttattctttcaatttaaatgttttctttgagatattaatatagagcttaaatcattttatttccaggctgataatcggaagagatataaagaagaaaataatgatcatctcgatgactttaaagctgcagaacatgcctggcagaaacacaagcagctcaatgagtctattattgttgcactttttcagggtcaattcaaatctacagtacagtgcctcacatgtcacaaaaagtctaggacatttgaggccttcatgtatttgtctctaccactagcatccacaagtaaatgtacattacaggtaagtttaagaagtagagagaaaatgatttattggataaaaatgctgtttttatggatatagagatgtaaatttctggtctttacccttacaaacattttatcagtaaaactcggccgggcgcagtggctcataccttgtactcccagcactttgggaggccgaggtgggcggatcacgaggtcaggagatcgagaccatcctggataacacggtgaaaccccatctctactaaaaatacaaaaaattagccgggcgtggtggtgggcacctgtagtccccgctactcaggaggctgaggcaggagaatggcgtgaaccctggaggcggagtttacagtgagctgagatctcgccactgcactccagcctaggggacagaacaagactccgtcttaaaaaaaaaaaaaaaaaaaaccttttatcagtaaaactcaatataaattctgttttataattaggcctatgtagattagaaagaattagaaatttcttttttaaagatacctttattaaatattctttcaggatttcaggattgttagtatgtttttaaaaagttttataagttaatttggaaagttgtctgttgactaacttaggcctacttttcataagcatttgctttacatggggatatcaaataaatatcctgttttccatgtatcaacaatgtttcttatataaaagcttgttgatacctttagtcttaaagtacctccagaatgtcatttcctccaacagggtttctctgattgaccaggttaggggctttcctgtgtcctgtcacaacacactgtaggtagcactcaccacactctgtgctgtcattgttcacttgtctatgcttctcactagatcacaagctttgggaaggcaggaactcttttgtgtagattgctgttgaatcactggtgcctgcagagtgactaactaaataggtgctctctgacattattgaagaatcgaattaacgagtatctgctacttgtttttttctgccaggattgccttagattattttccaaagaagaaaaactcacagataacaacagattttactgcagtcattgcagagctcgacgggattctctaaaaaagatagaaatctggaagttaccacctgtgcttttagtgcatctaaaacggtaaaggggaaagtttgtcctcctgttcagtgaaattaaatgagggaattttaagttctgtgtaatttatacttgttgtactgcctgccatgggcacataacaaagggcgattatctggttacagtagatctagggaaataaagcagaaatgagactgttagttcacctcagtgttttcagtaccacagcaaaatgacaataccactatttcatgtaattccttataattttaaataattacaaagcatcaagtgaaaatgtataaaaatattacagtataattcaaacaaattagcacatgaaatgtaacattcaaacagcagactaaagcataacagacttagttatgtgttaaataaaatttataatttttaaagtattttaatgataaaatatgttaacgataccattaagtgcagaaataatttcatccagatttttccaattgatggaaaagatctagtcctataatagaaggaataatgacaagagttataaaacacgaaccagatcttttgctgattctttggtcttcacataatcacataatccatgtaactcaagaactttgagttgattatttgaaaaactttttaaaggaagttgcacttttttattgagagctgtaatttttgtgtcaaaaaagcatttctgttaaaaatgttttatcttgtattgagattcttagttccatatattaatttccaaatttacatgttcagatttctcttgtgtaaatttttctaacaaaagctagttttttccattgtcctagttgaggattctggaagtataaacattctataagtgattacacatttgctaaaatttttaatgctgaatattttcaaaattatgaaataaccatattacaccaaccaagatatcattgttttgatgtttaaaggagcagaatatgccagaataatggaatgaatgacattattttagtcagtagtctcctactctcaatttctggctctagttttctctgaagtacaagcttgactcgagagcagctgtcattctttcttttgtggtggtcagcattataaacatgtgggtcttaccttcctagaagactcatgtagcagttgtagctggaccagagtatagtcctacctctaccattctggctgtttgaccttaggcacatcattaaatatccatatgcctcagttttcttgtttgtaaaatggaaatgaagccaaatgtctttaacaggttcctctactactaaaattccaagtctttgtatttgaaatggattttacagtcctggctaaaaatctagatgttaatgaatgaggattcatcctggtatcttcctctgtcagtgtaattgtaatgttttgttctgcagtttttcctacgatggcaggtggaaacaaaaattacagacatctgtggacttcccgttagaaaatcttgacttgtcacagtatgttattggtccaaagaacaatttgaagaaatataatttgttttctgtttcagtaagtatctctttgaactgaagactttttgtttcaaagcaagtttaaaaaaagttttaagtggtttcctacctcatggaagagtaagaacaacataaagctttgaaactattggcgtattttaaataacaattttaactgaattgatttttttttctatcttgtttggcacagaatcactacggtgggctggatggaggccactacacagcctattgtaaaaatgcagcaagacaacggtggtttaagtttgatgatcatgaagtttctgatatctccgtttcttctgtgaaatcttcagcagcttatatcctcttttatacttcattgggaccacgagtaactgatgtagccacataaggagacataggttataaactagttatcttttaaaaggctcagcaacacaactcttgaaatgcttatcaggataatggtagctatagctggccatttagaggaattctaggacagtgggagctgtgttactagcactatataattccggtcagtgctgacaaataacatttaacaagtattgcagtaatcatcacttacaggtaccatttatttcaaaacaacttttttagtctgctccaaagttaaaataattaactagctaagcattattattcgactggtctaaaaactattgttatctttttttttccttttcactgttatggccttttcacatttctaaatcccatcttgatatactatgaatactctagaatgatgtaaagcagataggaatgtatgtgtacatatttattgcatacttgcacatcaaatcgatgtacatagtttaacacgtggtccttttgtgaaacctagaactcagaggattgctttttttctttcagcctattttgagtaacttcagtgctttcttagggaaatgacagggcaaagcaatttttctgttggctttgggctgtatttgtgcactaaatctttattctaaaaaaaaaaatggaaactttaatttttttaaaacgagaatttcatttacagctacattaaaatcttaatgagaaaaataatttataaccctgtgggtgttctgtctttaatattgtattatcaaatataggacagtaaaaccatagattttatatacacacgtgctatataacaacacccagagtcattctttcaagactagtattctcacatattgagaatattcattctaaatattaaagtaaaaatgccgggagtcaggcatgattgcaaagtgaactgcattataaactacatctttacagagtgatgtattaagagggttaaaggagcttataatttatttaaccgagggactcagttgctatatatatagtcagtaaaacactccatataaaaataagattctaaaagtgcttcagaaagagaccaccattagcaggctctcagggagaagatgaaaggatggggttcaaattgtgaagctgacaacttttcatgttttacaattagtctaagagaccacttcttggctaaattattatatcaaatatattcaaatcatattcttaaactcatcgagccatttgaacaaaaattatttttgtttagcttcatgagtatctttggaaaataatttgttgaatatatatgattatgagatattttctgataaacactgaattttgaaacctgaactcactatataattgcagtgttttgaaggcctgcatccattagcattgcattatattcacactgccttttttagtgaaccaagacccatcttctggacgacagatttatcttaagatgaaaggttgtataacatgcccacaaggcataaaaatgttaatgatgcaagtaagttctaagagtttaatgaccaagcaaaactctaccaccagatgctgactgcttgttttgcagtgttcaggaaacaccattttcctggctcttaacgcttttgtattggtatggaaaagggctggcagctatagaacaggagatccatagcattttgaacagaagtatctggaatctcactgactcgtgtgttatcaaagctatatcaggcctgggtgactgaattcttgcagaaagcagtgtagtggccaccatccaaatcaccaaaatggttctatgggagaaaggaatgtcaaacttagtattcacatatgaacactaactactggaacagaaatgatagggccaagagatgctttttaaattgtcccttattctaaattaaaaggaagtgataattttgttgttaaatcatgcatatagcctgactgctatattgcttctcatttcattgtaactacttatatgttgtgcccattgactatcatctgtgaataaagaaagacaatatttagcagcatctgattaatgtttatcagtgaacatttagttagcacttaatatacatcaactattaagcattaaaggaaattttacaataagaagataattcaggccgggcacagtggctcacacctgtaatcccaacactctgggaggctgaggcaggtggattgcttgagtccaggagttcaagaccagcctgggcaaaatagcgagactccatatcttttaaaggaaaaaaaaaaaaaaaaaaaagatgagctaggcatagtggtgcacacctgtagtcccagctacttgggaagttggggtgggaggatctctcgagcctgagaggtcgaggctgcaatgagccgtgattgtaccactgcactccagcctgggtgacagagtgagaccctgtcttaaaattgtaagttcatttacgtaagatggcttcttttttttttttttaaagttaggataagccacagaagagacatttaacattagaataaggatcttaactgcatattgctacagcacaaattgagggggctatgtagcaacaacccctcaatcccccatagggtacaaaaaataatgtatctcattttcctttttccatgtctttcctaacccagtattgtttggaacaaaggcattagagaggtgtacttccaaggaggtgttatggtgtatgataagggtcagcaaaccacggcccg

SEQ ID NO: 12468 - DNA, 44430 bp, Human
gcccgggaggcagaggttgcagtgagccgcgatcatgccactgcactccagcctagatgacagagccagatcctgtctcaaaaaaataataatggggctgggcacggtggctcatgcctgtaataccagcactttgggaggctgaggtgggtggatcacctgaggtcaggagttcaagaccagcctggccaacatggcgaaaccctgtctctacaaaaaaaaaaaaaaaatacaaaaaatagctggatgtggtggcgggcgcctgtaatcccagctactcgggatgctaaggcaggagaatctcttggacctgagaggtggaggttgcagtgagttgagatgtcgcctcgccactgcactccgcctgggcgacagagtgacactacgactcaaagaaattaaaaaaaaaaaaaaggaaaataataataataataataataataataaaatcaataaataaaataccaggccggaggagccacaaccagaaaaccagcattcctctagctccacagcaccaggctgagacgcagctgatatcagggaatccatctggatcacccatcaaaagccccaaagcacctttcggtccagccagtcctcagggagtgtctttgctcagggaggcaccgagaggcggagaggaggaggggcccagtcctgtcccaggaggaagagcacagaatctgggggtgtgcatgatctggataggggtcagcagctccagaccaggctggaagttgaggctctcaggagcgggtgaggggctgtgttgttggggcagggcgcagctgcagctatctgggaaagcttcctggctgcagaggcacagaaggggtttggggtttgaacagccagctgtgcgggctcaatcctggcatctctgaccctgtgcagccttggtggatggcagagactgaggctctagaaggcagagcccagctcgtggtgggaggcagataagggctggggtgaggctgtctgggtctctcaagctggagggagcggcaatcaggctgttctcttagctcctccttttggcggggcgagtggtttctgccttcctgcgacttcctcctctgacccgctgccacttctcctggccctcctggggcgggtggagctcgggagcgctgaggcggaggctcatccatctctcccctccctgggccagggtcagtcccctgggagccctgggcagaagacccccccaccccaccctctcgggcccctctggggagccccacctttgctccctggttacatttcctgctggggtgacggtgtgagtctagggtaacgagcctggttttctgaactttcttatgcaccggctctttgttaaaggttctggttatgtgaggaataacccctcgccggtgggcattggaaaagaataaagaaagcagaaacaccaaataaggagaacatccagcactttcctctagagaagacccgcttattcagaggctttcgggttccctctggagtcacttcgcagaattcgagctgggaagcaggacgccccgggcccaggagagcccagaggaggcgacgcgcagcccagagccgggtgctccgcagaccgccccagctctcggccagatcccacccctagcagctccgcggaccgggaccgaggacccccgggccacgcgcccccggctcccgacaggcccagcacgcgccccgcgggcggtctcagtttcccctctgcagaatgggcgggggacccaggcggtgcgccccggggcgcggagggcggccggaaggggtgtgatggggggcgggccccgcgccgccccgccccggggagggagtcccgggcgcagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacggtgagcgcgcgggccgggccgggccggggagcgggggccgcgcgcgccgcagtctcagtttcccctcctgcctccccacccggctctgggcgggcaggaagcgagggctccggaaacctcttcggatgctcctggggcacccggcggggctgcgcggccaccttcgccggcgccggggctgggggctgggggctgggagcgggttccagctggggagaccggacgcctggcaccctctgcgcggtcctcccggacttcccacctccactccggccccgtccaccctggaagcgttattccaccccatcctggaccgtattccaccccaacgccgcgccgctcccgctggcatcctgcaggtgcagcgcagacaccggcgggcgagggacggccggagactcaggctcggcctcccagctggccccagggtctcccctgagggctccagaaaacgcccaggaaggtgccgcttatcagctagcagccttggggcccccacccccaccccaggtcttcctctttctgcaacccgaagcggatgtggctggcggagtcggtgggggctttgaactgctgaggcgggagacccaccttcctggggtggcggagtcaaggcctcagggaactgccagggaggcctttcccatctctggggagggagggaggcttcactatcatttcatcctcacctccttcaaaggagtgtgggattcttgctcttgccaaaaggcacattgagtgccaccgggtactgtccagatgtggcctggcaccttggaggtcccatgagggtggaaaatacagaggtgccctccccacatcccttccaggcaggacctgccacccccttgctcatgcccgcagcatcgggcagagtgtgagggatcccaggagaaataccctcaccatctacagagggcagcctgggtctgcatcctttggggacttggagccttgcccttttggggttcccagccagccagaggggaaggtattctagccctgggatcctactactcagggctagcttgaaaattaggaagaagtgtcagaaaaggacttttgggttttgtattggtttatgaaaaccacctcttatataaatattatctttctggagcagaaatcctttttcaaaaaaattagttgctatatttagttgagctgtgggaggaactggggagataaatattatttaatatcccccattagtgacttggcagggaggttgtgctttgctgcaggagagctgggcagcatgggctgcctctgaccctggggtgggctgggggcgagggccggcgcaggcaggtctgcggtcccactgcctcttttgtgctgctatagcctccagcttgggaatcctgattcctgagggaaactggagacgcagcccttggcctgtccctggaatcacacaaatactgcttctgtacgaccctagccaaggtctgtcttcattctgatatcatgtcttcattggtccagcggaggaggaactgactgggagggagggagccccagccttccccacctgttatttggttagatgagatccttggggtgccctggccagcgcacacctgtgtgaactgatggggaaggctgtgggcttggcgtggtgtgtaggtccacagagggtggatgtgtgttggggtgtgatgggaaaagttggggagggatattgctgggctcccctggatcctctgggcattgatagtattaataataaaagctgatgttcactgagcacttactatgtgccaggttctagtctcagcatttttcatctattatctcatttcttccccaaaacaactccataagggaaggactgttgtcatccccattttatacagcaggaaacggaggcacccagaggttaaaccacttgcccgaggtcacatagtaggtggtggagctggcactggttacctgctcctctctgggcctcagtttccccatctgtacaagacagtcacaagttctgcaggatgcagaaccctggtgtgggcgtctgtgctaggagtttgggtcagccggcagcagctttttcagctttgcctccagccttcttgggtccctagagggctcttctctcagatcactgattggggctgggggcattccagggctctagaagtctttaggtgagcagaggggagccagctgttccttcctgcctcaggcttgccatggcttgaggaggaggtgcagatgtccctagcacagctgctggggtggagctgatgaggctttgaaccctagccctgccccttcatagctgtgcaatgctggaccagcctctttgcctctctgtgcctcggtttcttcaccataagcgaggctgccatagaacccatctcccagggttgtttgtgagtctttagtgaggtcacagacaccaagtcatccttccttgtcgcagaagaggctggggcgggctcctggccacaagctgggtggcagggtgggtcaggcctgagggcagaagggacaccccagagacatgtgttctccccaccccaggagtctgtgcacctgcaaggtcgttattgttggaaaccacaaggaagtcatttgcttaagtcctgaagcttgcaaattctgccaggggagggaggcagcggctgggcatcccacccccaccttcccaccctcctccctcactgcacacagacacttcagagctggggagcctcggcagcgcagtcagtgagcacgctagccagggaccccctccactcacacataaaaccccatctgccgtaacccccaacagggagtgagtggggaggctcctggccccagcacctcctgtgagcccacctttgcaggtgccagaggtacccagagttcagcttccttggggggcttttacttgtacatcttttttatttttgaataaaaatgtgcacagtgcaacattcaaggggttcaaaaggtatacagtaaattctccgccccgtccccagccacccattcccagtcctcccaatatcttgtgtcttcttcccaagacagtccgtgcatatacacatctggagctgtgatcttgtgatcttttcccacacggaagcaggaggaggataagtgctctttgtccctgctttgaccttgacagtcattcttggagccggtgccaggaggagcacggtggggcttcctagtggctgcatggcatttcggcgtgcggcttttctctgacttctggtggacgcttgtgttgttggcagcctctgctatgacacgcagtattgcagagtatccttgttgccacatcatgtcacgcgcttgtgaatatcactgaaggacgcattcctgggggtggaactgtggggtctaagtgggtgtatattttcagtgtcgtcagctgtcactaaacttctctgtgcagttgtgccgactgaacggctggttctctgctgcctcgccagcacagggtgggatcagacggtctgatctgtgccagtcaggtggaagagtcctctcgtaggtttgcttggcatctttctgtttaaagtcacattgggtgtcttttcatatgttaaggagccaccaaatgggctgcccatctcctctgctggactggagccaaggcaagagacctggctgtgttgggcatgtcctttctgtagctaaagtccctggagaccccagtgacctgagagtcgggcagatcccaggaggtcttctggggtggtctctgttcaagggagctggcaggccgggcagaagcctgccttcccgggccacacgcggcccatgtgcagtgagcgccttggccccagggctgccaggtgggatgagtggtccagatttagactcctgccagcggcgtcttggctctggccttatttgctgccctcaaataagttccaggccatagctggtgctgaaactcgggcaacccatatgcgtagcccacggaaaccaggccaagaggaacggagtgtgtcaggaagagggggccatctgagtggccctgcttgctgggtggcattgggcagacttggccctccctggacctgctgctcctcaggatagcagggatgggaccctgggatcccctaagggccttgcgggatctgagagggtgtggtttgcccacagccctttggaagctcaacgtctttcatgcttcaccctagttttcactcccactggcccctgctgggcagctgaagccccccaggagcagcatcaggcctgcccagctgggccccctcaccctcttacaccctaaggcagggcctgtattttcccatagcacagtcggacgaagagatgttgagcaaacccttcatctccagctccggataagccaggggtgctgcaggccccgctgcagagcggagagctacttccaaggccccgcagtggctcccgcagagcaaggtcaggtgtccactctaggtggaccccggagacacaggcagggccaggtgggctgggcgggtcttgcccagccagggcctcttcctgactctgcaagtgacgatttaattgctctgtaaatttacctttgaggaagacctgggtgagtgcttgcctctcccggctggaactgacatttagaagctgaaataccagtttccaatgaaggaaggagtagaggggggatgaggggagcaggtggtgtggagcctgggggcagcccaggggcatcgcttaccccccttctccctggctctggactgtgggctcagggccctggcctgcaccacggagcaactgagtaaacaatgactgtaaggactcagcataaacacagggatgactcagccccgccccaccctggaagtgttccagtgtggtggggggaccctaatactgacaactggtcagagaagggcacagcgatgaggtaggggaggggctttcagagaaggcttcctggaaagggggtttatatgaggagataggatgctgctgtgcacagaaggaatggcacaagcaaaatgttggaggaggaaggccgggcgcggtggctagcaccttggcatctcagcaccttgggaggccgaggtgggtggatcacttgagatcaggagttcgaaaccagcctggccaacatggtgaaacctcatctttactaaaaaataaaaataaaaaattagccaggcatggtggcaggcgcctgtaatcccagctatttgggaggctgaggcaggagaatcgcttgaacccaggaggcagaggttgcagtgaaccaagattgcaccaccgcactccagcctgggcaacagaatgagactccatctgaaaaaaaacaatatatatatatgtgtgtgtgtgtgtgtgtatatatatatatatatatatttatatatgtgtgtgtgtatatatatgtgtgtatatatatatgtgtgtatatatatgtgtatatatatgtgtgtgtatatatatgtgtgtgtatatatatgtgtgtctatatatatgtgtatatatatgtgtatatatatatatatatgaatgaggaggagaaggttttgcaaaacgggattatcaacacatcacgctggaccccataattgtgtacaattatgatttgtcaattacaaatacactaaaaagcaggggtggcaatcctgaggcttggctaacagagggacagatgtgcattcgggatacagacatgatcctagaagggcaggtggggacagatccaggaaggccctgaagcccgtgctaaagttggtctttattctgtaggccaaggacagccactgaagctctgtgaacaggacagaggcagggtcagtcatccatcacatatgtttactgagcacctgctatgctccaggagctgctctgggtgctggagacgctgcgcttaacgaagtcctgctgccctagagcttatattctagcaagtgattctggctggagcgtgttcactgtgtgctacgcattccaagtgctttatgcatgccgttcaatcttccggcatccctgtgaggtacttacatttatcaccctctttttgcagatggagaaacagacacaggggattaggtaactggcctgtggccacagaagtaccgtgagatagagcaggatttgaacttgagccctctggaccagattccttgctctaagccacgaagcttctctgatcacctccctcttttcccaggactgcaggctgactcccaggcctgcacgctgggcctccgtgaacacaggccctctcagtctggcaacatgagccaggcaggggtcaccgtggcggaggctcagattagaatagtggccagccccactgtggctctcagagagagcggcacctcctggtcctgtctctgccccctgcagcccagcggatggcactgagagtgggcagagccagggcactctctcatttaacagataggacatctggcactgccagaggcccaaggccgccatttcaaggggaactatctcagcctccaacacgcagcctgggagagagcaaggaaggaggcagcatcttccaggaatgcctggggtaggggatctcccagccctgggctccctccatcaccctggggctcattcatgcgaggggagaattgggtccttcagggttgcatttagaagcagatcaggcctgagcaggcagagcctcgtaaacccctaaagcaccatcagtgaggccagcagggccttttggacaggaggatttgggctgtgggctctctacagaggggcacgccgactgaagggatggggacatccagcccaacggtcaggacatgggacaccaagggttttcagatgagcttgggtgagcggtaaagagagtggaggagggaaggcaggacagcctaagagttagcatcggaggcccacagcagggggtcgagaaccagactgcctgagctcaaaacccttccctgtctcccccgctgtgtgacggtgaactagtcactcaacctctctgttgtgtactctgtaaaatgggcataacaatggcatcctccttcccagcttgtttgcggatcatgagaataaggcacgcaaggagttagcagggtgtctggcgcacaccaccagctgctgctgctatgacctccgctaagcacctcacgtgctcggtccccagcgtcttcccatttgttctctggtgataatgcggtaaggcacctggtacattgcttggcaggtgcttggtaaatgtgactcttaacagtaatgatgatgatgatcaccacagcaggccttcaaagtgggtgtgggtaccccacctcccaaatgaggctcaaggccccacaaggagctggctgtgtgggcaggaccagagctgtgctcagcggcaggtcaggcctccccaggtgggcggggtgagaggggagctttgcggaggaagccaggtcacagcggagggggtatcagtcaggttcagcttggatactgcagcaatcgcctccaaatctctcttggcaccttaaaggaccagaggctcatttctcactcctgctgagtgctggcagcaggctggtccccgggtgctctgtgccttcctcattctgtgacccaggtcgatggagcagacaccatctcacaggctgctggctgctgtaggagagagtgtcaaagagctccagccgcttggctatttacatttaaatgcatgaaaattaaagtaaaattcgaaattagtcacagtccaggggctcgccagctgcatgtggctagtggctgcggtcctggccagcacagacggaggatacttctgctctcacagaacattctactggacagtgacctcctagaaagtcccccaccaaaagtcaatgctccaacctggcacgaatacacatccttcttctcaaaactcacacgggggccgggaagtgccctcctactatgtgcccacaaggtgggggagaaccagaaatatttggggaacaacataatgagcaccaaagactggatcctgggtcagggtgggtcagagagcagaaggggagatgatccaggtagacaggtagagaaaggtgaactgagccgggcgcggtggctcacacttctaatcccagcactttgggaggccgaagtgggtggatcacctgaggtcaggagttcgagaccagcctggccaacatggtgaaaccccgcctctactgaaaatacaaaaattagctgggcgtggtggcaggcaccggtaattccagctacccgggaggctgaggcaggagaatcgcttgaacctgggaggcggaggttgcagtaagccaagatcccgccactgcgctccagcctgggcgagagagcaagactccatctcaaaaaaaaaaaataaaataaaataaaataagagaaaggagaacttgagagaccagccggggcaggcaggaggcatcatggggacctttgtggggaagtccaggactggagctggcacgtgtaccccatgacacgcttcccaaccccaggcctcgcccctgcccagaataaagaaaggtgagggttacaggcatcccccgggaagagcccagcacaagcccacccatgcgcaccatgaggttagtgctgtcctgattcgaggctggggcatggctggggtgacctcgaaagcacactgctccattggagaattggcccagaaaccagtcctggccctccccccgcctttcctgttcgcctcagctaaatagatcagaaggaaaaagtctgtttgattttaatctcgacgcaggacactggagattacattttccacggaaaatgtcagccactgccgaaaataggactttggagaaaatgctagaaagtgtatttttaggctatatatttccctcctggattcctacagtccagtgggctgcttgatactccccagggttcagctgccaggtgcagaccccaaagcttccaaacaggtggtccggggagagggctcccgtaggaaaaaaaaatgcctgtaggccaaaaacaggtggaccaatgcaaggacctgtttccagtgtcaggaagaaggaggtggaagagagccagccatggccggggcctcagattccgcatggctaacgagcttcggggagatgccacagatgtccggagactgtcctttgagtggcaagagacaagaggaggcagggctcagttagactgcggcctgggaagggggagcttctccaagcccaccctgcagagcctggctcccgcccctctcatccccacacagacccactcactcactgtgtggccttgcccaagccacaccgccaccctgatcctccgtgcccgggtctgtgaagcagggcaggaactccccgccacctgcctgccctttaggctgtaggaatgattcaaccacttcaggggcccgaggcacctctgcctgatacaaaaggtgcttcgggaaatgttggagataaaaatcagcacctaggcctgggcggtggctcacgcctgtaatcccagcactttgggaggccgaggcgggcagatcacaaggtcaggagttcgagaccaccctggccaacatagtgaaaccccatttctactaaaaatacaaaaatcagccgggcgtggtgccgcgtgcctgtaatcccagctactcaggaggctaaggcaggagaatcgcttgaacccgggaggtggaggttgcagtgagccaagattgcgccactgcactctggcctgggcgacagagcgagactctcttaaaaaaaaaaaaaaaaaaatcagcacctcaattgaggtgggtgctgttagagtttggaaacagtgttcttcaccatgttgtgtggggggcgactgggtatgtggggcggggctggggggtcttcactgagctcgatggagtgcagggcctgggggggactgcaccatgggagggatcctcactgcggggtgctggctgctggggtcctgtccaggggagccctgctgtgcggtggggcccagcaggccggcccagctgcagaccttgtccagctggtcccaggggagcagggatgttagaggcagggtgagcggaaggcgcctgagctggtgttctccatttgagggaggggctgccttgctgtgggggtggcagagactcaacaggactctgcggccatctaaggaagggctatgcagggagccgtgagaacagcccactctccgtgtgacctgggtgggggaagtgtctgttttctaggcctcagtttcccttctgtgaagtggggcagggaggggctggactggaggggctggaaggaccctcttggctccgtactcatcccacgatgagccaagtcaccctagatcttcctcaatctgagtcgggggagggtagaggggtggaagcatttgggctcaaaccatttatcctgtggcctcagagagccctggggatacatccagtccgtggtgggggtctgggcgggcacggtggggaggcactgccagactcccccgaggcccctgcgtgacccactcctctcttgtctcctcatggctcccgtggctgcctggatcctgcagagctcccgagtgaggaaggtgaggctggcaccgggatggacctctaggccgcgggcagcatccctgggtcgttctctgtctggtcatgacttccttctccccgctgagtgaggccttgctgagctccccaggatcacccacctgagcctctcagcgacctgggttctccctcttctgagtgcagggagggaatgggccgggaggtctcccgggccatcccagctctgagtgggcagggtcagtggtgggggcccagcctcacacatgacccccgttcccagggaagtccctgtgggagctggtgctggaacagtttgaggacctcctggtgcgcatcctgctgctggctgcccttgtctcctttgtaagtagggccctgccagccatcctgtggtagtcggtagccctggagggagagccaggctgggcagtgctccgaggtcctggagcctgggcctgtcctccacaccctgggcctgcgccctggccttccctggccctgccctgctcagacttcagcttcccttgcctgaaccctcatggcccctacattgggtccccggctcccacctgacccctccaatccatcttatcctctggctctcagcgagctccccaactcacatctgccccccgccccgccctgctgtaccctagggtttctctgcctcagcactactgatagtttagaccagatcattctttgtcggggtgggggtgggggctttccactgtaggatgttcagcagcatacctggactctacccacaagatgccagtagcacctcccggggatgaccatcaaaaatgtctttagacagctgggcctgacagctcatgattgaaatcccagcactgtgggaggccaaggcaataaaatcgcttgagcccaggagtttgagaccagcatgggcaacatagggagaccctgtctctacaaaaaatacaaaaacattagccgagtgcggtggtgcaggcctatagtcccagccactctggaggctgaggcaggagaattgcttgggcccaggaggatggagctgcagtgagccgtgatcacaccactgcattccagcctgggcaacaaagcaagaccctgtctcaaaaaaattaaaaatgtcttcggacattgccaaatgcccctggggggcaccttgtccctggctgagtgctgctgccggagccccttccgtggatcccagtgtcccccacatggattttggggtctgaacctcttgcagcctcctcttggctgccgcatctccttgctgttcctccattcccactgatgctcccctggctaatgggctttggatgcgtgcatcagaatcacctgggcttggctgggcgcagtggcgcatgcctgtaatcctagcactttggcaggccgaggcgggtgagctcaggagttcagcctgggcaacgtggtaaaaccccgtctctactaaaatacgaaaaattagccaggcgtggtggtgcacgcctgtaatcccatctacccgggaggctgaggcatgagaattgcttgaacctgggaggcaaaggttgcagtgagccaagatccagccaccgcactccagcctgggcgacagagcaagactctgtctcaaaagaatccgtaggcttgccgacacacaggtgactgggccccaccccagaatttacgactcaggaggtctgggagggaccccaagatcaacatttcttacaagttcccagctgctgctgctgctggtctggggaccacactgagatgctctgctccaggcagacagtaaggcctcggtgggcagccatccaactgccccacagccttgaaggttggcctgggtggggtggtcactcctgtggggtgggcaccctgtgccaaggccttctcggaggagtggccctctccaagccaagagctccccagtgctatctccccaaagcagggaagcaagcaggagatccggggtgccaaggaaaaggagagcagatctcggcccgcagcagggcctgagctcaccagctgtgatcctgcaggtcctggcctggttcgaggagggcgaggagaccacgaccgccttcgtggagcccctggtcatcatgctgatcctcgtggccaacgccattgtgggcgtgtggcaggtgggaggcactgggggtgggaccgggcggggggcggtctcccagccactaggagtgccctccacctggtgctggcgtcctgcagactctcctgcttccacctccatcccaggccccagaggagtcactccaagggggtggtctgcggggggcagcagggacagactgcctgccggccttctattctgcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcaggtatgccggggcctcctccttttattttattttattttatttatttatttattttatttatttatttatttattttttgagatggagtcgtgctctgttgcccagactggagtgcagtggcgcaatctcggctcactgcaacctcctgcctcccgggttcaagcaatcctcctgtctcaggcttctgtaggggcctcctccttttattatgtgggcctgggagccccatccctctctgtgcctccgtcattccggccgtatatacagagggggtggctgtcggatccctccaaagccctttggccaaaaccctgttggacagatgagactgtgggccagaggggcaggggtcaccagagcgatcacagctcaggcacccgacgcccagccccagccttgggttctgggaacccttctggcttttcccagctggtggtgcccaaagccaccctcagccaagccattctccccgcacagtgggggacaaagtgcctgctgacctccgcctcatcgagatcaagtccaccacgctgcgagtggaccagtccatcctgacgggtgaggccccccccaggaggccgggacctagtgggccaggactaagggatgggcgtgtcttcatgtggggcttctcatctctgattccctgaccaggtgaatctgtgtccgtgaccaagcacacagaggccatcccagaccccagagctgtgaaccaggacaagaagaacatgctgttttctgtaagtcaaatgtctggggcctttgcccagacaatgataaaaataacaacattaggattatgatcacgcctgtaatcccagcactttgggaggctgaggtgggtggatcacctgaggtcaggagttcgagaccagcctggccaacatggtgaaaccccgtctctactaaaaatacaaaaagattagctgggggtggtggcgtgtgcctgtaatcccagcaacttgggaggctgaggcaggagagtcacttgagcccgggaggcggaggttgcagtgagccaagattgtgccactgcactccagcctgggtgacgagagcaaaactctgtctcaaaaaaaaaaaaaaaatatttttttttctggccctgttgcccatgctggagtgcagtggtacgatctcgggtcactgcaacccccgccccccaggttcaagctactcttgtgcctcagcttcccaagtagctgggactacaggcacctgccaccacacccggctaatttttgtatttttagtagcaacaaggtttcaccacgttcaccaggctggtctcgaactcctgacctcaagtgatccgcccaccttggcctcccaaagtgctaggattataagcatgagccactgcacctggcccaacattaaggttaatcagctaaagtcctacggggaagaacctcatcgattcttgacaatacatgcaaatttatagtaataataatagcttgtgtttactggggactgtgtgcctggcactgttctaagctctttacacatactagtttatttaatccttaacaccaaatctttgaaataagtactcttgttatgcttgttatctatattttccagcaaggaaagaaacaagcacagagagattaagtaagtttcccaaggtcacacagccaatgagtggcacagctgggacgaactcagacatcctggatttctgctgggagaccctgccttcccctggagaagggcagagcctccctataatcactcgatagaaatgctctagaggaaggaggtctgccaaaatggtggaggatggtgggggatactccattctccgacaggaaaactgacccacaaggcatgatgcccggtctacctggctcttctcagggatagtgatgggttcagctttggcgggagagacctgcctctgtggcctcagagaaagctagcaagtgatactcacagctgccccgcagtagcctgaggccagcaaggagcgtttaggggcacaaggaagggtcaggccagtcagacaatggcccaggccaccaagttatcgggggatagaaaacttcctggaagggaagagggatgaagaaagtgaaactcacccagaactccttttttttttttttttttttttttttgagacagagtctcactctgtcacccatgctggagtgcagtggcacaatctcagctcactgcaacttccgcctcccgagttcaagcgattctcctgcctcagcctcccaagcaggtgggattacaagcacacaccaccgtgcccagctaatttttgtattttactagagacggggtttcaccatgttggccaggctggtcccaaactcctgacctcaggtgatctgcccgccttggcctcccaaagttctgagattacaggtgtgagccactgcacctggcccagaactcttcttgagaggggcctacctagctgcatagaagccttggacaggatgccttggggtggggagggaagctctgagagctgttgctccaggatcagcagctgtcactaagaagctttggaggggccgggcatggtagctcatgcctataatcccagcactttgggaggccaaagcaggaggatcatttgagctcaggagtttgagaccagcctgagcaacatagtgagacctcgtttctactaaaattcaaaattaaacaaaacaattttctaaagtaataataaaaagaagctttggaggaaggtgtctggctgggccctgcatgttgggggctggagctacgttgcttaagacagaagagaggctggggcctgccttctcgccagccccaacagcatatgcatttgaaggggcaccaggttcttagcctcctcagaaaaactatcttgggcctgtgttggaccactttacagaagaggacaccaagccacaaggctggctgtcccttatgctaggaattggggattttactggagccttggaaatggatgagctgaggctcaggttttctggattttttagtaaatattaatggactgtttattgggttcgtagtcagctatgctcctgtgtggctatagtgattgtttacgaaatcacattttgtggggttgatgcttgtgctgcgctggttgattatatcatcaatatcagcccccgtgcctcctctgtgcccggccccgtgctaggcactggggatacggcgatgaacccaaaccctgccttcctagagctgacactctcatgggaaggcagcagggaccccgtgcatacatagctacaggagtctggaagcactagcaacatggagaaaaggaaagccgggtagaaggataagtgccttattccggcctgaaggagtcaggggtcctgggcccctggttggctgctgagcagctttttccttgtccctcccctggccagggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccgggtgagtgacggccagcttggtgttgctgtgcgttgcagagcaggctgggctccctctctgggtctctcccccacctccttttcagtgagggatggaggagagaatctgtgggctgtcccttggcccagagcaggtccaggttttcacaagatgacagggagactatagcaaatcatgcctgggtagccacatgtcactgaggcctgtgtgtcactgtggggccctggccaggttgctgacagtctgttaacctcagtctcctcattggaagcctggctgtgtgagccctgctaggtaaacgtaaaggacataggagaggctcaagttcagccttggcataggggccaagctgggcctggatccgggttccatcctgccccatcatgactctgtgcagtcgacacctgtcaccagataagccagctccggtaacctgggaagggccagggcaggaattattcattccctgcacttcatcccacatcctgggctcactgcccacacggccaagggattctggctgagacttcagcaggcccatggggcagaaggctcctcctgacccagcagatgggtgggtggggagatggtgaaggctatgtgttccccacccttcccaggtccccagtgcctctctgtcacccctgcttccacatctgcccactgggcttggaaacccaggctctgtattctgagaccctaaggccttctgggagcccatcaaaggctgctttaggggaggggtgctaccgagctttactgtcctgctaaaagccctcataggattttatttaaacagagtgtttcttgactaatagcgatttttttttttgaggcagagtctcattctgtttgttgtctaggctgaagtgcagtggcatgatctgagctcactgcaacctctgcctcccaggttcaagcgattctcctgcctcagcctcccaggtagctgggactacagacaggcatgcaccaccacacccagctaatttttgtattttagtagagacggggtttcaccatgttggccaggctggtctataactcctgacctcaagtgatccacccgccttggcctcccaaagtgcagggatttcagccctgagccaccgtgcccggccctaataaatttttttttttttttttttgagatggagtctcactctgttgccagactggagtgcagtggcacgatcttggctgcaacctccgccttctgggttcaggcgattctcttgcttcagccacccgagtagctaggactacaggcgcgtgccaccacacccagctagtttttgtagttttagtagagatggggtttcaccatgttagccaggatggtctcaatcaagcttgacctcgtgatccacccgcctcggcctcccaaagtgctgggattacaggcgtgagccactgggcccagctaataataaagagttttaaagtgcagtgtggggaagttgtaggggccttacgtgctggatgctgggctgtgcttgctgggtgactgcccccaggagtagggaggagagcgggaaggaagggacacttatgcatctactgggcgctgggctggccatttgcttgagaatgtgcggtgaggccatgtccacgaagcaagaactgtctccccagcagagctggctgaacagacaaagaaataggcatgctgggccaggtaagcctcctgttcctgaggtgcacaggtgggggctgagtgacccagcaggccctgtggcaggggctcactctctggggacatctctgggctagaggggtctgtgccccagagaggcgtgtgggtttcctcccttgaaggccaggaactcatttccttgaaggcaaaggagggggcggttcccatgttactagtggagaaactgaggctcagctacttggccagggatcgcacagtgagatgggcaaggacccaggctttctgcctagctcagggctccctcaagctggcaactgcccccagagcactgaagaatctgccataaatccctcagaagtccaggacattgggacaaaccggagccggacacatctggcagagcagacggtccctgcctcagcctggaccctgcgttctatttccctcctggtgggcacggacggccaggccggtttggccctcggtcgggcagggggcctgcaggaccccaccctggggtcgactggccgcccggggaggagggaggcgaccccgcccgcctaagcacgcccctgcgctccccagatgttcgtggtagccgaggccgatgcgggctcctgccttttgcacgagttcaccatctcgggtaccacgtatacccccgagggcgaagtgtgagtgcggggccaggggacgcgcgggcgggcggcctgggggcggggccacgcgtggcggcgccgaggtggccgtgggaggcccctgggggcgggccaggaggcggagcctctcccggggcggggccaggaggcggagcccttctgggggcggggccaagaggcggagccccctcctaggggcggggccaagaggcggacccctctcgggggcggagccgaggtcctcctggtgaccgccccggctccgcaggcggcagggggatcagcctgtgcgctgcggccagttcgacgggctggtggagctggcgaccatctgcgccctgtgcaacgactcggctctggactacaacgaggtgggcctcaccccctttcatgacctccctagtatccaggcgaccaggacagacccttttcccagcctcaaagctcccagggttggcagcccttgctccctggaagtgccacacccagggagcacggttacccctgcacacccctctctgccgcccctccctttccgcagacaggcttcagaaccctccccctggggctcttggtctgtgggggactgccatggaaggggctgaagggctggggaaacctgtggggggaagagatttggggaacaggaccaagaaaatgttgaaagcagaagacacagcccacaaaaggcccacgttcagttaaagcctcctgcgacttaggcattcacgtggccggggcagtggaatggggcatgcagcaggcgtctgcccaaagggaggtccttggccagacccagtccgaggccaagctgagggcagtagagcaccaacgaagagttttgagcaggagagtgacatagtcagatgtgcatttacagaagatcactgaggcttccgtgtggaggccagacagacagtagaggaccgaagccagggaggcctatgtggtcattcaggccagagagatgcgggctgagccctggctggagccttggggagaggggagaaggtatgggtcagagacatttaggagccaaaaatcctgggacttggtgactggttaggtgaaagagacagggaggaagccaggggggctcctggttcttgtgctgtctggggctgtcgccggagtggcaaatacagagagtgggagaggtggcctgaggggtccccggggaacaaggttcagcaggcagctggacatctgggcttggggctcagcaaagggccccagggagagcaggtgggagggtggaagcgggcccagacagcagaaaccggtgaaggaggctgacaggaagtggacagagatgcaggcggagggcagggacggtgtgtggcgatcaatgccagtgtggggggctgaatgtcagtgtcagacaccaccccgaccccagggcggccaggctgggaagggctcacgggccggtgcaaaggaggttacacggaactccagcaaaggcagctgcaggggcaaggagtgagtgaggctggggatgcgggctggaggctgcctgcccctcactccctatcccctgggtccttgccaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtgagcagggctgggggctcaggcctccggctgcatggctggggcttctgggacatctggagaaggcagacaggacactgaagtttttgttttgtttcgttttgtttttttttttttttgagacggagtctcattctgtcgcccaggctttagtacaatggtgcaatcctggctcactgcaacctctgcctcccgggttcaagtgattctcgtgcctcgacctcccggcgcgtgccaccacacccggctaatttttgcattttttagtagagacagggtttcaccatgttgtccgggctagtctgaaactcctgacctcaggtaatctgcctgccttggcctcccagagtgctgggattacaggcgtgagccaccgctcctggctgacggtgaagtaagacttggagaaaagaggggagaaggctgcgtgtgggcaaaggtttggagttgggctgcacacagcatggtcagcaaacggcatcgtattgccatttctggggctggagagggaaatggaggccttgaatggtggggtcagaggagtgtagatgtcatcccacacagagcaagaggctctcttggggccaagcagttggtgggaaggcaggcgagagttgctggctctgtccttcatgccctgacctgcctggaccccgcaggtcatcaagcagctgatgcggaaggagttcaccctggagttctcccgagaccggaaatccatgtccgtgtactgcacgcccacccgccctcaccctactggccagggcagcaagatgtttgtgaaggtgggggcctgcctggctggcctgggcccctgcgcgccctggggaacctggtcatccacgctcctctgtgagccccagtcctcccgtgtgaatggcagggttgggttacaagttctcaggagccccttttgcctctaaccggtggtgtaggggtggttggtgccacccttggtgctctgtgttttggaaactgagtcccagggagggaaaggaatcgactcccttgcagaccactgtctacagcgtctccgttgctgctcccaaaaccgaagagagaaatacagctctagcttcaccctgcaagggaagtttaaaccccttttgaaatgaaaaggcttctgtactgggagctcgggccacttggaaaagtcagtgcctgggtgaccttttaggagcaggagaagccactgaaggagctttagaggctgttcctaggcccggggtgaggtctgaggtgagacctgaggccactgaggggcctgtcatccctggacccccttcccagggctatgcccgccataccctgtgtatggctctatttctggtccccaggcagggctcagcctgcctccctgctgctgaggcccctaccaaattggaacccgagtagcaccagggaagcagggcctgcaggggatgccattctcacccctgcctgcaaaacgctgcagtgcccgagtctgctgtgggctggtgggggaagggcatcgctaggttggtggctgcccccaccccagcacactccccccattctctttagattgtctcacagggggacccacttggttctcattctgaactttcagtgaatggattctgctccctgccttgcgtgtgtacccttgggtggcctttgcccgtatcttagtctcagtttcctgagtttgggcaggaaggagaggaggggttctgactgatgagttacctcttctccctctccccacctcgcagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgaggtgggtgcaggagccgattctccctgcagtacgaggtgggtgcaggagccaagtctccctgcagcagctgagcaggtggtaggtcagggatgggctcaggccccgcttgaatctgccccctccctacagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatggtgaggccacagcctggagccccaggagggggtgatgagtggggccacggggtgtgaaaagagcaagccgtgcaactctcccctctgcctcattcttaccttttctaacatcttattaccaaaaaattcaaatacaaaaagaaatttaaataatgttattctgggccaggcgcggtggctcacacctgtcatctcagcactttgggaggctgaggcgggcggatcagttgaggtcaggagttcgagacaagcctagccaatatgaggaaaccccgtctctactaaaagtacaaaaattagcggggcgtggtggtgcattcctgtaaccccagctactcaggaggctgaggcaggagaatcacttgaatccgggaggcagaggttgcagtgagccgagatcacgccactgcactccagcctgggtgacagagtgagacttcgtctcaaaataataataataacaatactaattttattctgaacacctacatgtctatcatctggattctacaactaacattttattgtatttgctttatcacatacctgtccatgcagccattctttgcccatccctagcccatcttttcttaggtgtatttcaaagtcagttgcagacatcggcatacttccccctcacctactttagaatacatgttaaccagagagcaatgttgtttgtggttctgtttttcctttttgaggcaaaatttgccttcgatgaagcacacagatctttggcgtactatctgatgagtttaggaacatgcacacacctgtgtaactcacagccttatcaagataggaaaatgccaggcatggtggctcacgcttgtaattccagcactttgggaggccaaggcaggaggattgcttgagcccaggagtttgagaccccatctctccaaaaaaaaaaaaaacaaaaaacaaaaaaaaaaagatatgacacattaccatcaacccatgaagttccgtcacacgccttccccatctctgtccttcgtcgcaaaacaggcgatcactgttttcggttttttttttcaccgtatatgagttttatctgccctagattttcaaatgaatggaatcatacagtatggactgttttggtttggggcttttttgagatctatctgccttgtcgtatcagattattgcttttttttttttttttttttttttttagacagagtctcgctctgtcacccagggctggagcgcagtggcacgatctcggctcactgcaacctccgcctcccaggttcaagcgattctcctgcctcagcctcctgagtagctgggaccacaggcgcgcaccaccatgcccagctaatttttttatttttagtagagacggggtttcaccacattggccaggatggtctcaatctcttgaccttgtgatccgcccgcctcagcctcccaaagtgctgggattacaagtatgagccaccgcgcccggcctattgcttttttattgttgagtagcattccactgtgtgaatatttcagtttattgaaccattcctctttggatggacatttagtttgggcctagtttttgttcttaattgctgacctattcttctgacctcagcctctcccctgacctggtctctgtttttaatcttgacctccagcctaacccagtccttaaccctgacccatggcccagccttgatctgcacaccaagcttgactatcactgcagcctggttcttgatcttatctttgacctctgtgctgactttgtccctgaccttgatgttgaccctcatcttaatctaattctttttttgtttgtgtgatgaggtctcactctgttgcccaggctggaatgcagtggcacagtcatggctcactgaagcctcatcctctcgggctcaagagatcctcccacctcagcctcctgaggagctgggactacaggcatgcaccaccatgcctggctaattttttaattttttgtagagatgaggtctccctatgttgcccaggctagtcttgaactcctggatcaagcaatcctcctgccttggcctcctaaagtgctaggattacaagtgtgggccaccacacccagcccgacataactatttacgttgagcttaaccctgatatgaattccagtcttggccgggcacggtggctcacgcctgtaatcccagcactttcggaggttgaggcgggcagatcacctgaggtcaggagtttgagaccagcctagtcaacatggtgaaaccctgtctccactaaaaatacaaaaattagctggtgcatgcctataatctcagctacttgggaggctgaggcacgagaattgcttgaacctgggaggaggaggttgcagtgagccgagattgtgccattgcactccagcctgggcgatagagtgagactctgtcccccaccaaaaaaaaagaattccagtcttgacctggaccaagaccttattctcaacgttgaccttgacactgccccacccccaatgtaatgctttatgttgacctcaactttgatctggccttcaatttttttagatggagtctcactctgttgcccaggctggagtgcagcagtgcagtctcggctcactgcaacctccgcctcccgggctcaagcgactcccctgcctcagcctcccatgtagctgagatcataggcacgcgccactgcgcccagctaatttttgtattttcagtagagatggggtttcatcatgttgcccaggctggtcttgaactcctgacctcaggtcatccacccacctcggcctcccaaagtgctgggattacaggcgtgagccaccgctcctggcctggccttcagtttgaccttgattgcaactccagacttcatgtcacttgacttcactcctcatgtggaccttgacttggcctctgcctttgccttgatcttcaacttgactacaacacctacctggctctttacccgggccatccccttgacttcattcctgacttgacctcagctttctccctaacctcagtttcatcttctaccccacatccaacctcaatttcatccctaccctcatcgctgactcaccgtcatccccatccccacctcatcatcttccctaacctcatgcttgatattctccccaactttgtccttgtctgcatcccttgccttctcctcagcctcatcctctgcccaatttctagttcattcttgaacccaccatttgttctgtctaactgtctgcttcctttggaacatcccctaagattgggggtgggctgagttgagaagagatggggaggtggaagggaagtttctcaggcacagccctacctgacctggcccacagactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctggtgaggccgggccttccctcctctcagccctctcaatccgctctgtgcccctgagatggggaaaacgcctgttcctcggatgcgctgcagggatggaggggcctgtgccctgccctggctggggctttccagggtcccaccttggagtggacaggggagagcacctcttgtcattctccagaggccctggtgacctatggatcatggtcaccccagcacccacggaggtgcctgaagagtcgcctgtcagccctccagccatgaacttcccacttgcagattagcaagatgagagaaaagccccacctttaggcagtcgtgtgtgtgtccgtgtgcgaatgtgtatttgtgtgcacatggcctgagtgcctgagtgagaggtgtgtgtaatgtgtatattttgcatgtgtgctctggtgcattttgagcgtgagtacaagcagaaggatttgtgccggcgtgtgactgtgcacacactcgtattcacatgtgaggatgcctgtggggaatggtgagcgtgtgtgttgctggacatggatggattctgcatctctgcacctcagggcagatatgtaggtgtttgcttgtgtttgccggatggtgtggcatgtgctaggtttttgcacatgtctgattcttgggcatgccctcttcgtgtgcgtgtgtgtgtgtgtgtgtgtgtgtgtgtgtgtgtacttggcctctgctaggcctaaagagcaggtatgtccaggatccagagctgggactggggaaggcaggactggccaggcccgaggcagagctgtgtacacacacccttcacatcacagctggcggagggaggaggggctgctgtggagacagtgggtgggtgagctcccagccttgggtctgagcaggagctggagcctgcatctgccgggggctaggcctaccggggctagagctcatgactctgttccagcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggaggtgagtggggcctgagccctccgtggaattcctaagcttcctaagagccttgtatcaggcttgcaagctgcagacagtgtgactcagcctggcttgtgccagtagaaactgtatgagctcatgtaatggaaaagaccaggcatggcgggatctgggtctcagtatcactggcatattttggcactgcctcagcttcattctcaggcccacgtccctcatggtggcagaatggctgctgcagccccagccctctgctcactccattacaaccccaaattcagcagaagagagagtcttttatcatgctgctctcccggtagtatgataagaatctcaggcctgggctgggcatggtggctcacacttgtaaccccagcattgtgggaggccgaggtgggcagatcacttgaggtctggagtttgaccagcctggccaacatgtggctcacacctgtaaccccagcactttgggaggccgaggcaggcagatcacctgaggtcaggagtttgagaccagcctggccaacgtggtgaaaccccatctctactaaaaatacaaaaattagctgggcatgatggcaggtgcctgtaatcccacctactcgggagactgaggcaggagaatcgcttgaacccaggaggcagaggttgctgtgagccgagatggcaccattgcactccagcctgggcgacagagtgagactccgtctcaaaaaaaaaaaaaaaaaaaagtctcaacaggcctgttctcattggcccacatagggttcacctgctcatctccaagcactggggccaagggtatggcagatgctgattgaccagccagggcccaccactggcatcgaggggaggtgcctgcaaaccacagggctgagagaggaaaagggtggctccctgcagggaattcagggaattattaggcaggggaaacagacgccagaaaaccaccgccattctctacagccggtctcctcccttccccgcagtgtacgtaggcctggccacagtggctgccgccacctggtggtttgtgtatgacgccgagggacctcacatcaacttctaccagctggtgagcaagggctggccagggagcctgttgaacttacagctcgagttgttggagttccaggggagatgggtctagagccgcatgggtggcctgcagtgtccttccccactcgctatacacgaataaacatccccacctggggagccgagctcagagcccacgggaaacccagagacaccagcacggacccccaagccaaaggcgcctccccatcccagtcagttagcggggaccaagaggcctcactgccagatgtatcttacctttgtcaagggacccctaaaacgttgaggcctcagaggaatgagcccctaaatggtgggactttaggcagagggtcaaactgaggagatcaagaatggaggggagggctgggcacggtggttcacgcctgtaatcccagcactttgggaggccgaggtgggtggaccacctgaggtcaggagttcgagaccagccgtccaacgaggtgaaaccccgtctctattaaaaatacaaacattagctgggcgtggtggtgcacgcctgtaatcccagctactcaggaggctgaggcagttgaatcacatgaacctgggaggcagcggttgcagtgtgccaagatcataccactgcactccagcctgggtgacagagcaagactccatctcaagaaaaaaaaaaaaaaaagaatcgaggggaggctgggcatggtggctgacgcctgtaatcctagtactttgggaggccaaagtacttgagcccaggagtttgagaccagcctgggcaatacagtgagaccccatctctaccaaataaaaataaaaatgaaccaggcacggtgatgtgtgcctgtagcttcttgggaggctgaggtgggaggatcagttgagtccaggaggtcacagctgaactgagccgtgatcacaccactgcacttcagccttggtgacagagtaagaccctgtctctagaaaaaaaaagaacacatcctgccgcggtggctcacgcctgtaatcccagcactttgggaagccgaggtgggcggatcacttgaggtcaggagttcaagaccagcctgaccaacatggtgaaaccctgtctctactaaaaatacaaaaattacccaggtgtggtggcggatgcctgttttcccagctactcgggaggctgaggcaggagaatcgcttgaacccgagaggcggaagttgcagtgagctgagatcgcaccactgcactcgagcctgggagacagagcaagacgcagtctcaaaaaagaaaaaaagaaaagaaaagaaaaccaaaccaaagggggtcttgcaggacacagggaataggacataggcaggcaggcaaagggaaggagtgggcacagcagtggcctcaccagtagaaatgggctcctccagggcttccccatgtgcctgtgaggcagaagctccagcccgacgcactgtctttttttgtttgtttgtttgagatggagtctcgctctgtcacccaggctggagtgcagtggtgcaatcttggctcactgcaacctccacctcccgggttcaagtgattcccctgcctcagcctccccattagctgggactacaggcgcccaccaccatgcccggctaattttttgtattttagtagagacagggtttcaccatgttggccaggatggtctcgatctcctgacctcatgatccgcccgcctcagcctcccaaagtgctgggatcacaggcgtgagccacggcacccggaccccagcgcaccttctaatgaataattccagaggccacaccgagacctatgacctggggaatactgtgtgtgtgtggcaggtgcttgctggtgaaacccagaaggtctgcactgggcagggcatttacagcaagagcaacagacccattgaaacatatttatttatttatttgagacagagtctcgctctgtcacccaggctggagtgcagtggcgcgatctcagctcactgcaacctccgcctcccgggttcaagcgattctcctgcctcagcctcccgagtagctgggattacaggcacccgccatcatgcctggctaatttttgtatttttgtagagatggagtttcaccatgttggccaggctggtctcgaactcctgacctcaggtgatctgcccgccttggcctcccaaagtgctgggaatacaggcgtgagccaccgtgcccggccgaaacatcctgacatgatcttgttggtattttcttctctgtgtagacgcataagcgtcttaagcattcacatgcccgagtgggaggtgtgtgtccctatgtttgtgtgtacatgtatggataggccattaagatctggcagggtgaggcccgacaacagtggcacaattggcaggaggatttggtcctctcggtcactgggtgggtagagtcaggttcaaagttctggaggttttcccttctctatgatcagcaccaaatagaaacgtgtggctgctcacgcctataatcccagcactctgggatgccaaggcgggcagatcacttgagcccaggaatttgagagcagcctggacaacatggcgaaaccccgtctctacaaaaaagacaaaacttagccaacagtgacggctcaggcctggagtctcagctacttgggaggctgcggtgggacaatcacctgagcccaggaagtcgaggctacagtgagctgagatcgtgccactgcactccagcctgggtgatgggagtgagaccttgtctcaaaaacaaaacaaggccaggcacagtggctcacgcctgtaagcccagcactttgggaggccgaggcgggtggatcacttgaggtcaggagatcgagaccagcctagccaatatgatgaaaccccgtctctactacaaacacaaaaattagccacgggtggtggcgggtgcctgtagtcccagctactcaggaggctgaggcagaagaatcgctcgaacttgggagatggaggttgcagtgagccaagatcacgccactgcactccagcctcggtgacagagtgagactcagtctcgaaaacaaaaacaaaacaaaacaaaacaaaacaaaataaaaagaaaacaagacatatccacttgcctcaaatgctggagcttgagttttggagaaaacgtccactatcgatttaagagattatcagattctctatctctttgttaaaatatctagccaggcttatttctcttcctgcacgagagaggagaaacgatactcagagtggccttatctgcatttgtgcagtgtgggaaaacggatgtatttatgcgacagacagtagatcagacagccgggcattttacacgtttttctttgaggattatgttcacagcacatggccccaatttctaatttaaaagatctccatggccgggcgcggtggctcacgcctgtaatcccagcactttgggaggccaaggcgggcggatcacgaggtcaggagttctagaccatcctggctaacacggtgaaaccccgtctccactaaaaatacaaaaaattagccgggcgtggtggcgggcgcctgtagtcccagctacttgggaggctgaggcaggagaatggcgtgaacccgggaggcggagcttgcagtgagccgagatcatgccactgcactccagctcgggtgacagagcgagactctgtttcaaaaaaaaaaaaaaaagaaaaaagatctccatgttcagattagactcccaagagcaggatctatatttttggtgaactaagctggttaacggttggaaacattcaccctcatccctataatatggaagagaacaagacaagttcccccaataccctccgttcagcctcttagcacgattctgtgaacaaggtttttgagcagtaagaaaactcccctgaggctataggggttatcagccctgagcgcttcatgttaattacagagaagctacctgttacagctgcaccttggcaattcattagtctctgtcagaagcacacatcagatctgatagagttcagtttcagtggcagaaatggagtgaggtatgaggtgtaaatggaatttttttttttttttgagacagagtcttgctctgtcacccaggctggagtgcagtgacgcgatctctgctcactacaacctctgacccccgggttcaagtgattgtcctgcctcagcctcccgagtagctgggattacaggcacgcaccaccacgcaggctaatttttgtatttttagtagagacggggtttcaccatgttagccaggctggtcccaaactcctgacctcaggtgatccacccgcctccgcctccctgggatgacaggcatgagccaccacgcccagctgtaaatggaatcttaataacagtgaacagggcctgcgtagccttcatcttctataccgcaaaggtgaattccactcccgcatggttttgttggttgattttcacatgcatttccctattcagtgatctccaggctcccgctagcctccccaggctaatgccagctgttctccttctgagccgctgcactcctgctccagaacgtctgcctttcccacgctgtgcccttgcttctccctggcacggtgcagctctccccaccgccgccccgaccccgcacccctcccgggatccccagcccaccccacggcagtgttttgtgtgctggttgtgcccaggcgtgggccaagggcaggatgaggcttccctcctcccacccaccagcccctcgcctgacctgccgctctctctgacctgccacggtgcccccagaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacaggtaggctgggcgcagggcctggagctggggccgaggagtgggggctgagggctgggggttccagtatcagtgtctgagggtcaggggtccaggtgggctgggcgcagggcctggagctggggccgaggagtgggggctgagggctgggggttccagtatcagtgtctgagggtcaggggtccaggattggggtctgtgggtcaagagggtccaagattggggtctgatgtttggggggttcaggattgggatcagaggttcaagggggtccaggattggggtccagaggtcaagagcatcccagactggggtctaggggtcaagagaggtccaggattggggtctggggtcaaggggttcaggttggggtctgatgtttggggggttcaggattgggatcagagggtcaagggtccaggattgggttccaggggtcaggggagtccaggactgaggtctgggagttagaggggtccagaacaaaggtctggggccaagcggggtccaggattagggtctgggggtcagtgggggtccaagattgggatccaaagatttggggatctggattggggcctaagggtcaaaggggcccagagaggattctgagagttcatggggaccggaattggggcccaggagacaaagaaggctgaaactggggtccaaagaaatcggccaagattaggtctgaggggcagagaaaggggtcccagcccgggacaggccctggcaggccgagcgggcaacagcaatgcaccgctagagaagtggtgaggctcctcccatgggggtgggtgcctggcagggcctccctgcaccccggcctaaggggagcaccctgtgccctggcagcgtctcggagaaccagtcgctgctgcggatgccgccctggatgaacccctggctgctggtggctgtggccatgtccatggccctgcacttcctcatcctgctcgtgccgcccctgcctgtgagtcaccccgcctgccccactgccctggtccctggacatcacaggccctgggctggtcactggacctctctggcccccctgcaatggaaactacctggaggagagggaggtgagaggtctggccagccaccacctccagctgtggccccaccttcaggagctcccagacctgggggacggaagagggggaaaccccttgctgaggggactgtgcccaggctggggtgggaggaaggacgagctttcccagggcagaatcctcccgcctcccaacaggatggatgggagttgacccagtgggcaagggcagaggtgggcccttgaggcagaggaagctgagcggacaaagattggggggtgcagctgaacagacaaagatcggggggtgcagctgagtggacaaagatcgggggtgcatccagggggttcttaggagcgctcatgaagagtccatcagagcccaggtggataaggccagcagatggctggggcacgggacagccagtccttcctttaaccaaacctcccttcccctccccgccagctcattttccaggtgaccccactgagcgggcgccagtgggtggtggtgctccagatatctctgcctgtcatcctgctggatgaggccctcaagtacctgtcccggaaccacatgcacggtgagtgggaggccccgtcccgcctccagcctgcctccccgcccgcctctgctcctgggctgcagtggacgctgtgggtgtggagcgcagagcctctctgtctgcacatcggggaggcgttctcggatcaccaagtggagggtgtgaaggggctctggtggctgggtcccaaggtgtccgcagggtcttgcactgcaggggacctgggctcactgggccagcaacgggagcacctcttgggccacactgcctcactgtcttcacctgccaccccctacatggccagggcactgtgtgctcttctgggcctcagcctctgacccctctgcacccagcctgtctttatccaggccttctcaggacagtctcgcaggcctggagtaggcagccgctgaccacctcttggaccccagaccacaccgggttggcctctttggtatcaccttgtgggtgggtcaaggggagggttgtttctgagctcacagctctgggtctgccttaaccccggagtggagaggacaggatggcaggtgtcgggctggagagaagtgggctgggacatggggtccatccacctgcctctgccaggtgggctctgagagtgggtgattctgaacttccaagggccagggacacagcatcgtctcgctgtcagagctgctcagagagggaggaagcaggggtgagctccggttcctgggaatttgcgcagaggcagtggccgtatggctggactgctgtgcaggggcctaggttgggctgggcagtggctgaggcctgcactggggcagctgggtcgttgggggccacctctggcaggaatgtgccccaggggagtgggtggagggactataaatagatcacgcgtctgtcattccctaggggctgagcaagggagctggcctgtccagggagtggccagacacatgtaggggctcactcgagggtgcaggtgggcactcagccaaggcaagcctgctggggccaatgggtgggggtggggggagctgagcaaggccattctgccccctgtctggttctttctggccaatgctctgtgacagccctggggagacactggaaactcccatccatgggggcccaaggcatccctgcactggccggagcaccgggccggtccgccaggaaatcctccagccgcccttgaccacactcactcacctgcacagccaggcctctgggccgtccttgaccacactcactcacctgcagagccaggcctctggggacatgacagctcaggtggcttgtcttcctcgggagagttcccaaatggccacaactgcctaggagctcagcagattttcttgagaaaacttaaaagtgagaaaattatgcccatggctaaaatgtctcagccagcacggaaaagcctgtgtctcagatgcctttcagcattggctgctggatggtggaggattccccaggcctaaagagcgggagggtcctagcgggaggggacaggctaggagggctgggagggagagattcctgctgggccaggagtgagggggagtttctccaggctttgaggttaaagcagtggttggaaagaacaggattgaacctggtggaacagggctgggtgagcacagatgttgacactcagcatgcagggcagaggggtgaggcccggcaggggcaagggccttgagtgccaaggtagagaccctggacattgtcctcagggcagtggggaagcacgggaggagtgtaagcacggtgcggactgtgtcaaccatggaggacaggcaagagggggtgagactaacgggccgggcgcagtggctcacacctgtcatcccagcactttgggaggccgaggtgggcagatcacctgagtcaggagttagagaccagcctggccaacatggtgaaaccccatctctactaaagatacaaaaattagctgggcgtggtggcaggtgcctataatcccagctactcgggaggctgaggcaggagaatcacttgaacctgggaggtggaggttgcagtgagctgagattgagctactgcactccagcctgggtgacagagcaaaactctgttcccccactctcccccaaaaagagagggtgagactaacaccaggaggtgggcgagcggcattgaacagatctggggagctggccccagaaagcacctccacctccacctccttgagatgttgacggtggtccctgtgaagtttggcttggaaaggtggtgcctggctgctggaggacagacacaggctgggtacctgcggctccatctgaggggtggggtggaggcaccccgaggaatgtgctcactggaagcccagacagccctgcccagcgctactgcagtccctggggcctcctaaagccagacggggcgggggtgagagagggaccctttgcgctcccaagccagctgggtggccttttagggaagtttttctgaagcctgatgcttgtggcttccccgtgatttatgtcatttacgagggatgtgtcctggggagaattctggatcctgggtcagtcctgggggctgggggcggtcctctcaccccacctcctggctctgcccaggtgtggctgagcagttgtcaggggaggcgtgggggctgggctgtggtggttgtattggggacagatctgggaggttacaggcgggcttagactttactctgaggacagtgaggaaccatgaaatggggtgttgggactggatttcggcttttgcttgatgctaggggcagaagtatgatgggacggtaagactggggctgggggcagggcggcaggccttgaggccttgaggcctggttggggaaggcagtgggagagatgagctctcgcaatttgggtgaaatcaggcctgggtgtgtgtgatgggcaagagaagcaaggatgagcctggtgtctgaaccttacgataatgggtggtgattccccaaaatgaaaaccaggagagtatgtactggagggtttgggggtgctgatggaacagtggagtgaaggaggcgtgggggacgttgcggggatggatcctggatgcagcttggggggtccggtggggctggggtagactgaggtctggactaagggaggccttgggagcctggggctgtcctgggagaagtggaggatggaaggggctggaaggaagctgtctggatgtgtgcccttacacatacatcttaacgcgctcttgggtttttcttccagaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactgggggaacggaggatcctcagcgtctgttttcctggggagtggtcccgccgtctccacctatggggcgtctgcctggggccctaccacctgcccataccacctgcccataccacctgcccacacccagtccaggaaacgctgagcaaaggtctggggttcacacatcaccaggattgctcccttggcccccaagacaaggctctggagagccacactcgagtggcaggtgcagcgcccgcagagcctcccagcttgggatgctcgctcctcacagggacggtgttgacaatttgtgcacgagttcaaggccttttgtgcattttattttatttgtttatttatgtatttatttgagacagagtctcgctctgccacccaggctggagtgcagtggtgcgatctaggttcactgcaacctccacctcccgagtagctgcctcagcttgaagggtagctgggagggcatgcgccaccacagccagataatttttgtatttttagtagagatggggtttcaccacgttggccaggctggtctcaaactcctgacctcaggtgatccgcctaccttgctcggccttccaaggtgccgggatgacaggtgtgagccacctcgcccagccccttttatgcattttatgatctgcatgtcaccccctgaggaaacagcctgggagagttccatgattgggcctggggcagggctgggcccggagcctgaatctcaggggccccttgcatcccacagaggagcctcaaccccagctcttctgtaggtcctacagctctcctgctctatctccctctcctcctcaaatcccaggatcccatccacctttggcccttccaagcccagctcaaatgcacctcacacctaccacctccccagggcttccctcagctcacaatacccagggacctctgcgaggctgcctggggtgagccggctcgcacaggtggccctaccttcctggaagccggggctcagggaagggagtcgccatggccctcgtttcaccaaaacccatcatgaaggcttagtatctaatccttcactcagctatcctgggaaggagacgcaggccctgcccacagggccagaggcaggattgtctacataatttgcagggcccattgcaaaatgaaaacctggaaccctttgaccaaaaatgacaagaattacaaagacagaagaacattcaatatgatggccggacgtggtggctcatgcctgtaatcccagcactttgggaggccgaggcaggtgaatgacttgaggtcaggagttcgagaccagcctggccaacatggcaaaaccccgcctctactaaaaatacacaaattagccaggcgtggtggcgggcacctgtagtcccagctactcagaaggctgaggcaggagaatcgcttgaacccaggaggcggaggttgcagtgagccgagatcacatcattgcactccagcctgggtgacagagagagactctgtctcaaaaaaaaagaaaaaaaaaagaacattaaaattcaccaaaccgtgtgcttaaaatgggtgcattttattgtttgtgaattacactgcagtacagtttgacttaaaagggaaaaaaagaggtagccacagaagaggtgggtgggcacatggctggcatgttggtgtggtggtgtcagaaccctcaggactggagaggagtgctcagtgtttgggggcagggccagcccccaggagttcttaatccagggcagagagaggccgggaatgagggaaaatggccccagcacagagcgtttttgagcccggggcctggtgcaggtacttggatcacacgtccatgatgccagcttgtcggtggaggcagcacccccacccccaacccaggagctcccaggttccttagcagggggcctggggttggcgccgagctcacagcaggagcagggtaggcagaaggcgcctccctccacatggtccacccgtaagacctctcataccacaggaccttctcat

SEQ ID NO: 12469 - DNA, 7070 bp, Human
tctctactaaaaatacaaaaattagccgggcatggtggtgcgcgcctgtaatcccagctacttgggaggctgaggcaggagaattgcttgaaccggggaggcaaaggttgcagtgagcagagaccgcaccaccgcactacagtgtgtgaaacagagtgagactccgtctcaaaaaataataataataaaaataaaatattcttcaaaaacatggccgggcgcgctggctcacgcctgtaatcccaacactttgggaggctgaggcgggcggatcacgaggtcaggagatcgagaccatcccggctaacacggtgaaaccccgtctctactaaaaatacaaaaaattagccgggcgtggtggcgggcgcctatagtcccagctactcgggaggctgaggcaggagaatggcgtgaacccgggaggcggagcttgcagtgagccgagatagcgccgctgcactccagcttggcaacagagcgagactccgtctcaaaaaaaacacatgattttatttcctgttttatttctgcttatttcatcaagtgaaaatatcataacttatttcaccttttactgtcagtggaacatttacttgtttccaatttcgacaaactctgcaaatgcacatctttttaaaagaatctgcatttctgattcttcaaaataaattcctagaagtgatattactggatgaaaagtggatggagagcttaaaggctcttagttactcaagaattactgggtcaaagaggatggcccattcacagcctttgaataaaaataaatattgccaaactgctttcaaggaaggttttctaattcatcctctcaccagcaatataggagagcgtgtggctcacattaataaaaagaactctgctgttttgagcagtactaagcggagcgtttaaacttatatttctttgattaggaaggctgacattcgttcctgcaattcatatttcttccttactgaattgcctgttcctatcctttgctcgtttttctatagggatattatttcattctttcagtgttgtttttacaaaataaacaatttttttgtttgttttttcccccgagacggaatcctgctcagttgcccaggctggagtgcagtggcgcgatctcggctccctgcaacctcggcctcccgggttcaagcgattctcctgcctcagcctcccaagtagctgggattacaggcacgcgccaccaccatgcccggctaatttttgtattcttagtagagacggggtttcaccatgctggtcaggctgatctcgaactcctgacctcaggtgatccgcccgcctcggcctcccaaagtgctgggattacaggcgtgagccactgcacccggcccaacaaatgttttagaaagccatctggatgatagtccatgactgctgaacaccggctgaggtccacaaaactgcgctcaccgcttggggactttccagccggcctttactctccatggaaagcggtctttccacaaacctccacggtgggaattactgcaaaggcatcggctctcccggcctcgaatatctcgcgggatctcagctgtccttgggccccccccctcagcgcaactaccaatcccaacatgcaacgcgccccgtggcccaagcgcccgaatgaaggctcggggccaaagtcatgtgtctgactgcgtcacacgtcccgtcatctctcccacgcctttttcttcagcgtacaccttggtcgccatcttgtgcgcgaggttatggaacctctgagtcccgccaactctatggtcgagcgtttcagggatcggccaatcgtaatccagatctcgtaggaaagccccgcctctatccgcatggaggcgggaattgccacgaagctcctgtggagggagaggaagcagctgcggaaagccaataagagtggggaatcgatgacgtcaaccaatggggacgcggggatattacggccaatgagaatggagaaggtccaggacacgtgggtgggggaagctgagcgctgagaccaagggctaaagctgggaggtgagtctgtcaccttgagccgggcgagcgctgtgggccaagcaggggttgcagggtagtaggagtgcaggtgacttggggccgggagccagcaataggcagggttgtgggctgggcagtgtggaggggtatttccccccagtgctgggagaggctatggcaatctagatatggccttatcaatgaatgttaattaccaacggtaatgaacgattgactgcctcggctggggcgggtcggggactgctgtgtaagatgggcaggatcctgcgcgacacctgcccagtatccgcctccagtcttcccgagagaccattccctttcgcaacatttccttcctggggcttgggcacatttccttgacttccgatctccatgactttgctttgaagacccactgctctgtccctctgacctctaatgccctcctcagctggggcacggtgcaaggaagagcgtggtctagggaggacggacgggggtgaaggggacgaccaaaggtcgtcattataagcaaacaaccagggtctcagtgggattattattactattttttccccctctgcagactgaaaaaatgcagaccgccggggcattattcatttctccagctctggtaaggtgccgcgccgcggtgctctgtagtaccaggtgtatggtgtggacgccatcagtgtttaatgaatgaacccaggggagcttggcgtcctgatgatgtaggctctttgaggtggctgtaggatgtgatgaaggtaacccctgtttatctgggcctgtgaaccaagctatcttggctttggaatgtggtcagagagtctggatttgatttttatccccagtctgtcctggccatagagacagcccactaaaacagtggttttcaacagtggctgcacgttagaatcatccagggaactttttaaaatcctgatgcctaggctgcaccttagaccatttgcatcagactttgggaatgggggtggaacccaggcatctgtatcttttaagacttctccagatgattccaccgtgcagccaagtttgagaaccactgcactaaaaattatttcaaaaaagccatgttacagatggctctccttggatggctattccagtcggtttccggggctgactggcccactccatttagggtgtgtagctgtgagtgtattttagcagaataaaatttcccccatctgattacttggtgatctgggtataaacctttcctgtacctgctttggtattagtgtgggttcttgttccattctgagaagctgattaaagctgtgcccaaagaagtgaactttggtttggttttgaatggtgaaggttgccactgctgactatatcaagctattgagacagctgtctctggggcaggcctatctgataggaacaggaataaattgaccttgaaatacattgaacttattctgtttatgaaatctgtagtcatttttgacagctcagcaattaggattttttttccttgactgatttggtaggatgtggctttctgattttacagatccgctgttgtaccaggggtctaatcaggcctgtgtctgcctccttcttgaatagcccagtgaattcatctaaacaggtaagggaggaatagctctcttaggaatgttcccaaggcccaggatggtggctcacacctgtaatcccagctctttgagaggctgaggcgagaggatcacttgagcccagttgttcaagaccagcctgggcaacacagtgaaaccccatctctacaaaaaaaataaaaaaattagccatgtgtggtggcatgtggctgtagtcccagttactccagggctgagatgagaggattggttaatcccagaggtcgagactgctgtgactatgccactgcactccagactgggtgacagagcaagaccctgactcataaaaacccattaattaattttttttaaatcaaggaatgttcccagacaggggtccttcagcttaagttgcctttagaccaaagtgggaggagagttggagaatctgtatgctttaatagttctaagtcccccaaggtaagccttgtaggtaagaaacttataaaagtgaggtgtgcctaacccatgaaatttccctagtcctgtctgctgtctgacaacagactctaagactaattcccagcatactctgcaatcagagtattctgcatttaccaggcagtttgccaacagtttcagagctcaggtgggtggggtgaaggaggtagagtcagccacctgtccttatgccatactatctctctgctatctcgcctgccttgcttctctttctagccttcctacagcaacttcccactccaggtggccagacgggagttccagaccagtgttgtctcccgggacattgacacagcagccaagtttattggtgctggggcagccacagttggtgtggctggttcaggggctggcattggaaccgtgtttggcagcttgatcattggctatgccaggtaagtttgggtggtctacagcatctcccactgtaaattccaccccgtttggggaagcctcagctggaggagctcccttcaggagccttcaggttgatttcatctacatcatagtttctccagagaaaacatgcatccagcctggctcacttaaacttaccaggttggcccactctgcttgtccatccaaatccccaggatctgtgcaggctaggccctctcccaggagtaacagtccccattcacctcaccctcctgtgtcctcccctcccctcaccccttcctctccctcaactggcaatgatctctgtccctcccaggaacccgtctctcaagcagcagctcttctcctatgccattcttggctttgccctgtctgaggccatggggcttttctgtttgatggtcgccttcctcatcctcttcgccatgtgaggctccatggggggtcaccggcctgttgctactgcaactccacaccattcttggtgctggggtgtgttaagctttaccattaaacacaacgtttctctaaacccctgtctgtgcctctgtcctttgaccttcaggagggccttggtagaagggtgaggagagggaatttgctcagccatgggtgatgggaactcctcagggctgagaaggagcactgccatgactgtaagaacagagggttctcatgttctcccaggaggaatatgggtttgtctgagtaatgagatttttgccttttcccttcagatttattacagttggccatctgtatccataggttccatatttgtggattcaactaacagtagacagaaaatattcagggaaaaaagtgaatggttgtgtctgtactgcacaagtacaggctttttttttcttgtcattattccctaaacaatacagtatagccattatttatatagcatttacctagtatttaggtattgtaagtaatctagagatgatttaaagtatatgggaggatgtgcataggttatatgcaaatactacaccattttatataagggacttgagcatctgtggtatccactggggtcctggagccaatctcccacagataccaaaggataactgtaacaactgcatattaataggttacatttttgaagggcttaatttacaccaagcattttacattcgttatctcaacaaccctaagagttataagcacaactttaaaactgttttgcaaatgacagacccagggtttggggaagcaaaataacttatccagtatcacagagctagtaagtggcagattggggatttctcccccaggccagcttaaaccttaactgcactgttgtcctatctattttcttttttttttttttttgtcccatctattttcattctggtcacacaacaattaatgtggcacagaaagggaaacttagtcccaaagaagttgtatagcaggtgaaaggtagaggtaggcttctatctgcctgtgtttagccccatttgtaggtttcattttcactatcaattagcctttctcagagtatctaaatgttcttaaagcagataaagtacacaatcctggttcttggagaatttatcaccttagttttgctaggataaaagactatctggagccaggcatggtggctcacgcctgtaatcccagcactttgggaggctgaggccggcggatcacctgaggtcaggagttcgagaccagcctgaacaacatggagaaacccagtctctactaaaaatacaaagttaaccaggcatggtggcgcatgcctgtaatcccagctacttgggaggctgaggcaggagaatcacttgaacccaggaggcggaggttgtggtgagccgagatcatgccattgcactccagcctgggcaacaagagcaaaactccgtctcaaaaaaaaaaaaaaaaagatgatttgggggcgtgtgccaaataatgaattccataaagagcttcgtccagcatcttccttgggttctcaaagtctatgcccaccagtcttgcccctcttggctaaagtgggactgataacccatgtaaaattagctaagttgacatatcaacagttgctgcttctctaagtccttgcaggagcaagccatggacagagaactcatgcaaagatgctgggaacgtggtctgtctcaaattggatggcttcaaaaggagtagtaacgtaaagtgggatccattctgtgaaaactttatacctcaactgcaaaatgtgaaatagtgaaaccaagaaaatatctaattggtgttaagaacaccttctaactgaaaggcaactagcaaagagggttaaaacatacagaaaatttggattccatttacgtgcaatttaaagacagtcatgtaggtatttaagcatcttcctagggaccttaggggaagcaaagaaatctaattctaatgtccttgccctcaaggagtttggggcaccaacagagtagaaataagtacaccatgccctacctcattgtatatgtgggtacatgagctatgtgctatagaagttcccagaggaaaaaggag

SEQ ID NO: 12470 - DNA, 13648 bp, Human
tatctctgtcataagtcccctgccccaccctagggtcatatttatattaaggatcccttcctgctcctggatcagagagggccatcttcgcaggcctgggcagtcactgacattggcccacccaaccagttatcaattaatctccatagctctatctgaggatctggggttcagggcctgggagagggaaactgagacagacacagagatgaaggggagccaggcagacaagatggcagattcctgtacaaggtcagccaagagcagggcctgaaagagtgtctctattcaagatctggacagcagacattgtactagtggctgttcgactcctgctgagtacaggaccccgggtgggatcatttatctgtccttccatccacccctctgtttgtctttccaaaactgcctgctgaggactagccagagacaagccctctccctggcacaaggccacgtgctaagatgaatcagattgggccggctggagccagtgggtggaagacagaggacgcaccaggtggagggcacaacaacgaccagggctcgtgggtgggaaaatactgggccaaggcaggcactggggttgagtgcagggtggagggtctgagctcccagggggtgtactgaaggttatggggaggtcaggagaggagggacaaacagcaggctatggagggacaaagcagagtccctgaagaaaggaggaagcagtagacaaaataacagggagggtggaagtcagagcctcagacttagctccatggggaagccacctggtgtctgcctgtcttcaggcccattggttgatgccactccttctcactcccccttgggggatctggttccacctgggccaagggttcacattgccattcctgtccctgcatctaccccagggttcccggacccccacactcacagcacacccttgtacccagcaccaaggagaaatggtaaagaccccagtgtcaggccaggagtggtggctcactcctctaatcccaacactttgggaggccaaggcgggtggattacttgaggccagaagttcaagaccagcccaggcaacatggtgaaacccccatctctacaaaaaacacaaaaattagctggatgtggtggcacacacctgtaatcccagctacttggaaggctgaagcagaagaatcacttgaatcaaggaggtggaggttgcagtgagctgatatagcaccagcctgggtgacagagcaagactctgtctaaaaacaaacaagcaaacaaacaaacaaacaaacaaatcccacaaaacccccagtgtctggagtaagaaccccagctaatgaaccctttaccccctggctagatgaccttgggcaagtcacttcacttctctgggcctcactcccctcctctgtcagatagggctgatggaagcacccaaccttgtagggtaacagagagggttataccataggaaggacccaaagcttggtccagcgcctgcaacagcctctggcaaacagtggaagctccagttttggacacttgatggtcagtgtagtttgcagtttaaaggggactttccaaccccaaaagattcaggacccagagctcaggtctctggtggtggcatttgcaggtctggggcaagcctagggaagggacgccatgtgcggcacgggcatctagtgtcccagagtccgcacgggttgctgggggaaaaagagggatagtcgcccagccagggcaggggtgggagttggggggagagggttacttcctcctgccctgaatctccgctcggggttcaactggctcgccggcgggcgagggcggggcaggccggcctctctggccctgctggggggtggggggcgggtcccccgggaactgctcctcccgccagccgctgctttaagaggctgctccgcggtagcgagcggggccggagccgcagcccgaacgagcggaccgagccgaccgggcaggtgcacggctgcggggacggcagcggcatgaccggccaccacggctggggctacggccaggacgacggtaggcacagacctcccccaccgcctctggctcggacccccgacccaactgcactcgccccaaccctcttgcccagctggtttcccagaccggaaagctcccacactccaggctgggcgggacccctcttcccatcccggcccccgaacttggcccaagccttggtcccccgcgccagacgcaaagtccgcgctgcgccccgggtggccccgccgccagcaagcgacctggcggctgtgtcctgccgcctcctccgcgaagcccctgattgcccagcccgctcagacccaggcccagactctcactcactcgccccgggcgtgcgcagcgcgtgggggtggcccagggcagcggggggcgggcgccgcggagcgctgtgcgcgggtgtctgcggggagcgcgcacggcaagtgagcggggacctcgggggagcggggctccgcgtggcaagggcgcagtgtcccccggagagaatttccccgcagaagtggccgagctgccttctcggccggtacgtgagggaagggggcacttgggggcgcaagcatgtgtctgggtgtctacaccgagcagggtgtttgcgcacgtccgggtgtgagtcgtgggagcccgtggcccacaccagcctcctgggctgacgcggaagagagctccttcatcctgcctcagtttccttaggactcagagaaagggagaagaggcagaaggtgagagccagacggctggagtgtgggtctggggcagtcaattccctttggggccatttcttaccaagcaggggtgggggtgtggggtaaggggttccctatttccctggggagccagtgcaagacaggtggggtgcggagaagaaaaagtaatgatgggaggaacatcccccagccccactcctctgcggagaggcagtcactttgtgaggttgggtgggggaccacagtctgggaagccagaaagttgcagtagaccagagggagggtgctgtggagtctttggctccctctggggccccaagaacaaaggagcatattttggaagagaacccccagatctgggtatgcaagagctggaaagagacattcagaaaaagatgatatagacaagcagagagggagagacaggcagacatggggcagatggacaggacccatagggatcatcttctcccagcacctgctctgagccaccttttgggtgcttcccccagagccagagtcccctgcctccagctcttcttgctagtcatgcccaccagctctgagcacccagtgtcctgtgtagcctgctccatgggcctgctcccccaaagcagccaccccatcacccaggcagagctggattgtccagtcgaggaagggaaggacagaggacagaggtgccggcatgcagcagtgttcacagggcttcaaaaataacccagaggggccgggccacgattctgagtcatccattggggacacggctctgtcggcacctgctgctgttttctcaggaaaacttaagaagccaaaaagggggagaagcaccagccggcagtagctctaaaaataggctgcatctcaggatgttccccagggagatgctgagcctctcggctgcagatggatcctctgggaggcaggtggtgggcgcctgtgggtgtgtatgcaggtgtgtgtgtgtgtgtgtgtgtgtgtgtgcatgggcatgtgttttgctgtggtcctttatgcaaacttgggtctccaacagaggggtttgtgtgtgagagagcatatgcgtgtgtcagatgtagtctgcagggctgtgtgtgtgtttgtacacatgaatgttctgggcctggctgctctgtgtgcacaatggaagatcatagaaagattaatgtgttcataggaagatctctatggacttgcaggcacacacattgggagggcagctgggggcagtgcatgcacatgctgtatttatattagtacatatgcatgcacacatgtgtgagtggccctcagttccctcatctgtgaaatggggatcttgctggtttctatttcacaaggtggttgtgagaggcaaatacatgtcacagagtcaaagctaggttgatgtgagtttttgttgttatttatcacaaacaccaacaccaaattgcccaaggcacagaaagaggtgagatactgatggggtcaggtcagagacttcagatgtctggaggtctccctgttggggagacttattactctgagccaccccgagcctgtagctgttatgttcccttccatacagtacctctctgggcctcctatcagcactggaaggtgagttttagtgagaccatttcacagacaaagaaatggaggctgaaaggggaaatggcaaagctgggattggaactccaagctgtgcagctccaatgcaggggctcacctctgaaaggatgctgaagagaccattcccctatgggtgtcctcggcctgaagcccagagatcctggctggcctgagtccttgccctcctccccacctgcaggcccctcgcattggcacaagctgtatcccattgcccagggagatcgccaatcacccatcaatatcatctccagccaggctgtgtactctcccagcctgcaaccactggagctttcctatgaggcctgcatgtccctcagcatcaccaacaatggccactctgtccaggtagacttcaatgacagcgatgaccgaaccggtaagtggcccctgccaaagcctggcacctggcccctggccccttagggtcctaaccttgtgttgggcagtctcaggaagcatgctatggtgggtaagaaaggttcctcctctcaccagctgtgaagccttgggctgatcttcagtctccttatgtataaagtgagagcaataagacctaccctcttaggtcatagaggggaaaaatgaaaaaaccaagtaaggtcgatagatctggcacacagcagatgctcaggaaatgctaatttctttccttcccttccttcccttccttgtggtgctacagatcaggtttgttttcactctctgccccatcactgacctgccaagccctcctcgctgtgtgatctggccaagcctagcagggagagagaagggagctaaaatttacaagtgccaaaccccttgctaaagtcacaagccgctcatttattcttctcaataacccatctctcagatgggcaaatagaggcttgatgagctggggagggccagaagcagcctggtccagcctgaaggtctctctctctctctccagttcacctatgacttcaaggtccaaccatcttgggccagtaagaggccagtgggaattcgtggcagctccttccaaggcctctttgccctgggattagagtccagattctttcatgataaattcctagacaggagtgctgttcattgaagggattttcgtccttatgactgggccttatgactgggtagagtggtggaatggggcgaggaagaaacctactagagtttcttgtgtaaggaagtattaataactggttccttcctcctccttctcccctccccacaaatacaataaaagccctcaaaggaacttaagtttcaaatggaaaattaaaaggcaaagaggatgaaggaagccagacctttcatgagaagagtgatcttacttagttctgagttccctggtaggctaggaaaaaacagaaagaggattgattatagtttttgctgcaaaagaaagggagtctagcagatcctcaggagagagacaaagcatttatttcctggtactgaattctaagaaaagcctcttactcagagctttggggagggggcgtggggctctagctgaccctagatgatagtttggcaaggaacagttttcatatgactgtcccttctaacagccttcagagggcactgggggctcaactaagaaatcagtagctcaatgaaggccactggggtgggagaagacacagggggacatgcctttggattactgatctggggtgttgccttcaggcctggctggggctccctcccccacccagaatgcccaggccggagggcgcaggaagccagtgaaaagaggaatgagatggtggggctctgccactcacccactgtgggtcactccagaggtcagacgggttgatgccagcagagtgccaaacacacattgagtgccccgtgaatggcagcacattctgtgtgtgaactgggggaggaggctaaggggtccaaggtcaaggggtgttacggagggagctccctctctaggagcccacactatagggtcccaggtgaggcatgctttggagggtggcatctgcagacctatccaattgcttagcctgcaggctcagccgctcctgcttccagggatggggcagcctgattagggccccacccacagctactactcccagactcctagccagtgcccaggtcttgcctctttgataagaccgggcaagaaagagggacttctggactgtcctgtcctcctgcttaaggaggccacagggccaaagccctaccctggtcacccatcatggaagggaccagtggaactctgagcctggggtgttatctgatccaggagctcacattcaagcctagctggggctccctccacctccagatccctttcagctggaaattctatcagtcccaggaggcctcgtgcatggccccagctcactgggtgtcaaggcaagaaagttacaaagccagcacaagtggggccctcagaagaggccatttctgggggaggcggcactggaggcacctgggcctgtccaggaaggtagagaccctcaggagctaccctcctcttctggaaaagcacaaagtttaaagaagtttcaaggttctagggaggcagtgttgcctggtgattagtggcttgggctttggacataagagatactagttcataccctagttcagtgccttgctgtgtgaccttgagcaaatgcctcgtcatcactgtgcctcagcttctctctttgtagaatatggataataataagttctgtccctcatgggctactatgcagactaaacaaaatagtctcttcaacctagccctggatcagggtttcagacatggtaggcctaactgtcagtggtaatgggggtcctgggaggcagggtcccaccctccatgggaaatcgggcaggagcggggaggacagctagatagagagctgtcctctgtcagtcccagacccttctgccacctgccggctgtcaggatttctgccctggcccagctcaagggacaggggtctagggggcagtggggaccaacccaagcccagtcagcccagtgaattttccaaatgaaaaatgtatcccacactttggaaggctgaggtgggcagatcacctaaggttgggagttcgaggccagcctggccaacatggtgaaactccctttctactaaaaatacaaaaaattagccggatgtggtggcaggtgcctgtaatcccagctacttgggaggctgaggcaggagaaatgcttgaacctgggaggtagaggttgcagtgagctgagattgtgccaccactgtactccagcctcggtgacagagcgagactccatctcaaaaaaaaaaaaaaaaaaaggaaaaatgtatctcagctggcacagtggctcgtgcctgtaatcccagcattttgggaggccaaggcaggaggattgcttgagcccatgagttcaagaccagcctggccaacatagagagaccccatctctacaaaaaataaacaaattagctaggtgtggtgccacatgcctatagtcccagctactcgggggggccaagacaggaggatggcttgaggccaggaggttgaggctatcataagccatgtttgcaccatggcactccagcctgggcaacagagcgagaccctgactcaaaaaaaaaaatgtccctttcctgggctgctgccctggtcctggcactgggctgtcggtcctctcctactcattgccactcgccccacttctacccacagtggtgactgggggccccctggaagggccctaccgcctcaagcagtttcacttccactggggcaagaagcacgatgtgggttctgagcacacggtggacggcaagtccttccccagcgaggtacgggccctcctccacttgaatccctctgctacatgggaaggaacgcaggcctgggtagtcaggggcttgaggatgcctggggtcgggccttggagagggggaagaggagcacccggggcctttgggagagatattttctacccacccccagcacagggtcttccatctgaccctgtccactgctatccttcctggtctgtgcgtcgtggagttttctgaagggctacccagtcccactgcagccttgctgacagccctttaagggttgagcccagtattcaagactgtgcatgaactgatcttgcctggcctcatccttcccctcacctcttcatacactgagctgcatgtgacgaatcccctgtccacacctggctccttcataccaccaagctttgtctgtgctgttctctctgcctggaatgcctttccccaaggcttccctctgataaccctctgcttattctctggactcagctgtaggcaccacctcctcaaggaggtgtcacgctggatgttcatgatcgatttcacagctcgttccctgcaaggcagggcttgggccagattcctctttgggtcccccggagcccagaaaagaattgggcccagagttgggtggatgctacctgtgaccctctggggctcccctggaccccccagcatcctaatccttggaggcttgacagcttccccttcctgcaaagaggccaggggtctggtgggagtgaggggagcctggctcagagttcccattgcctctgggaggcacgaagcattggcctgttgttgccccatagctgcatctggttcactggaatgccaagaagtacagcacttttggggaggcggcctcagcacctgatggcctggctgtggttggtgtttttttggaggtgagtggtggtttgctggggcctggaggggcatgggaggcctggcactgcccctagttctagaacacagtgggctctgggctcacactgccctctccctgacagacaggagacgagcaccccagcatgaatcgtctgacagatgcgctctacatggtccggttcaaggtaaagtccctgcccctgacccgagcagcccgatggggagagaggaagaggctggctcacaagttgggcccttccagtccttcattctgggagtaaacccttgctgagaccaaggaggagggtcagcatcagcagggccctgcacctgattcctcatcggggtcagcagcccccttgggtgtccagcatgaagcccggctaggtataaaattgataagatgcttgtcacattaatggtggtctaataggcaatgtcattgagggcagctgaaggcaagggagggaagatcgtggccaaatacctccaggagccacagcttttacatacaagcaaacggatgagagggcccggctcaggctggaagatggcatctgggatcacagacatttgctcacaatttgcatcagtggacacagagaggcctaaatcctgctgatagaaatgggtggagaatgccgggcatggtggctcatgcctgtaatcccagcactttgggaggccgaggcaggcggatcacttgaggtcaggagttcaagaccagcctggctaacatggtgaaaccctgtctctactaaacatacaaaaattagccaggtatggtggtgcatgcctacaatctcagctacttgggaggctgagagaggagaattgcttgaacccaagaggcagaggttgcagtgagccgagatcgtgccactgcactccagcctgggtgacagagtgagactccacctcaaaaaaaaagaaaaagaaaaagaaagaaagaaagagagagagaggggaaggaaggaaggaaggaagggaaaggaaggaaggaaggaagaaagaaagaaagaaagaaaaagaaagaaaagaaaagaaaaaaaaaagaaaagaaaagaaaaaagaaaagaaaaaagaaagaaagagatgggtggagaagttgctggtttggtcccagtgggaggtctatgctgattcctgggttcctccaccttgttccagggcaccaaagcccagttcagctgcttcaaccccaagtgcctcctgcctgccagccggcactactggacctacccgggctctctgacgactcccccactcagtgagagtgtcacctggattgtgctccgggagcccatctgcatctctgaaaggcaggtgagtcctctcagaggaccagatggagggacatggcactcagggctcaccccaggcagtgtgactctccaactagcaccccacagcccgtgatcccaccttcaaggttcctccccattttttactaataaatgtatagattcttggttgggagttagcttgattgttaatcaccagaacctagacactggctgggagcggggatacctggatcctgggacccccacccccgctactgtgttggaatctgaatgctacatttgctgataagtcttagctagatgggcttggaactagaactaggtaaagcagagcccagaccctttagtgagtaaataaatgagggtcctgcagagaaaaatgagtggggaagagtagggacagaccctaagggaaggaggagggaggggtagagctggctgggcaggtatgccagatgatgcatctggggtcatagaggaccacagcacccccaatctgccctgagcattccttctgcttcctcaagatggggaagttccggagcctgctttttacctcggaggacgatgagaggatccacatggtgaacaacttccggccaccacagccactgaagggccgcgtggtaaaggcctccttccgggcctgagctgcccatctgcctagccggccactagggcaccatcttctcaagggcttccatgtcagcagacaccaaaccatctgaggcttcctccctggggggtgctggggaccctccttcagccagtttgctccttggtcaccctggaggcttctggatgggacccttgagtctggggcacccttcagctgccctggggacaggaaggacaggagctaagcagggtccaagcctggggctgcctctgctctccaagacccaaagaccctgggaacctcctctggtcttccccactggcagtggcagcagccccaccccgagcgcacactgtgatggaggagactgagctccctggggcgggcagctgacactaccagagagactcaagcaataattagaggtgggcagagctgccctctcggcattacctcttctgcaggctctgccatgcacgcacctcactgccaggccattaaaatcagcacccagcatgctggaggtgacgtggccttctccctccagccacctgctgccacgggcaggccctggctatagcttatacagtatctccccttgtccccacccagtcaccaaagccacctacatgacagtccatccctgttgaattaataaattaatgtatccatgcaacaaataccaattgagtgcttgtgctgtctctagtaccgtcctaggctttggggagcaatggtggtgagttaagcactatgtgttgggagggatatgagtggtgagcaggtgagggttacacaaagggcagggaaggggctatgggagcagatgagaggggaagaccatgtcactcagcaaagaaatgcaattctggtcaggcgtggtggctcacgcttacagtcccagcactttgggaggccaaagcaggtggatcacttgagctcaggagttcgagagcagcctggccaactgctgaaaccccgtctctactaaaattacaaaaattagctgggtgatagtggtgtgcacctgtaatcccagctgctcaggagcctgaggcaggagaatcgcttgaacccaggaggcagaggttgcagtgagctgaggtcgcaccactgtaccccaggctgggcgacagagcgaggccctctcaaacagaaagaaaggaagaaatgaaattccaaccagtattccaaatcagatagaagggaacagcatgtttgaggccaagggaagggcaagtgtgcaggctcagaggtgagagagagcccagtgtggttgtggggctcaaaaggctcaaaggggctagagccctgggggaaacctgggaccccctccccaggctgacggggagctaccaagggcttatagtagaggaggggcagggccaggcctgcaaatggggaacatccctgaggaatgcggatgggcaggcaggaatggtggcagggagcaaggggtggcctgtgtccaggcgggaggggacagggtggagggaggtgggagacagagggctggatgagagagatttaggaggtggtgcccaaaagacagtgtttggctgttcaggatagagaggagaccagggcatatccctgagcagaaagtggagccttcacttgctctgggaaccctacagggagctggccacattggacacgcagcattgtggggtcctggaaggaaaatctaagggggcatgtgccttcaggcccaggccctgcacacgcacaaccccaagagggggttttatttttatttttatttaattttacttatttatttatttatttatttatttatttatttatttatttatttttgagacggagtcttgctctgtagcccaggctgaagtgagtggcatgatctcagctcactgcaacctccgcctcccaggttcaagcaattctcctgcctcagcctcccgagtagctgggattacaggtgcgcaccaccatgcccggccaatttttgtatttttagtagagatggggtttcaccatgttggtcaagctggtctcgaattcctgaccccaagtaatccacccacctgggcctcctaaagtgctgggattacaggtgtgagccaccgtgcctggccctagagtgcttttttttaaatgtgcatcctcaccctagtccctagtccaagtccaaaaaagtgcccaagggcaagttcacagttgggcttagagaccaagtgatgattgtgacccagatgagacagcggcaggagccggagacagacactgggggtgctgaggagtgaggggaggtgagaaactgggacctcacatgtataagtttagttgtgaagggggagaaagggacagtggagggggctgcggggagatggaatgtccgaacacccttgggaaggaggccccactgcagggccaggaggggctggtggtgcatgtcatcagctcactttgaccacagctcctgtcaatgttactataccagaagggaactcccaggccacagggcacttttgggtcttagattaactttgacctcagtgatctggggaagggagaggcttgctctatggacccccctcccactcccatgcttagggcaaacctgtctccggagtggggaggaatggggtatacaggaggagcaggccaaatagagagttaccctgcaggcgcccctggcctgat

SEQ ID NO: 12471 - DNA, 11145 bp, Human
  misc_feature (1)...(11145): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgcccagtctagtctccgctcccaggctcaaataatcctcccgcctcagcctcctaaagtgctgggattacaggcatgaaccactgagctgacccttctcctctacttataggactccagccacactggcctcctgaaagcaggcgccagtcacattctggcctcagagcctttctgcttcccattccagattccagattcccggaatgctcttccttctggatatctgctaggtccactcccccacttagttcagggcacaactcaaatgttacagtctcagtgaagccctccccagccatattttctaaaattgcacttccctccccaaactcaaagggacacttctgagtccctttccccggcttatttcttgtcatagcacatggcattatttcgtaccctagatattttacttatttatcctggtttatttatttatctatttatttatttatttatttatttattttttagacgaagtctcgctctgtcacccaggctggagtgcagtggcatgatctcagctcactgcaatctctgccacccgggttcaagcgattctcctgcctcagcctcctgagtagctgggattacaggcacgcgccaccacgcccagctaatttttgtattttttgtagagacggggtttcaccatgttggtcaggctggtctggaactccagacctcgtgatctgcccgtctcggcctcccaaagtgctgggattacaggcatgagccaccgcgcctggccatttatcctgtattttatctattcctccaactaggctggcagtttcctgagggcagggatttgcctgttttgttcattactgttcattttgttcattgctcctgggatactgctaggtagcacatagtgggggctcaaaaacttacttgtatgaatgaatgacagcagttcctgtttaccagtgactgccatgcaccaagtccaatgccttagagcagaggctcactgaatattcaaaaatatccccttagggcaggcactgtttgtgtgtgtgtgtgtgtgtgtgtgtgtgtgtgtgtgtgtgtgtggttggtgttttatttttatctttttgaggcagagtcttgctctgtcacccaggctggagcgcagtgacaccatctcagctcactgcaacctctgcctcccaggttcaagcaatcctcctggctcagcctcccaagtagctgggatacaggcatgcaccacaatgcctggctattgaggcactgttattataccattttatatttatttatttattttttgagatggagtctcactctgtcaccctggctagagtgcagtggctccatcttggctcactgcaacctccacctccagggttcaagcaattctcctgtttcagtcttcagagtagatgggactacaggcacacatcaccacgcctagctaagttttgtatttttagtagagacaggattttaccatattggtcaggttggtctcgaactcctgatctcaggtgatccacctgctttggcctcccaaagtgttgggattacaggcatgagccactgtgcccagcctatttatttatttattttgagacagagtcttgctctgtcacccagactggagggcagtggcacaatcttggctcactgcaacctccacctcccaggttcaagcgatcctcccacctcagcctcccgagtagctggaattacaggtgttcgctaccacgcccaactaatttttgtatagacggggtttcactatgttggccaggctggtctcaatctcctggcctcaagtgatccgcccacctcccaaagtgctgggattacaggcgtgagccaccgcacccagccatatttcattttaacagatggaaaaacagagacccagaaataagagacctgctcataaccatgtgaaaaggaaatgtcacagctggaattggaatccaggcccgattcggaagtctgtgcccacaaccatcctcctactgtcctttccctggccccagggccccaccctcacccaccttacctagggacttgggcctctcactggcatagatgccccggggctcagagggacccaggcgaccataggagctggatccagagaagccactgtccccacagaaggttgagggtggtgaatctggacctcctgtagagctgggatcttcatagaagcctaaatttccaggagaagcagagagacttcagggggtttgggtgggaaaaccagagctggggaaaggaggagatggcgtggggagagacacagggggcctcagaaatagggatacggggaacatggaggcgtcccaggcaaaccctacccctccatccatgctcacccgagctacgcccgctctcctgttccaggcccccagactccaggctcaggtctcccagctgctgtcccaggtcccagacgagaccaggcagggcctcctgaaggcatagggagagaaggatggtcagaaggcccccagtcctctgccgactggtcccctattccacgagctcatgggcagagtttcactttgacaatgaggctctcgcttcaaaggataaaagcagtacctcagtcccaggaccccctcaagatctgtgtcccttcatccccattagaaagtccttctgacgttccaactccagtccttcatgctgcagccccatctcattccctcttaggtgtgatgaggcctcagaaaacccccatctcttgccctgtctttatcagttgctacccccaatctgtgctcagagcccctcaaccctgattagaatgtccctctttgagtctaacttcaggattgctgtaaggacagtttactgctaaaaggtggtgtccaggacccccagatcccttagtcataggtctgccttcttctccaagtttttctttttttatttttatttatttatttatttatttatttatttatttattttgagatagggtctcactctgtcgcctaggctggagggcagtggcgtgatcccagctcactgcagcctctacctcccgggatcaggcaattcacccacctcagcctcctgagtagctgggattacaggcgcccgccaccacgcccagataatttttgtgttttcagtagaggcagggtttcaccatgttgcccaggctgatcttgaactcctgacctcaggtgatccacctgcctcagcctcccaaagtgccgggattacaggcatgagccactgcgcccagcctctccccgtctttgaccttctttctcagatacgcccattgccccttatcaccaagagaaggtccttttgtgagtcttccttaagtccttcctgctgcagattgcctctttcccccatatgggtaaaataggctgaccacgactcataaacgtctttgctctcccttcagaaagaacctcccaagcctcctagacagtcctgtgagtctagccttactggtactgcagcagccatcccagcacgttcctttgccctagagaccacatcctccttctgcctttggtccactcccaccaggaagctccagtgagtctacctttcctcatcgccatgagaaatttcggggagtcaggccgggcgcagtggctcacgcctgtaatcccagcattttgggaggccgaggcgggcggatcacatgaggtcaggagttggaaccagcctggccaatatggtgaaaccttgtctcccttaaaaatacaaaaactagcggggcgtggtggtttgcgcctgtagtcccagctactagagaggctgaggcgggaggattgcttgagcccaggaggcagaggttgcagtgagccgagatcacaccattgcactccagcctaagcaacacagcaagactgacaaaaaaaaaaaaaaaggaaaaaagaaaaagaaatttccatgagtctaccctggatccttcttgctgcaggaaaagagcacttctcacggatggggtctccaagacattaggacttaatctcattttagaaaagagagggtcagagccagaaaaagtctcacatgggtctgagtgaggccgggtagcagcaggcagcctcgggctgacggttgaccctcagacaaaagcggcttgtctggaccgcaggagggagggaagtggggaggagggtttgggagggcaggcacccaaccctgcctatttagggcagaaagactggccggctccccggcagccacaacccccccgccccatcccagtctctccagggcccagcctctcccatccccctagaacagaagcccccatccgggcctgtttatttgaggaaggtcaacaaatccttccactctgggctcctgccctgggtatattgagatgctcacagtgaagtcatctttgagcggaactcaaaaaagcagctgaattgtgcagcatcaggaagtaactaaaaaaaaatctctcggacctaccatgtaccccatgtcacgtccgtcacaaatcactggcatgctcactcccctctagccacgcctggccttgccaccgtccctcgaacataccatgtatgcgcctacctcgggagaatgtttcccccacataccttccttgcttcattcagatctttggtgatctcttctctgacacctttccaaaatagctcccctgtcattgtgtaccccgttgccctgcttttcgggttttttctacatatcagtaatgacctcttgatttaaaattatacatcaggccaggctcggtggctcacgcctgtaatcccagcaccttgggaggccaaggcagggaggatcacttgaggtcaggagttcaagatcagcctggccaacatggtgaaaccccgtctctactagaaatacaaaaaatagccaggtgtggtggtgtgtgcctgtaatcccagctacccaagaggctgaagcaggagaattgcttgaaccagggaggcggaggttgcagtgagccgagatcacgccactgcactccagcctgggcgacagtaagatttcatctccaaaaacaactaaaataaaataaaagtatacatcaaggtatcatttgtttgttgaatctctcactagaatgtcagccctaggaacgcagagatttgtctgtttagctcacaggtgcacccccacccagtgcctagaacagtgcctggcacaaagtgggtgctcaggaaatatttaatgggctgggtgtggtggcttatgcctatcatcccagcactctggaagtgccaaggcgggaggatcgctggaggccgagagttcaagaccagcctaggcgacatagtgagacccagtctctctctctctctctctctctctatatatatatatatatatatacacaaacacacatatatatatacacacatatatatacacatatatacactatatatacacacatgtatatacacatatatgtatatatatgaaatttatttatttatttatttatttatttatttatttttgagatggaatctagctctaccgctcaggctggagtgcagtggtgcagcctccacctcccaggttcaagtgattttttttttttgcctcagcctcccaagcaggtgggatgacaagcatgtcccaccacacttggctaatttttgtgtttttagtagagacagggtttcatcatgttggccaggttggtctcgaactcctgactacaagtcatccgcccacctcagcctcccaaagtgctgggattgcatgcgtgagccactgtgcctggtcttttttattttatttttgagacaaggtctcactgtctcaccaggctggactgcagtggcacgatcacggctcactgcagccttcacctcctgggctcaggtgatcctaccacctcagcctcccaagtagctgggactacaggcacatgccaccacacccccgctaatctttgtatttttttgtagagacagggtctccctgtgttgcataggcttgtctcgaactcctgggcttgagcagtcctcccgcctcggtctcttaaagtgctgggattgcaggcatgagccattgcacccagctgtctattttttaaaaagaaatattagatgaaagaatgaatgtatacaatggaatactatacagctgttaaaacggaatgagtcaaatttctatatagaatcattaccaagatatagcattgagcagaaacagaaaagggcagaatatatatagtatgagtgactcagaattacctggagggcttgtgaaagcccaaatgactgagtcccattcccagagcttttgattacagcctgcagtcacgcccaagtagttgtatggctaacaagttccatgtcatgtggtgctgctggctaggaggccacactttgactggcatagtctctgggacctcacccaagaaactagaatttgtaaaaagcaaagctttgacaaaagctctacgttttttggtatgtaaacagtttctgttaggagatatgttggaagaggtctgggaggtgacactaaggtgacaatgatggtgacctcaggggataggttggatttaggggatccagggaggaatgaggggactggatggtggaaggaagtgtttaaggaggcgtgacttggcatcacattaagctctgctgctccccagctgtgtgaccttgggtgggtgactttacctctctgggcttcagtttccttatctataactgggcatcataggacaccatctcctggaggttattgtgaggattaaatgagtttcctttttttttttcttttttttttttgagacggagtcttgctctggcgcccaggctggagtgcagtggcacaatctcggctcactgcaagctccgcctcccgggttcacgccattctcctgcctcagcctnnnnnnnnnnnnnnnnnnnntgatctgcctgcctcggcctcccaaatgctggaattacaggcgtgagccaccgcgcccggccaatgagtttcttttgacacataataaatgccagtttgtatgattacaggaaagctatgaatttcttataaggaaaatagaaaatgtttccattgtttaattaaaaataaatgtaggtgtcgggcgcagtggctcacgcctgtaatcccaacaactttgggagaccgaggcgggaggatcacttgaggccaggaattcaagaccagcctggccaacatggtgaaagcccatctctactaaaaatacaaaaattagccaggggtgatggtgcatgcctgtaattccagctactcgggaggctgaggcaggagaattgcttgaatccaggaggtggaggttgcagtgagccgagaatcacttgaacctaggaggtggaggttgcagtgagcagagattgtgccattgcactctggcctgggtgacagagcaagattctgtctcaatgaataaataaataaaggccaggtacagtagctcacacctgcaatcctagtgctttgagaggctgagacagaaggattgcttgagcccaggagttggagaccagcctgaacaacatagcaagacctcatatctttaaaaaaaaaaaaaaaaattagccaaatgtggcggtgtgcacctgtagtcctagcttcttgggaggctgaggcaggaggattgcttgaggccaagttagaggctgcagtgagctatgatcgtgccactgcacttcagcctgagagactttgtctccaaaaataaatgaataaataaatatatcatttaaaaatacataaataaacgtgaaaggatagactttttggtaagttctgccaagtctaattccggttcttccattacaaggaagagcagaaattagggagacagacaggagatgcctcctcctctccagcacctagacgccccccaaaaatattccaagtctacacccctctatttgcaagtctggcctcattccttccagttgcaaaaggatgaatctttaaaagattagaaagtccttggcctgagtctggctctctgcctcctcacggtgcccctcatccttcctctgcaggcttaataagagtgtggttaggacccctggagacccctttgcccaaacttcccttaccttgtttctcccctcacgtgcccctcgttggtatccagtgcccatttatctctattaggaagtcattctgcaagtctaacttaagttattcttgatgaaaggaacctttttccttcttgagagcaagcaggacccagggagcccctgccctcacccaggattcctgcctctcttctctgcaacacccctgatctttacctggtatccccatcattcctattagaaagtaatcaagtctggcttcagtctttcttgccttgaaggaagtgtattcctggcaggggctgggggtggggggataagtcataagacaagggttgggggatcagaagaagccctaatccactcttcagagggacccaggaacccccagcactagagaagtttatatttagcgcttctctgctcctcctcctccccccgcctgccaccgcctcctccctgatgctgggacaagctttgcctagagactggggggtggggggacaggcctctccactatcagctcgtgccgggaggacagagggctgagggggaggaggggacagagggaccgaggagagggagactgaagggcagagatggggaaggtgaagggtgaaaaggggagagaccgagggcagagggggagaggacacagctacccacagctaccccaacctcatgcctcgcattctccttgtcaggatggaaggcgccttccaagccgagccagcttggggtggggggagctagcgaaggcccccacaatccgtctctaactttgggagggggtggggcctcccacagctgtttctgtttccagaaaagaatgtgcaggggggtcccactcctgagagggggaggggccgggcgtgcagccccgggagcctggcttcagtcttcctccccactccccatctggggagggggcggtcgaggtcagcggcggggagagccccctccactgccacctcggctcaggtttcccgaaacgggaagctctggccacacacaggcttggggatggggatctgccgtggagccagggtgtgcgggctggggggaggggaagacagactgagcctgggacgtcgggcaagaagaagagagcgaggtgcagacaggcaggaagggaaggccaaggagacagatgcagagggacacagagatcacagagacagagagacaggatgaagaaagagaagcagacacagaaagtcacagggatgtggcaggacggagagagtgacagaacccaggacgagatcgggagactcaaggaatgacatagaaaggggagaggcatggggcgtcctcaagtcattccggagacctctgcccatcttccaccatgagaacacccagagtccagaagtctcccccaggcgctgcctcgacctgcctccccttgggtcaaggagagctggggccaggtaggaagcaggggaagtgtcaccaaagggtcaagatcccagtggggggtcctcagggactgtgagcttcctctcagcagtggtccctccctctggaggccctgagattcccctcctcccaccccgccccctccagagatctccaagcacaccaggacttagggaagatggagccctggtggcggggcccagagaagggcatgtttggagcctggctgtgtcaccttgggtgagtcgcttgctctctctgagcctcaatttgtttctctgttaaatggggactatcaccccgtttcccaagccgcaagaagacaacgcctgcaaagtacccggtctcgggtttgacacatacttggcgcccacaaggattttctttggggaaggggtgtaagagacagggcctgtgtttctcacgaggccccagtgggggcgatgcagttccccctcccccgatttgggggcggggaggccaggtccggcccgccgccggaactccggggtcgccagccccaccccctgtcctttctcactccctgcctacccgggtccccaacccccgcccggtgtctgagcatccaaccgagacagacagacacagacgggggtggagggacggacggacaggcagccccttaccagctgctcctccagggccgctgcggcccggcgcgccgccgccgcatcttcatcctcatcggcgtcctcctcgtcctcggcctcggcgccccccattccgggctgggccagccgcagcgcctgctgcacgcggtactcctgcctctcccggagccaatgtaactcgcagagcccggccaggctaccctccagccagccccgcagccggccccgctcagggctcaccgggaacgagaaggcccggatcatggctgcggccccccgccccagcccggccgggccccgcggccacccctctcccggtcccacctccccgccccagcag

SEQ ID NO: 12472 - DNA, 9968 bp, Human
gacctgttggccccagtttgtgagctgacagccacagctgcacacttagcacctatgttcaggcagaaaagggccagccatttctgacccctttcatcaagaagcaaaacttttccataggccgggcacagtggctcacgcctgtaatcacagcactttgggaggctgaggcggctggatcacctaaggtcaagagttcaagaccagcctgacgaacatggtgaaaccccctctctactaaaaatacaaaaattagatgggcttggtggcgcccgcctgtaatcccagctactcaggcggctgaggcaagagaatcgcttgaacccaggaggcagaggttgcagtgagccgagatcaagtcattgtactccagccttggcgacaagagtgaaactccaactcaaagaaaaaaaaaaaaacaacttttccataaagctccagtagacatcccgcaggtcaaaacatcacatggctagcctatctgaagggagactaggaaatgagtatcttgctctaccagccattataacagagggtggcaaaggagaagtagtgttagacaattctacagatgattttctctgaatgggtcctgtccctgcacacgtaacccctgcaagaaacttccattcctcattgatgatttacccttcggagaacaccaagaaggcttctaggccatctctcccagagcagagaaagggagaaaacaggagggtggagggtaggggatgcagggacaggtggtccactgtttggcagtgcttcctgatcatggaggccattgaatttggtaaaatgtgggcatggaggagagtaaagaggtggagagaaactggtctgcaaaagaggataagaaaactgcatctagggggaccagagggcaaaatggaaaggcaaggctctcagaagtgagaaggaaacgagggctttgtaaattccaggaaaagtgggccacacagagagaagctcagtgggggggatgcccagggagggggaagctcaggaagggggaagctcagggaggaggaagctcagagaggaggaagctcagggaaagggaagcccagtgagggggaagcttagggagggagaagctcagggagggggaagctctgggaggaggaagctcagggaaagggaagcccagtgagggggaaggtcagcgagggggaagttcagggagagggatgctgagtgagggggatgccgagtgagggggaggccgagtgagggggatgcccagtgagggggatgcccagtggcaggccaagatgggtggatcacttgagttcaggagttccaagactggcctggccaacatggtgaaaccccgtctctactaaaaatacaaaaaagaaaaaagaagaagaagaagaaaaattagccaggcgtgttggcgcatgccagtagtcccagctactcagaaggctgaagtagaagaatcaaggtggaggttgtagtgagccaagatcgcaccactgcactccagcaaaaaacaaacaaacaaacaaacacaaaaaccctcacatgcctacccaacagccttcacacccacccaaatcctgactccctggagggagtaggaggcagtccacctcagccctctctggagccgctgtcaggttcctcggcgacctgccttccctaccacacccagctggccctggctgtccttgccccccatgtggaacatggaggtgaggctgggacaactgagcccgagttggggctggaaggtggatgtctcttttggggcagacggggcccctgtctcccctctccagcccaggtaacctgagcccagcattgtgtccatcctggaacagctgacaacgctgtggtcagacagctggtggggctgggccaggctggccgggctggctgggctggctggggtgggagtgtaggctgttatatgacacccagagcccatctctctctgccccagaccttggagctgttgtcccacccctgtcactgcagagagctgaggcaccatgcatgggggccaggggccgctgctcctcctgctgctgctggctgtctgcctgggtgggacacaaaggaatctcagcctggggagtcccagagctggggtccacagcctcaggggatggagggtctgaggggtattggggcctgccctggacccagttccctgagtccccacttcacacccccagggcctccccgctctttccacctccaagctcctgctaggctcacgcctgtctattgcaggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctggtaagccgcaggacggaggaggggtcagcgcaccacgccctgggacctgctggggatagcatggggtggctccagccaccaagaggttggagggccctaaatcggacaggctggggtctggaaaacccccatggttgtggggggagtactatcaagaggctgggggatgcttggccccattggtggcctgtggggactggcactgaagtcgggggctgagccctccatactacacccttgcacccccagaacgagcgagaggaagccctcaccaccaatgtctggatagagatggtaagaggccaccctgccaccctccttccatcaggggtcccaccccaccaccccaaggcctcctgagagttgcctgccccgttcctgcctcttctgtcctcttgggctggatgcccactcctagggctgtggtgcagcagagggcagaggcctagcaactgcccctccccctgcagcagtggtgcgactatcgcctgcgctgggatccgcgagactacgaaggcctgtgggtgctgagggtgccgtccaccatggtgtggcggccggatatcgtgctggagaacaagtgaggagggggtgcaggcaggggtgtgggggacaaaggacacagggtctgggcccagcagaacaaggcactctgggaaaagagaaagatgagcagagggtgcaaatcgggcacctgtggggctagggaagaactggatggagcaggtgccgagggcagggccctgggtatgccctctgaccccagggccagcagagcagaccctacgccaggctccatctcctctgggctgggccacctgggtgggctgctcccttccctgtaacatggggccgctgacgggtcctatagaagctggcgagagtcaacaagacaggcatgaaaagtgcatcactcgggggctggcacatggtgtgggcttaacacattagtcgctattatgactattattattattattattattatgattaaaacaagagagagtaagataagcagaaattaggaggtggtgcctgaggaagtctgtctggggcggggggtggcaggaggattgctggggggacctagtggtccgggtgggaaccagtcagggggtgacaggctggtagggactggtgtccccaggcccctatccacatggggcacaggggctggtctggggctggggtgtcgggggctgagcccacagcctcgtggcctggcctgttctgtgcatacagcgtggacggtgtcttcgaggtggccctctactgcaatgtgctcgtgtcccctgacggctgtatctactggctgccgcctgccatcttccgttccgcctgctctatctcagtcacctacttccccttcgactggcagaactgctcccttatcttccagtgaggccatttattggggaggattaagagagctgctctcagaggggcctgggcagtggtggggtaaggcctgggcaaggcttctggccttggctctggcagcacctagaggcctggctccatctcccctgggcctctgtgcccatctcaggctaagacacctgaaggtgcccaagctctccctgctaagcccgagtcccctcactcatcctttactgcctcagtttcctcacctgtgctccaaggggagacattcacgcctggggtgcgtgggtgagaaggcacacatgcacacaagatgcgtgtctgcgcacacacgaaaccactgcacactccaggcccacagggaggcagggctgtcctgtgagagaggggccctggcagggaatccagcggaagcatgtatgcaaccaagccacccctgggggtctctgggtctgtttcctcaaacctaagtgtggggaggagggcccgggggagggttctcctgtaccttagaggagcagtctttccatgagcaaacctggcagggagactcccctctgtagacatgggggtcctcctcgggtaggcatgtgttttctacattgccatcatcagcccctcctgccagacagcagtgggagagacaaatgcagagtgaccctgggcccatcagccaggtgagggccctgcagcctcctgggccttcaactccatcttcctgaccccaaagagccctaggtcctcctgctctccatatctcgccagtggggtttgatagagaactcagaagcgtggggctgcattttgttgaagaaaagctgcccacacttgtccccagaaggtcatccccatgcagtcgtggcaggtccacccgctcacatttagcctctttcctcggtgactcccaggtcccagacttacagcaccaatgagattgatctgcagctgagtcaggaagatggccagaccatcgagtggattttcattgaccctgaggccttcacaggtaacccccacccaagggctccccaggcagcctcatccagggctcctgctggacccagctgtggtcaaggctggaccaaggtcaaatccctcccatgtaactcaaaatgaaaactacagcaaaccataaaatatgctttttaaaacgtccaacaaagctctgactttcctcatgataatgtctccaattttagaagaggctcgagcatccaatctcccaccccacttctgtccctcaagggtgcctcccctgctggtgctccttagggcacatgctgcccttgcagctgggtcactcggctgcagggatctgcctagctcacgcttcttgtgcccactcctgcctgcctgcctgcccgcagagaatggggagtgggccatccagcaccgaccagccaagatgctcctggacccagcggcgccagcccaggaagcaggccaccagaaggtggtgttctacctgctcatccagcgcaagcccctcttctacgtcatcaacatcatcgccccctgtgtgctcatctcctctgtcgccatcctcatccacttccttcctgccaagggtacctggagcctatgggaaggagccatccagtagcacaggggacacctgggaggccggggtgggccctgcctggggaacagagtggcattacgacccaggacagaggcagcgggctacttctggggtaaggggttcctctgtgggtgggggaggtaggaacctgctctgagagcctctcggtcatggatagctgggggccagaagtgtaccgtcgccatcaacgtgctcctggcccagactgtcttcctcttccttgtggccaagaaggtgcctgaaacctcccaggcggtgccactcatcagcaagtaaggctggtcttcatgtccacccgcctatgccactctcccttcttgggagcatgatggcctcctgcattgccctcttgccctccatccaccccccccatcctcaattcaggaggcctgaggggggcagccactaagggtgggggtggcatcatggtatgggctgccagctcctgcccaccccaccctgacaggtacctgaccttcctcctggtggtgaccatcctcattgtcgtgaatgctgtggttgtgctcaatgtctccttgcggtctccacacacacactccatggcccgaggggtccgcaaggcaaggaccctccctgcccacttcaacatcccgctgcccactcccctacgcctccctctcgcacgccccggcagtactcacctgtggcattccacagcacacccatcctgggcgtatctggacgcatggaccaaaatcgattacagtaatacaggaatgaaattgcttcctaggtgcccgggatattacaaatgttaatgtatttcatcttcataaaacccatatcacctccaattacagatgaggacgttgaggcgcagagaggttaagtaacctgcccaaggaagtgcactacaaagtcgaaaaagcaggagtctgccagggcagtctgattccagtctgtgtgatctgtagcccacctgcagccttcagcttgggcccttgttgcacatgcagattcccaggcctgtcccaggcattctaggccagaatagcatgagggctgggggcaggaatctgtgtttataacaagtgccctggtgattctgatgtgcactgaagtttggggacccaggctcgtgtccagtatagaaagctttaccaaggccacgtcactgccccggtatgctgcctccatggtccctagcagcacaagcccttcacgccaacctctggcttctgctctgaagctcggcctgctgccctagtgaagccaccccctctctaggtgttcctgaggctcttgccccagctgctgaggatgcacgttcgcccgctggccccggcagctgtgcaggacacccagtcccggctacagaatggctcctcgggatggtcgatcacaactggggaggaggtggccctctgcctgcctcgcagtgaactcctcttccagcagtggcagcggcaagggctggtggcggcagcgctggagaagctaggtgagacacaccaggtgtgcctggggacagtcctcccctgggaccccagctggggagccaggcacagcagatgagtgctggagaagtgcccaggtcagggagagaggagctggggtccctaaggagaggccatcttctctgcctgtttctcctccattctactcccaaaccttaccctttctctttatcagagaaaggcccggagttagggctgagccagttctgtggcagcctgaagcaggctgccccagccatccaggcctgtgtggaagcctgcaacctcattgcctgtgcccggcaccagcagagtcactttgacaatgtaagctgagtcagggtggggtggaggtggagtgagtacctgggcttggaaccgtgatagagacaggatgagtggggttgccaagatagggcagtgggatggaaaaacatgaggccgggtgcagtgggtcacacctgtaatcccagtactttgggaggccgaggcgagtggatcacctgaggtcaggagtttgagaccagcctggccaacatggcaaaaccctatctctaccaaaaataccaaaaataccaaaaattagctgggtgtggtggcgggcacctgtattcccagctactcaggaggctgaggcaggagaattgcttgaacctgggaggcggaggttgcagtgagccaagccaagatcgcaccactgcactctggcctgggtgaaagagtgagacgtgagactccgtctcaaaaaaaaaaaaaaggaaagaaagaaagaaaaaggaacaggggcagggggggcacctcagggccagggggccatggaattagccaccagttgggacccggacataggtaagaagggccccaggaaatggagacatgggcctgctggaagcccaaggatgagaacaggacccagggaagacctggtgccgccgctggttatcccacacctgcctcccaccctcaggggaatgaggagtggttcctggtgggccgagtgctggaccgcgtctgcttcctggccatgctctcgctcttcatctgtggcacagctggcatcttcctcatggcccactacaaccgggtgccggccctgccattccctggagatccacgcccctacctgccctcaccagactgagccaaccaaccactgtggggcatgtgggagtcacacacgtgggtcacactgagtcttatcagccacgttctcctactgaggtcctaagtgtgctctttgggaagtgcccttcaggactgtgtgagccaaacagccctgagaaaagctggggaaacagtctgagctggagtccgagagtggttgggggtgggccgtggctagtgtcctgctgcagtcagcacacacgtgggattggctagctcatcctggcaccagccacccctccactcagtgcactcccctcacttaggcaaagcattattcattcccatcagtctgaagcccgaaggactgttttgtataataccttcggacttgggactggctccccttttacaagttctccctgaaagagggcagtcacaagaggtgtgaagagtagcagccgatgctctctccaaagcagggcagcagcccataccagctggcatctcccccccgtgccttctgggtacaataagcacccaattctcaacagccccagtggcctttccattcatgtgcatttttctgccactgaccacaagacgatttcctgagttttgtaatcctcttttttttttttttttttttagtttttgatgtgttgttgttgttttgtttagttttgagatagagcctcactcttgtcatgcaagttggagtggagtggcatgatcatggctcactgcagcctcaacctccagggctcaagcaatgctcctgcctcagcctcccaagtagctggcaccacaggcatgcaccactacacccagctacttttaaatttttagtagagatgaggttttgctatgttgcctaggttggtcttgaactcctgagctcaagtgatcctcccacttgagtcttgggattacaggcataagccactgtacctggcctcctttttaattaagagctcctcacagcagtatggataagcaagagtcattattccccatgttatataggcaaattgagcctagagtaagcgggactccacacaacagtggtggttaaacaaggtttgaagtccagaattcctgactctgacccaatctgacactctaagattctacggcctgaaaaacaggcccttcttcccaaaggatggttaagacaaggaagagctaggcaagaggaggtgtggagttaacagagagccactgagctcttcattccaggaggagactttgactggcctcccttgaccccactaatcaggtagtaaggcataagctggggtcttcctgggggagaggcaaggtcctgctctgagattacagccggcacacgagtttggctggtaaccaggggacacccttgggcaagtcacctatgctccctgaggctgttccctcatctgtaaataaggtgcaaaaaataatccattcctggccaggtgtggtggctcacacctgcaatcccagcaccttgggaggacaaggtgggtggactgcttgagctcaggagcccacgaacccaggaacccagcctgggcaacatggggacacccggcctctaccaaaaaatacaaaacttagctgggcgtggtgatgcatgcctgtagtcccagttactcgggaggctgaggtgggaggatcgcttgagcccaggaggtctaggctgcagtgagctgtgatcatgtgactgcactccagcctgatgacacagtaagaccctgtctcaaaaaaaataaaaaaattacaaaactgaaaaaagaaaagtgaaagtgccacataaaggcctgacgacaggatatgctggcaggaggggaccttggaaatatgccctccctccaagcacaggattgctgtctttgggattcaatcaccagcaagttcgtattatttactccagtgtgagtctgtgtctgtgcatgcacagtgtgtttgaagcaagagcagagtcagagctatagagaactagaggagttagggagagtgggggagaacttcaatcagggagggaatctgatgaca

SEQ ID NO: 12473 - DNA, 8870 bp, Human
tgctgctaagagcatccgcttgcaccttctgctcatccccagacaagctttgtcctgtgaccataatgaactcttcatgccgtttccaactttagcccatgttattcttcttgtctgaatatccacccttttctctgttctcaataataagttcaggcttttcgtcttctgagaagccctttctgacttccacaggctgaaccactggcttctgctcctctacataatacttcaattccagcattgatctcactctatcatgatcatgggtttagctgtctgtccctgccactgctgtgtgttcctcttgagggcaggaacatttgtttttcactttttaaaaaacctctgttgcccagtctggcattaggaagtgcccattaggttgttattgcttgttggcgcttgagctggggcttgaaggtttctataatgtgtagcagtgtatagaaaacaggcaggtcagaaaaggcttctgtgcatcacaccaacatggcacatgtatacatatgtaacaaatctgcatgttgtgcacatgtaccctaaaacttaaagtataataataataaaatttaaaaaaaaaaaagaagaggcttcctggaggagatgacagctgagctaagtcctggaggatgagaaggagtataaaataagataataggagaaaaaaggcagtaggaacagcatgggtaaaggtgatgaggcctgaaagaggcacgtggaaggaaagacaaatgcaggaagggggaatgggagggaatgctggggtacaggccaaagagggaggcatttggtgagtattctgcagagtctcctctgctgtgctgaggtgtggacaatgggaaaccatggacggactggagtaggcaaatgtcatattccctgttgcaactgtctgtttgcatgtcagccttctagaagccccttaaggtatcaactatgtttttgttttgtcatcattcaatcctaagtgcacagaattccgggcatattacaggttccccataaatgtttctttctttattaaaatgtatgaaaactctccagatttaaggaaggtcctcaatgtttcaaattctttttgttagatcattggtcctgtctacagctgtcacaaatttaaggactctggttatatttaatcttcacttttgaattttctgcttgaaaaatttgtattagaaaaaaaagtctatccttttatggacggctctaatctcttgaatcatttgggttggcttttctttggaccttcttcaactctgttttgtctctgttgagttaaggcttttaagaacacctgaattctttccttctgcaaaaccagaggcagcttcttttccgcctattttcagtttatttcttgtgattttagtttttttctcttaaccaaatgctaaatggatttaggagaaataaacttatttgtaaagctgtcaagggaccattagaaggatggtgcttcacagatagaatacagtttttattaatgatgcctagacaaatcctgccattagcccaagggctcagaaagttagcagcctagtagttttggagatgtcaatgaaatgaattggactggatggttaaggatgcccagaagattgaataaaattgggatttaggaggacccttgtactccaggaaattctccaagtctccacttagttatccagatcctcaaagtgaacatgaagcttcagtttcaaattgaatacattttccatccatggattggcttgttttgttcagttgagtgcttgaggttgtcttttcgacgtaacagctaaacccacggcttcctttctcgtaaaaccaaaacaaaaaggctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctgccaggacctggccctgcactctcctgttttttcttctcttcatccctgtcttctgcaaaggtgagtgagacttttggagcatgaagatggaggaggtgtttctcctacctgggtttcatttgtttcagcagtcaagggcagtgatttatagcaaagccagaagttaaaggtaaaactccaatctggcttggctggctctgtattccagggccagcagggagcagttgggcggcagcaaataaggcaaagagatagctcagaacagagcgccaggtatttagtaggggcttcatgaatgcatgtgagttggtttagtagagagacacaggcaatttcagacccttctatgagactggaagtgatttaagagggaaaggatagccatagtcctgaatacatttgagctgggtttcaggatgagctcacaagttcctttaaaaaaaattgacttaagcaaatcctgggaagagtttttttgctatacaattcaaggttttaaggtcctcggattcatatactttataaatgaattagccagcttgtttaaaatgtagggaaattgtgggaagaatgccttctttacttaattcaaggttttaaggttctcttaatcaattctactagctaattagccaattatttaaaaataaaagtttgaaattgccaaaaaaaaaagacaaggaaaaggaaagaaagaaagccaccagtctgtttggcatacaatacttaattgttgcctgacctacgtgtgggtttcagatgcagatcctcagttttcagctcttcagagactgacaccaggtttgttacacggcttaaaatgatgagtatatccattgaatctcaaccttatctctctctagaccttcttggctaagaaaccatgtagtttgtatgaagtaggtactcaaaagatatttgatgatttaatttttactggagaagaaatattcatatatgttttcttatttttacatgttttaaatatgtaaagattaaataaacactcttagaagtatttaaatttcctaaagtaaatttatctcaaccagtaacaggaccctcccaatactggaaagttgagtgtgaccgcatttagtggtgataagtgtgagcttgcttggggagagggcaggacatttaggatttcttaagcttagagtcaatacaataaagattattgagtgctcacttgggtgggctataatcactgctcacaggagttcatgaaccacaagtaaaagagtgaggagatatgattagctcacaaataactttaatacagagcagaaagtaatgaactactgcaatggagttatcacagtgctaaggatgctcagagggcatctctgataggcagaggtgagggttagggaaggaagctgtagtctagctagctagagctgctggaatagacatgacaatggctgctgccaaactgttttctcttctgaggacagatgtcccgtgcaagtggcttggtggaagggactagtgtctctaatatagggtgatttataagcaggaaagtgtgtcctagaaattcagaccagagtgatagattggaattggatcatgggggactcattgaatgttatttattgtatttgtttttgcgatcagtgttagtaaagtgtcaaagggattgagcagatgagtgacatcatgcaacacaagttttgagtttcacttgtcagactgactggagaggggcctggttagttacaggaaggtaatttggcatgcagccactatttttgagttgatgcaagcctctctgtatggagagctggtctcctttatcctgtgggaaaagagaacaaaggagcatgggagtgttcaagggaaggagaaataaagggcagagaggcagcggtggtgtcaggggaagcccacaggagttaacagcagggttgcctcaacctagagaggaagcgacctggtgccctcggctctgtggcttccttcatctaacaacatcttccactctacaacaatgccagggaaggcggaggctggtacagtgcatcaagacacagctactcctgggtgacagaggttcagggccagctcactaagtaggcagaagtttttgacatatactttgagagataaagcaagattctgtacctcaaccttcagaatttcccctaccactcattatagttccggagctatatagctcctatcattctatcataaccttagaataccagagaacatatcatctcatctaattatctcttactatatgtgaaaaaaatgaaggacatgggggaagtgtgacttgccccaaatcacatatttcatggtagagccaggtcttctgtttgtcatatcagtgttcttcctgccacaaccatcttgaagaatctatttctcagtaagaaaatatctttatggagagtagctggaaaacagttgagagatggaggggaggctgggggtgtggagaggggaaggggtaagtgatagattcgttgaaggggggagaaaaggccgtggggatgaagctagaaggcagaagggcttgcctgggcttggccatgaaggagcatgagttcactgagttccctttggcttttccatgctagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattggtgagcaaagccatttcactgagttgacacctgttgcattgcagtcttctatgcacaaaaacagttttgttccttaatttcaggaggtttacttttaggactgtggacattctctttaagagttctgtaccacatggtagccttgcttattgtgggtggcaaccttaatagcattctgactgtaaaataaaatgatttggggaagttggggctctcgctctggagtgctaaccatcatgacgtttgatctgtacttttgatatgatatgatgctcctggggaagtagtcccaaatagccaaacctattggtgggctacccatgcaatttaggggtggacctcaaggcctggaagctctaatgtccttttttcaccaatgttggggagtagagccctagagtttaaaactgtctcagggaggctctgctttgttttctgttgcagatccagaaccgtgcccagattctgacttcctcctctggatccttgcagcagttagttcggggttgtttttttatagctttctcctcacagctgtttctttgagcaaaatggtgagtgtggtgctgatggtgcaccatgtctgatggggatacctttagtggtatcaactggccaaaagatgatgttgagtttagtgttcttgagatgagatgaggcaataaatgaagaggaaggacagtggtaaagaacgcactagaaccgtaggcattggcatttgaggtttcagaatgactaatattttagatgaatttgtttgacattgaatgttcatgtgcttctgagcagggtttcaatttgagtaaccgttgcaataacatggggcagctgttttgctctttgtcttcatgacaactgtacttaagctaacagccctgaaacatgagattaggctgggcagaatgctgctagagaggaccacttggatggtctttattctccttctccatgtccctctccatcacctggaagtcacctctgggtgccactctggtgccttccttgtcgaagctgtagctgctcacatgacacctatccctattatccagtttgcttgactgggacgttttgccttccccttcagccaggaagtgaaagtcccagtttttatttatcacaggtgttggtattggtggtagaagaggtagaattatggaatcaggcctcctgtcaggatttctttttgacagtccctctcagacacctctgcctaaggccagctttgccattgcaaactctcccttctccctctctcccttcttctcttcctcttccttcttctcgctctttctctctctctctttctccctctctgtctcttatacacatacacaaagatatactctattccaacatcctctacccaacctgacagagatgtcctttgctgtaggttcagcagtggggatgagaaatacagctctcaaacaggataactaaagcttattatcttatcaagcttgttcccttgcagacaagattgatcaattatcataggctttctgggtgttctttctgaagctttctcaaagtctctttctcctatcttccattcaaggcaaatgattgccatttaacatcaaaatcacagttatttatctaaaataaattttaatagctgaatcaagaaaatctcctgaggtttataattctgtatgctgtgaacattcatttttaaccagctagggacccaatatgtgttgagttctattatggttagaagtggcttccgtattcctcagtagtaattactgtttctttttgtgtttgacagctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccggagttgtctttatcatccttgcatttgaatattgtgtttaaatttttgattgattcattcagtatctggtggagtctccaatattagaaatactggaaacaaactgaaaaaccacaaaaggacaaataatgcttcatgagtcagctttgcaccagccattacctgcaagtcattcttggaaggtatccatcctctttccttttgatttcttcaccactatttgggatataacgtgggttaacacagacatagcagtcctttataaatcaattggcatgctgtttaacacaggttcttcacctcccctttcttaccgcctgctttctcagctcaactatcacaggcattacagttgtcatggcaaccccaatgttggcaaccacgtcccttgcagccattttgatctgccttcctgaaatatagagcttttccctgtggcttccaaatgaactattttgcaaatgtggggaaaacacacacctgtggtcctatgttgctatcagctggcacacctaggcctggcacactaagccctctgtgattcttgcttaaccaatgtatagtctcagcacatttggtttccacttaaggtttcctatttttgacctccacatcctgttattgtcttttgcagtgattctcagtgtggtcagggaccacctgtaactgaatccactgggtcacttactaaaaacaccaattcacacttattcccagatgcgttgaatcagaatctttgagtggtggggccaggagtttgtatttccaaaaatcttcccagtgcttcttatacccatcaagttttgagaatcactgcttaggcaactctgtctgtgtctcttcctctgtctctcccccttgctcattctcttgcttgctcttgctctcttt

SEQ ID NO: 12474 - DNA, 142506 bp, Human
  misc_feature (1)...(142506): n = A,T,C or G
gactagacatatttttttttttaactggggcagaaaatgctttgggtttttcatgtttaatcacagaatttggagaaaactttaggactttatatggataacatcattattaactatgaaataataaaaagtggtgttctgattcccataatgacaatctaataatgtatgacaaggtgtattgaaagcagttcacattttcaatggttgactttagatagatatatataagatgttttcagagaaaatttatggtatttttttcaaaaattactcgacagtaatttaattagaaatgaaattgtgcttttaaatactatatttatgataccttttaggtacttactcatactcccaacagtcttttctattactacagcaaaatatttgagagatgctcccactttgcatttttctaaacaccagtgtcttatttgttcttcaaaagcaatatttaaaataaattaacttatgttaagtgaattagagtttgaggttaactggaaaggaatactgtgtagagtttcaaataataaaaccaaaaggagaatatattacttattggtaactttaaaatgccataaatactgcaatatcactgaaaacctcatgatatcatataaacattacctcttgcctattgcaagtattttcattttcattgtcatacagtcataatgcatctggttatttcataagcatatttatatacagcgtagaatcctgcatgttattaaacatgactattacattaactgcttcattagttcttccgtagtcttacatcctataaataatgcatacaaaagtgctatattctgtccgggcatggtggctcaacgcctgtaatcccagcattttgggaggccgaggcaggtggatcacttgaggtcaggagttaaagaccagcctggccaacatggcgaaaccccatctctactaaaaaatacaaaacaaacaaacaaaaatgccatattcaaggccaaatatatattcaaataccttttctacaacccaagtaggggattgcactgctcacaatatgatcaggttaatgaaagcatccttgtttttatagatgtaagatatttaagtacttctactctaaagatactttcaaacaaaacgcagcatgtaaaacaaataaagtggaaagataaaaaacaagaaagagaaagagattgttgtagcaatagcagaggacaaacaaacacctctggcagcatttgttagaactatgatgcagtgcttgggttatcatcaatatgggttcttggctattccattttgtaaaaatgtgtcattacagaaagagtagtggtcttgggaatatgaagactcaggttcaagcctagttctgtcatgacctagctgtatgatcttggtgaagtcacttatcctctatttttttatttttttttttatttttctttttttggtttctttgactgcaagagagaagtgtggtagagagtctttgggtgtacctcttcccctgcttctcacccagttctctaaattgtgagtccatgattgcttggccgtctccaaaaaagaagtactttgcttaaccttttaggctatatttttaagggtaatgatcatgtgtttacagtgagttgtaaaaatgctgtcattgccagtgttcagtcataaaatttggtgaaaatctatggttttaaatagcccaaacaatgggagttaacaaattgggcactaacattttaactttttctcgtgtttcaatatgtggaatttcttgcttagaagctggctctttccaagtatattgtttcatacaaacttggagtttcttgtttgattttctatttgacctttgattgctgctgttttcctactaagtgtttggccaaaagtgagagggccagtacagataaagcaaatagtgtttcatggggttaataattaataaactgaactgtcatcagaaaacccgcggatccagttcattataatgtcatgatgacaacattttgtgagagaagtctgtataaaaagcaattgctcttttgtttccaaaacaggtattacaagtggataaataatgtgcactgctctgagcccaaaggtacgcagtggacctggcctctctgatatgcatcagtatagccaatggctagccagcagacatgaagctaatttgctaccaatgaaagaagatctggccttgtggttaaccaatctattaggtaaggttataagatctcattttgtgagcaaagacaacagtttttgttttatttttcctcctgtagtgtccttcacctaagcatgtgatagcaccttggaaagaaagacttttattatttgacatttgcatctgggaaacctgaagcaggtggaaaatttaagtgaatttcccaatgtctgtcatattaactgtgcttagtaattccaatatgatgcactcaaatgtggaaatatgcagtcagattgcttattttatctatatgctggtctgatttatttttggcttttctttcatgcagctgaccaatttgacctactcttttgacattgtacacaggccacagtgtctgtaaaatctggcttctaaatctggatttctttgccctacttttacagcacaccttctaaaactgctgaatacccaaactcaggaacaaaatcatgtattctttttccaaatgagctgactagagtcatcccaccctgaactaaaatttttcttttccatttgcttttgtttttaaggtctagtctaacagtacttttgctgacctcatgctacctcctggtaaagattcctctccttttgttgctgttgtgctttcatattcccaggataaaatttcaactatgtgaaaaatagaatcacatgtttaaaggatcatcatatatagcagcactatttccactaagttttttatagagaataaatttaatttaaatgtgagaaaaaagatccctgtagactttataagatataagatttgagcatatcatttgcaggggagatttcatcaacactattttattatttaaatcatctgtcaaggtaagagttgttatcctcattttctagctaatgaaactaagagcttagtaaggtgcaccctgtccatctgaaattttagcaaggtttggcagaagtttagcacattttatcagggttttgcttgctctccatggctctggatttttgcatggcttttgtatttatttattttttagtccttatcctaggatttctttatcctatatttcttttttcttcatggtgtgcacacgattttggcaactctgtagtctaaccaaggctactgaatatgggtatgtaaattgtacccttcaccaacagataggtcagaaaaagaagaagacactccctagaaagacccttcacagtgctatggaagtgtctcccccagaaggaaggggctacacctttcagtaattgattcattcagagggccttttatctccatcaaggagagggagttatttaagcctaaacagatgaatttttctctctcttctgtctttttggggttcactaatgattgtcatattagtaattaattattaaatttgagctatcagttttcagatataggcaatcacaagtatggtagtggaaaataaaagttaagagcacaggcgctggaaatagactgcctgtgtttgaaccctacctctgccacttgctagcagtatgatcttgggcaaattacttacctctcttgtccctcattttcctcatctgtacagtggtaataatagtagtaactactttttagggctgctgtggcagtgaatgattaaaatatgtatagtactttgaacagtatctggccctagtaaacactatattgttgttattattattctacttatatagttcagtgaaacttaatttgattttgtgcataaatttattctttttttcaacaaacatttgagtgtgaagcagcataagcattggtaaaaaaaagtggactctggaataagaatgctttcaattcaaatcttggttttaccacttattatgtgatactgggcaagtgtcttattgcactgtgtcttggttatataatctgtaaaataaataccataataaaaccaaccttatggaattgttgggggtttgaatgagataattgcctttagaagaaggtatggcacataatcaagcagtaaataataactattgtcattattgtgttccagacagtcatctaggtactagaggatagtgattaagaataaacatagtacctattcttgcaaagcttagattagcaaaaaaacacagtaaataagcaattgaatatataatctattacttgttataaacactaaaagatacaagttgcaattaaaatgtaaactgaggtgggagtagggcaaaggatcagagggcttgggaaatcttctttatgggaacatatatttaaactgagaactgaagattaatagctagccagaccaaacatggggtaagagcctttgcgaggagggaagggcatgtgttgaggtaggaaggcgcttagtacattgcaagaaatgaagcaagtctagtttcaacagaaaagaaagaggaagagagtttcatgagacatgttcgggctagatcatgtattactttgaaaatcatattaaggagcttataatttacagtatgatctatgagaagccattgaaatgttctaaacagaggaagagtatgattaattagagtatagtctgcttatacaggtatgctataatgtcctatgacttgtcatcaagggcattttatttagtgagtgtggtcatttacaaggcagcttgatcagtgtgagcagcccaagacagcctcaaagaatagagagtcagtgtgtgtaatggaaagatccttggattaaaaatcaggagacctggctcctaactgggcgtcaggagacctggcctctggttctggctctgctacttggtaggaaacttgcccaaagtcactcagctatcttttctgggctcagtgtcctcaaccataaaatgaaggggttgaagtagatgatctctaatgtcttttccagatccaaaagtctgagttttaggaaatccatctcttgaaacccagtttggggtagttgagacagacattaatatatataaataaggagaagatttacataaatgaatgactttttttttcaaattaagacttttttaatggtcgtagttataacacaaatgcaattgatggtttatgaaattttctcagaaaaggaatcctaaaagaatctcaagatacagtaaagtttgacctttgaattgacttcagttcatacaaagtagatagataatagactttaagtcgttactctcatggcaacttgagaagtctactaataacttgagattattaaaaagtggtaaaacatttggaggtagaaaaatgcattgtgtgctagaatggtgataataaggagggtaagaataaatttatagttatgttagaagatatttttcttacacttagatacatttagtattcacatactttggaaatagaggaattaaagtgaattttaaaataatttattattggctgttttgtcacttcagaaatatttgtagatttttattatgcagctctttttcaagtcttgctttttatctacttgaaagagataaaacgtaaaaaacataaaaagatgataagtcttgaaagtagctttggaattgatatatctcctctgaattcctaggtgaggtagaaattacatattaaattaaagcttttaattaggatttgctgtgtgcaaatttgctgcttatttctagtatgcttgtctaaaatgtaatttttttccttttatgtttttcaaaaggagtattaatgatattctaaattcagatatttctgatcctacatataaactgtctattaaaaatatggttccttaaataatactccatttatattctgatattttgatggataaaaatgattcgatagagaagaaagtgattttgttagttcataaaccagtgttcatattcatataacatatgtatgtattatactgtcatttccaggaaatatacttacttaatcattaataataataaatatcattttaaattcctaggcataggattaaagcatcaactgcaaacttttatgctagctgaaatttatatattagaatataaaataccagctatcttgtaatgttaactagttaaaatgaataagtggttaatagtagctgggatttctctagggggtagcacacactgattaatgagaacattatcatgtaatattcactgactatttacatatccttggatatatctactgatcttatagaaaatactctttgcagtcctattaggtttttgaataatggctggcaccatggagcagttttgtgaccaacattcaaaaaagacagcaaaacagtcatgaagatcttatcgtctttctttacaaaaagtttctttagccattgttgcctattgtacattaaatatacacatttcatttttattttagatcttttgttatttttgctcatgaaccaaatattgccaatttgttatttaactatgcccttagggtatattagaacatgaaatgcatatataaataaatcttggggaaatttttaattgtcattatgagcaaacagcatgttattacattaacagtcctggattatggcagccacccattattcaaatacattaggcatattctactacttttataattattgatggactttttaagaatattattggcttggatttgattatatactaaaataagcgttctcaaattgtctatttcacatgtatttttaatttaaaatgatggcttacctttattttcaattaatatttgtctaatgctatataaattacatgagagcatattttaaagaaaggattatagttgttaaacatgaaataaaattgttcttaaagcttatagatctttaggatataggcatatgtgtttggataatgcagggactttgaataaatcatcagatatattaaaaatcaagttgtgctgaattgattttacttatatttagaaaatgcattgacagttgatgtcatggtaattttccctttctttgagctttgtacatgcatataaaagaaaatgcagttattttccacttaatatgagcaatatgtaacatttcatttttttcagttattcttgaaaaataacattttcagcattaaaaatttaagcacctatttattagggttgctgctgtcaaatacagctactatctaatgagtttggaacagcttgcttttcttttttcttgtggcccttttaccagaaacttattctgcagggttctcacattcttggtatggccaataaaaattccttaggacagatggtatcttctgttagttcaaaagtttacagaatcaccttcatgttcacaagttgacacctttcagagcagttatcctaattttgtatgtgacttgtgcagcagaaccagcttgatcttttttgatataaatgcagggtagacacttgaaaatcagtgtgaagcaggtgctggtctagggattttgcatataatgaactgtttcctatctcacaaacttgaaacttttgtctcaaaatactgaataattttggttaaagagagcatatgaaccactttgaattctccagttagaaaaatatatttgtactgagaggtacagtggggatgaaaatagaatttgatagtatctggatcatctttagggattaaaaatataccaactttcttcttcagtgaatcatgccaaataccagaacttgcctgaatgatattgttagccattctccagtctacaaggtggattgctattcatttttcagcaccacaatcttcaatcccaagctttttttttccaccaaagaggtttctgtagtgtttctacatagaaaaagacagcggcatgagggagaatgcactgtcatggaaaatagtcatttgtgtattcagcaaacatttaagtagtcaagcatagtggctaaaagcatgcactctgaacctaaattgccaaagagccaagttcctctaccctcgaattgggtgacctgaggcaagttacttaatctacacatctgtttcattatctgtaaaatggatataataatagcacccacttcacagttttcttgagaagactcaatacatgaatacatgtaaaatgcttagaacagtacttgacatataataagaactcaactgttaagtatgattattagaattctttagaaatttaatactgctaatttattgggaagaaaacattctttctcagcaacttggaagattaaaaggattattttttccaggtggccccagtctaaaacacttataggctgatatgtaaatctttataaaagttatggcaaacatatttctgggaggaatacactgatgtgtatgtgtatgcatgttgattatagttgcctggcaaaagatttcaggcaactgaaatcccaccattgagctataatgttttaacataaagcaactagccacaatatttaatcaaatttcctgattttgatctactggcaagttgtcattcttgactaaattaatcatgcgaagatcaaatatcgcaattataaatttaggaagtgaaactattacttctaaactaggacactctagattaatgttcaaaccaatgtctttacggaccagcaccggtcaggactttaacatgatttaattgtattcatttattgttctttctttccctacaaacaccaaccacaatgaaatgctgaggttagggaagaaatgattctctggtgctaaaatcacactgcttccagtacatgtagtctgatgtgttaaaccaggtgcacaatttaaactaaagaagatttgattctgtgtaacagagatatttacctttgtatgacttttacttgagaaagtgtaattatttctacacagcctgttcttaagaatttgccatggataaattcagctacttttatattatatttttttgaaaaaaatactgttgataatattaatattaatgtaataatgagataatatatcatccccatataaagattataactgatttcttacaatcatacattgattgtaatcataaagtatatatttaataatttttaatcattggaaggaaaatatgttacacatgaagttattttaaaaagtctcagacttgtgttttttcttcatttgaggtagtacatttcaactataaagtatgtaatagtctgtttttgccaaaaaaaactcacctttcagagctataaaatatacagaattgaaagctgacacctaatatatttttcattagatacagatgttcaatgtaaaattctttttacaagtattcatgaaaaacaggataactaaaaagatataatgtataaaaagtaaaaatcatactttttggtaaattgttaatggctttttaatgaaagccatttttttctttttatgatttatgtgttgttttaagtatattgtaactatcttataacttaaaattatgaatggaatcttcaaattgccatagaacttaatgaaataagaatacataaagatctattacaaacgtagaaaatcttgcaaataatttgtaaagaaataattcaacaatttagagtaaagtttatcttctttatcttaaaatttaaacttatttgaataacattataattaagagaattatttctaatatttactttctgtaattttgtgaaataattttcttattagaaaatgtggcctggcgtggtgccttatgcctgtaatcccagcactttgggaggctgaggcgggcagatcactaggtcaagagatcgagaccatccaggccaacatggtgaaaccctgtctctactaaaaataccaaaattaggtgggcatggtagtgcatgcctgtagtcccagctacttgggaggcagaggttgcagtgagccaagatcgtgccactgcactccagcctgacgagatcgcaccactgcactccagcctgtggttagtcactttctgctaaaaaaaaaaaaaaaaaggaaaaaaaaaaagagaaaatgcaggccaatatgatgaatacacaatacaaattctgttacactgggttttttgtattttgggcatgctactttcatttttgaactgagctgcacacaattttgaaataaaagttctgcacaggctacctgtgtggtgagtatttaaagctactgatgtttttccacctgcagaagtcattattttaattgggggctaaaatatgaactacttaaaaagtaatttgttttccttaagactgctcccaaaaatggaaaaaaaaaagtcattttaagcagatgtttcttgaaatccaaatatattagatattctgagtttaacttaaatggttcatctgtttttccagtcggattttatttatttatttatttatgagacagagtgtcactctatcacccaggctgcagtgcagtggtgtgatatctgctcactgcaacctccgcctcccaggttcaagccactctcctgccttatcctcccaagtagctgggattacaggcgtgtgccaccatacctggctaatttttgtatttttagtagaggcagggtttcaccaagttagccaagttggtcttgaactcctgatctcaggtgatctgcctgtcttggcctcccaaagtgctgggattacagtgagccactgcacccggccagattatatttattttaaggttcatggaattgaactacatgcctgtttcttaagataaaagataagccttgagcatcttggtataaaactttaaaataatttctttttttttttttgcttttgacttaactgtgtttcacaaaaataatattaatgttttctcaaagttttctagcagcttatttcttcatttgttcattcacatgctcactgagcacatttactaggtgcctagtatgtgaataacattatgcttacctctgtaggagatacaaaaaataataataaaaaagatatacctcaaggtttataacatactaaagaagacaaacactgcatacaaaacatactactaacaatagaatatgtttgatcagtgccagagtaagtgatattcatgagtatgacatacggaaaacagatcaatgtgtactggatgaatctccctctggaactctgattaaagatagaacttgtccaaggaggtagaaggtagggcattgaagttgggggccataccaggaacaaaagcatagcagcagaaatagaaaggtctgcaaggggaatctgtgaaggcagcctatagatagatcacggagtagggtgtagggatgttagatgggaaagatgggttagaggaatacagggagacctttggatattgggttaaagtgcttagttttcatattccaggtaaaggagaaaattagggattgtgcaataaaggtgtctggagaatgcctcagtgaggacggtgtttagccatcttaattttagcagtgagcatggtatgtattggagagagaagttgaggacacaaagaatagccattgttcttgttgctagaggtttaagtatcaccttatgaagatttttattaaggttatggcatgagaaatagaaggaagcttgaatctgtaggacttctgactaataatttacacaaaaaattaaggcaggaaaatggaatcttctgaaacttggattaataggaaacaaaaaaaggaaggggctttgagaaagatacgtttagaaagagtatataagaaagcagtgcagtggcacgatctcagctcactgcagcctctgcctcccaggcccaagccatcctctcacctcagcctcccgagtagctgggactgcatgcaggcatgcaccaccatgcctggctaatttttgtgtttttgtagaaatggggtttcaccatgttgccccatggctggtctctaactcacgagctcaagcaatccacctacctccggcttccaaaattctgggattacaggcctgagctactgtgccccgcctacctgtattattttaatcaggaaaaccatttcaatagaatctagagatatggttttatacattggccatgttattcaagttcccaatggtggtttttaaaaaatacatacatggttctattttaaattaaagaaaattgatctggctgggtgcaccctagattacatgactgtaatcccagtacttttggaggccgaggctggaggattgcttgagcccaaggagctcaaaactgcagtgagctatgatcctgccactgcactccagattgcgtgacagagtacaatcctgtagagagagagagagagcgagagacctacggcgttcttgtagtcagacatacacctaacaaaaaatacttgtcctgcattatgtcctgccttgtgggtcaaagtaattgaatgggccactggggatgagaatggaatgattaatggaggccaaattgtgaaatcactggtaaagctggttctttgagttttgttggttagttttcattccccttgattactaaatgatggaactctttcacccaggatatcattttgccaccttttatttgaaataaaactgttatgcagttagcactatgttatgaaaatattaaatgttgagattcttgcaaccaaaggaagatagaaaattccaaagaaatgactatttctggtaagctcctatcccagttatgtaactcagctagaatagcaattttagtgataaaactgtgtcaaatattttatttagtgtgaatctgacatttgattttccttttataatgcttctttttgttatttcagggaaggagattacagcagaaacttttatggagaagttggacaatggtgccttgctctgtcaacttgcagaaactatgcaggagaaattcaaggagagcatggatgctaacaagcccacaaaggtaaaagatcccaatgcaaaaatcactcttaggtggtagattacatttataattgcttataaattgtgtgtaattaaaaaatttattgtgaacggatgcatcaaggtctatactaacaacaaagtacagagagttctttttaattaggtaacatgttatttgcactctaattacataaattgcataatccttttggtgaatctaattaaataaaagcttatgagaaatgatggtattaaaagagtattgtgtataaactcaatgaatctgaaatattgattaaaaacttagcagagaaataattgtgtcattaggcaatgcacagatctagccaagaaagatttactgaatagatctttgttttcaaaaatattatggcagaatactagaacaaaatttctggactgtaatttttggtttattctaaataagtagtaccattgaactaagtaaatttggacaaattattttatttctaactgctcagatttcttttctccacattaattctaatattcttctctagtgattataaacacttgatgaaagtatagtgtttgactttttttgaagaaaacaagagagattgtacttaatttttaatagagaatgaaaagagatataaaaaatattaaaataatgttggccaggcatggtggctcatgcctgtaatcccagtactttgggaggctgaggcgggcagatcacttgaggtcaggagtttgagactagtctggccaacatggccaaaacccgtctctactaaaaaaaaaaaaaaaaaaaaaaaaaaatagcctggcatcatgacgcatgtctataatcccagctactcaggaggctgaggcgggagaatcgcttgaacccaggaagtaaaggttgcggtgagcagagatcacgccattgcactccagcctgggtgacagagtaggactctatctaaaaaaataataaaataaaaatgttgaagacaatttaagacaaaaagcaactgttaagccttttctgcaactctgacagaaaaaataaaaggggtgtatgtgtgtattaccactgaatttattttttaaatattttatattactccgtaaagtattgtataatatacaaaacctccctctatttttttatttcttaaaagcagctctgtgaaggtattaattaattcagtggctcccaaactttgctgcacattggaattacctgagcatcttttaaaaaaatgctgagagctgggctggatgtggtggctcgtgactgtaatctcagcactttgcgggggtcaaggcaggcagattgcttgagctcgggagtcgagatcaacctgggcaacatgacaaagcaccatctgtaagaaaaacacaaaaaagttagcagggaatggtggtgtgttcctgtagccccaggtatttgggaaactgaggcggcaggttcaattgagcccaggaggttgaggttgcagtgagccaagatcacaacactgcactccagcctagaagacggaatgagaccatttctcaaaagtaataataaaataaaataatactgagacctcgatcccatgcctgaacattctgatttaatcccatagggtgaaacctgggtactagaatttttaaaaagctccccaggtgattctaatgtgcagcaaagtttggtaaccattaatttcttttaattttctccttaattggatggttgaagactgtaagtaatttgtacaagattggctagtaagtgaccaagcaagaatttgacacagacaactttgcaagtttaatgctctctcatttttgttcattatgtcattatgggtagcccaggtgtgaggagactgtttatgaaaatgctttgtgtcaagcttaatgttaggacaccaatttttcttctgctctcatttccgtcgtgatgtaactggcctctacatcagctactgatgaaaaaatataatgccaataagaggacaacttgtatagaaggtttacagtaaagcaatgaacagagggaaataagctgtggtgcccagactcttgaaagcattaccttcacattacgaagttcctgaaacttgtattgcttattgttgaggatggagagccgaatgcctcagtgtaaagaatccttgaatcctccagagtagtaaagattaaccaactctattaaggctgttgtgcagttctggttttgctttgtttataagcctttgcttttttaaaacagaagcaaagattcccaaatagatttgtaattgtaagactcaatgtaagataaccctaaagcattagcctataggtcaaaggctttgacattaagtgcattttgcttgggttctagttttatttattaattggacgtgtctgagccgtactttccttatctgtgaaataggattaataattacatatgtatagcttccatagagcattgcacaaaatagggctcttgataaaatctctttttgataaaatctcttttccttacgtgaaagataagagacccttgtaagtattttcgattaactataagaaaataaatactttatagtctacggccataccaccctgaacatgcccagtctcgtctgatctcggaagctaagcggggtcgggcctggttaggacttggaagggagaaaataaatgctttataaatgtttgtatttagcatgagagctgctatgtgcaaatatgtatacatttgccccaatctccatgataatatggaatattgagaatatttattgatcaaaagttatgtaagtactttccttttaaacagccatttcaatattataatttttataataaaactataaaacaaaaagaaaagaatttttttcagttagtaaaactgcagcaagttattaaacttgaaatagttccgtgaacctgagcaaatttttaactgaatataaagctaaatttttttctgattgtgataaaggttttagtataaaaccttaaatgtgttacttgaacaagtggaggtttaaaaatacttattatcatctcaccaaaaagtcacatgcaactgtatgttcatagcagcactattcactactgcaaagacatgaaatcaacctagatactcatcaacggtggactggctaagaaaatatggtccctatataccatggaataccttgcagccataagaaaccaaaatcatgtcctttgcagaaacatgggggcagctgaaggccattatcttaagcaagttaatgcaggaacagaaccaaatggtctcacatataagtgggagctaaacactgagtacacatggacacaaacaggagaacaaaagacactggggcctacttgagcaggaagggcggcaagagggtgaaggtcaaaaaactacctattgggttctatgctcactatctgggtgatgaaaccatttatatacccaacctcaacaaggtgcaatttacccatgtaacaatcctgcacatgtcccctccgaacctaaaataaaagttaaaaaaaaataccgattatgacctcactttcactgctcaatacatcaaatttgatctgaggtaaaagttgacacagttgctcttgactgaattgccttctctgttcttggcagcatttatatattcacgactgactgccagtaatatgcagcttaaatcaataataacttgtgccttactgtatgaaaagtgcaaagatgactacattttattttttgccttttatagtaaaattttaaaagatgaaaggccagagggttagtatgtatatcttcatggctactattgttcataaatatacttctgttaaactcaagatttttcagtccattgttggtctagaaacaaaaaagacttatgagattgtaagcatgttgatgttgttaaatctaaatacaagtttaaacaataatggattcactacaacccaggtaattaggattacagtgaatatttcccatgggaaaaaatgaggctttcaaattgagtataaatagtctggaggttacaatattaagtctgattttacacgtgtgtacactcatgtgttcatgtatgtgtttgtagagaactatttctcattttggcattttggagttcagaaaaaatggtggcgaaaatggatgaattagtcaatacattctttgaattaatgaaactgtgcatagggagatgttgaaacagaattacttttaaaaaattgacaaacttgatcccatccaaagccatgccacaggaagctctctgtaatttttttctagcagctttaatcttatctcctcattttcatagcaatattttttactattcttggttgatagttaatttggagattttacagctgtgtaaacaaatttgaacgagtaagttatgcctggtatgtgtgaagtatgtctgtattaaggatgatttaaatgctcttaaatctttaataaatgttagttcgcatatttaatattttagatatttagatatttctaaatttaatatttagatataaatccatgactcttttatatccagctttggtttgataaaatactctgaatggaaataattctgtcctatgattctttcttcccagacatcaataggtcaatttaaaaatagcttctttacgtgtgtgagctctaagtagttaaccttagcctttgtgtagtgggccattttctaactctgcatgggagcaatgcagagacttcacagactagggcagtagatgggtggaagcatttgagaccagtgtgcagccatttaatgtgtaattttatttaattcatttatacatactataatattatgaattcactgtaattacaaatcttaatatttctggagttgaggatgtttaaaggcaaaaatataaatgaaatgaatctttcaatattgttttaggatgagaaaaccaaaccaaatgacaggtttaaggttaggttttatgtcttttgactctcagctacccgatcggaattggcatctctaatcaagacaggggaattgttacatttatgcgtgaactttcttttcccggtccaaatagtgttccacagtacaaaccccttcctattgtatatttgctctctttcccccacccccaccaatcacaagtttgctgatttgtgcaaaagactctctcaaccacggggcatcagcgtggggcaagacattcaaaaggtttaacctctctttttctactaactttcctttgcatttgtctcatttattttgagtctcttcttcagacatcagagtttctctgggtttagagcttcctctgacttcaaagagccctgggtggttagatcaagtttgaagcagatgaaggagggggcggggggaaaagaagttctgttacctagtagaatgctgcattatgctccaaggaaggaactgaatattaaccgtctaaatgtagaatccagtccttgttcaggagaaagaacatcctgcagatagaatgcctacaatacatttgcccatcaggagtacttggttccttgagctgcaagataacaatacctcaggatgttgttttgtgccatctgggaattaaataagacataaagattagaaattttcttctcagaaaaatcaatagcactttttgtttagagaacatctcatcaagatttaattctgagaaatccagatatttgtgtttattgctgatctctctgccagaacaagaaagtatggtagatgcaataaaaggttttgtatgaaaaagaaaataaaatctcagctgtgattaatctggagtcattcattgctggctatacagctaaatgattttatatcccttaaaatttattgttctaaattgcaaacataatgctagaattaaacagagaatatattatgatgagatgggaagaatataagtggcatgatgtagaaagaaataatttttttataggtgtgttgctgcctgagactaaaggaaaaagaaaagttagtggtaaagtccacttcctcaggatttgtaaaatataggtaaaatatatttaagctttaaatacactaatttttttatttactttgtaattgcttcctgaggttgaattatttctcagtataaaattaaatccccctgtcactattttttaagtctctgaccaaatagccaaattattcacctccaaatcagagacaatgaaatgtcttgcttaatgttttttgtttttttttccactgagagtttctgttctatactatcttccagagatatgcctaaatcgggcttcaatgccatagcaatacatgttggtaaatcatatagaataaaaagaatggtatgtaaaggagcttgacttttatttttcaaataaaactcatcacaggagacttgatatgggctacatttgcagatgggggtgggcgagcggaaagcagcaatgtgaaaaattgggcaagatagggagtgagtgatgtgcctatggaacttatctagatcttcatgtctaattgagcccatcccatacatggcacttgtacttgtaaacccagaaaatcggagacaagtctcagttaatttagaaagtttattttgccaagactgaggacgtgcgcccatgatacagcctcaggcagtcctgatgacatgtgcccaaggtggtaggggcacagcttagttttatacattttatggagacatgagacatccatcaatatatgtaagaagtacattggtttggtctggaaaggcaggacaacttgaggcaaaggcaggaagacacgaagtagggaggatgcttccaggtcactgacagatgagagagaaatagtcgcattcttttgagtttctgattagcctttccaaaggaagcagtcagaaatgcatttatctcagccatcagaggtataactttgaatagaatgggaggcacatttgtcctcagcactttccagcttgagttttccttttagcctagtgatttttggggacccaagatattttcctttcacatactcaatggtaaagtagtgctgggcacaataaaaaatatggcccagtggatcatatggcactaagttcatgataaacatttaatgtttcatgattactggttcccatggtagaaattcagtctccatcagacaacaagaacaagcgaggaacatttgtgtcgtgtcctttcctaaaagggcaatgttcctacctgacccctactactagatgctgaaactttgtttagttggcagaacccctttctgcattttcatgagatttattctctaccctccagaatgtgtgtattttatgaaaccgtctggtttccctactattcctgctttgcagtatcaaatctccaatatcaaatattgtaaaatagaagaggagcttgatgacctgtgatgttgaaatatccatggtccctgtaggttatgtcacagggctggagatggtgtataggatagtaagaattctgttgttactgtcaaacatatgcaaactgattctggaattttctacttataagaataaagaaaattccattctccaaaccaagagatgaatgttaagtaccaggatattgagtgataacacttcattgaaaagaccacatctgtaacatcgattctgattaaatatgttacttcattgtaatcttcccactgtttccaagtcatgtcaatctttttttactgattttcattgagatgtggtagaagtcacttttattttttgcaatgttcaggtcattaataacagcatgaatctctgactttttaaataggtgtgctttttttatttggtacttttaccacaaaagaacttattccatgtgtcaaggataaaaattatgacattttttgagaatatccatgcaaattgcacattcaggtaaaactataaaaataacatctaatgtttgcaaaagtgtactagttatagtgtaaagtaggtttaggtaaaaaatctaactgtcacctgattcctcacaaagcatttcccttttctgaatgcatagtaaacagatcaggtccctttggagattggaaggaagctttatataaagacttgagatcattactgccttcattcagtgagctctgggtctataatttggctctagtctgggaattgggcaatcagaaaatttgttgctctttttgttatacaaagaaacccaaatactgcatgttctcacttataagtggtatctaaatgatgagaacccatggacacatacaggggaacaacacacactggtgtctttcagagggtagcgggaaggaggagggagaggatcaggaaaaataactaatgggtactaggcttaatacctgggtgattaaataatctgcacaacaaaccctctgacacaagtttacctatataacaaacctgcacttgtacccctgaacttaaaataaaagttaaaaaaataagaatttagggaattgactttcaatttacttcccaaggccccatgattaataaaccataatcagatttcctgtgctttaggtcattctaggagatctgattggcctctccagattgtattctgtcccccatatccactttgcctctggaaattaagtgccaacgtgtgttcctgccacccggagaatttccattcacactaaaatgaggaagctcatttcaataacagctcctgagactttctgaagaataatgtcaccttaaaaatttttggagctttcttcatcaacttattcttcaccctttagtgaaaaatagagccacttgggtcccactgagtgacatagtgaaaagtatgcttatgtgaggaattaattacaggtcgaatagaatgtggaattttttcttgaagttctaattcctttatctatatcataccaagtgattcctggctttttgtgccatttagtgtgagctattgttgaatatatctttgtgttagcaaatctagcaaactttaatagggtcattttatgctagcccattgaatttgggacatcttattagtccagtacaagtaaattaattttgctgaatctaaaattacatcctgctctcctcagactaataccctcaaaatctattgcaaagacagcaacaaacaaacaaacaaaaaacttctgccataatatatttagtggcactcaacattttaaatgtatattgaggctttgtaactagttagccaggaattcctgagccttactatgggatgtatctaaattcatcctcagccaggctgcagtattttgacgcctggtagaggttgtcagcaatggcttaaaaaagtgtgggttcggctgggtgcggtggcttacccctgtattcccaatactttgggaggctgaggcgggtggatcacttgaggtcaggagtttgagaccagcctggccaacatggtaaaacgctgtctctaccaaaaataaaaaaaattagctgggtgtggtggcatgcacctgtaatcccagcacttgggaggctgaggcaggagaatcacttgaacctgggaggcggaggttgcagttagccaagatcacgccactgcactccagcctgggtgacagagtgagactccttctcaaaaagaaaaaaaaaagactctttattctgtggctagctgagatttaaggacagagccattgtttcagaactgtccaaattaattgatatacttttcttaacctggtccaggagcataccgggtgtagaggaatccaccatgtaccctccctgtttcctgggagggtatgcttgctattttcttacccaacctgctcattcttttcatgtctctgcctctcttcccaagataagaatgttaatcccttctcatctgagaccaggatctggcaaggggacaggattttagcaaaggacaggagccaatagcaaatgcaagtcatattattctgtaaattccatatatcacagctattcagtggaaaattcttccatattcaacagctcacaaatgaaagaaagttggtagatttctctaaatttgacaacagaatatttgtcaaacaaatttgaaataaagaaaaaatttcaaaatttgtaatattcaccaataatgagctgtgaggttgaaagtgattttcctgaattattagaaattgtgtcctgattaatcatgctaaaagaaagattccaatacgtttctattcttcctatgcaaatatttctaaaacgttgtttttttaaattttattattattatactttaagttttagggtacatgtgcacattgtgcaggttagttacatatatatacatgtacaatgctggtgtgctgcacccattaactcgtcatgtagcattaggtatatctcctaatgctatccctcccccctccccccactccacaacagtccccagagtgtgatgttccccttcctgtgtccatgtgttctcattgttcagttcccacctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttggattagttccaagtctttgctattgtgaatagtgccacgataaacatacgtgtgcatgtgtctttatagcagcatgatttatagtcctttgggtatatacccagtaatgagatggctgggtcaaatggtatttctagttctagatccctgaggaatcgccacactgacttccacaatggttgaactagtttacagtcccaccaacagtgtaaaagtgttcctacttctccatatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggagttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaaggtttaagtctttaatccatcttgaaataatttttgtgtaaggtgtaaggaaggaatccaattttagctttctacatatggctagccagttttcccagcaccatttattaaatagggaatcctttccccattgcttgtttttctcaggtttgtcaaagatcagatagttgtagataagtggcattatttctgagggctctgttctgttccattggtctatatactactgttttggtaccagtaccatgctgttttggttactgtagccttgtagtataatttgaagtcaggtagcatgattcctccagctttgttcttttggcttaggattgacttggtgatgcgggctcttttttggttgcatatgaactttaaagtagttttttccaattctgtgaagaaagtcattggtagcttgatggggatggcattgaatctataaattaccttgggcagtatgaccattttcacgatactgattgttcctacccatgagcatggaatgttcttccatttgtttgtatcctcttttatttcattgagcagtggtttgtagttctccttgaagaggtccttcacgtcccttgtaatttggattcctaggtattttattctctttgaagcaattgtgaatgggaattcactgatgatttggctctctgtttgtctgttgttggtgtataagaatgcttgtgatttttgtacattgatttcggtatcctgagactttgctgaagttgtttatcagcttaaggagattttgggctgagacaatggggttttctagatatacaatcatgtcatctgcaaacagggacaatttgacttcctcttttcctaattgaataccctttatttccttctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgaataggagtggtgagagagggcatcccctgtcttgtgccagttttcaaagggaatgcttccagtttttgcccattcagtatgatattggctatggagctgggtttttgaaaggatcagcaaaattgatagaccgctagcaagactaataaagaagaaaagagagaagaatcaaatagatgcaataaaaaatgataaaggggatatcaccacccatcccacagaaatacaaactaccatcagagaatactacaaacacctctatgcaaataaactagaaaatcttgaagaaatggataaattcctcaacacagtcaccctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggaactggtacctttccttctgaaactattccaatcaatagaaaaagagggaatcctccctaactcattttatgaggccagcatcatcctgacaccaaagccgggcagagacacaaccaaaaaagagaattttagaccaatatccttgatgaatattgatgcaaaaatcctcaataaaatactggcaaaccgaatccagcagcacatccaaaagcttatccaccatgatcaagtgggcttcatccctgggatgcaaggctggttcaatatatgcaaatcaataaatgtaatccagcatataaacagaaccaaagataaaacattgttttaagaagaggtgaccaaacagtataaaacaagaatatttaagaaaatgtgaagtagcattcattcatgcagttaattaataagaaatattatgttgtttttctgtgctttgtgatggttctagtgtttaccatcttttaaaagttattaatttcttgtgctttattttattaggctaaaatgtttaattccatatcttattttgtgtttataattctgttcttttctataaggaaagcacccaaataaaataagctcaagcccccacaaaatctgtttcttttctagcccctgtgtaaatagcataggctgctagttttctattccacagttgtgttccattatcggtctcaacaccaattccaaatataacatatttttctgagtcctgacaacttaactccatactctggtaccaaagaaatttttggaaaagatgaatttattgagataaatgtacagaatgaagggagaattctaaatgaggggagtaatgatctcaagtctttactgtaccccttccttcaaatctacaaagggacccaaactctttactatgcattcagggaagagaaatgccttgtggggaatcaggtgacaggtagattttttaaatctgaaattattggaaaagatgaatttactgccaaaagaatgtattggaaagatatgggggtactgcttagagaaaaaagacatgtgaaggaaagtgaaactggatttggagggcttaagaattagactatttgcaaggattatgcagcatagatacacagtcatttcacagtaccactgttagggtgaataatttcagacatttttagagagggcagctgaacagaaatggttaatagtgtatactcagtagtcatactacctgggttgaaatcataactcctcctctgtgcgttagttttctcatttgtaaaatgtagtaataattgtagctacctcatttggttattatggggactaagtaagttagtatacacaagcactgagtggtacctagtacatatgggtgctcattaacatttagctgttaactttattgtatcattcctctcaagattaacatttcagcaagaaagagcctgatggacagccaactttctgactagatcatggcttcataccttgattgctcagtctgaataaaatgaaagaaccatagtgtccctatggaaaattaatatgctcttacctaagaagggaaaaggatactggaagtgtagagatgcccttgcagtctctacactctgtatctgtagatctggcctctttcttacggtttgtccatctgcatgttaacccctctttcttgtaccatactgttgtacttagttgtttcctagtctttatccctttgctagactctaagatccttgagtacatagtttatgttctattcatctgtgagtctaacataatacctagcatatagatgctcagtagacatggtgttggatgaatgaataaataaatgccccaagatggatatttacctttagatccagaatactgttatccgtgggttttagccatctttgctttttaatcctgaagactttattctcattaagtttgaaattcccccctctgcctgtttgcttagctcaaaagcctttgatgtgacaaagcatgaggagcaaatctgacttttccagtcgtaaagacggaagatttgagaattttagaatggtctagggaaacaataaggatctgaggacgttaaaagcactgacaagagattggctgaagtaacagaccatggggatttaaactagttaagaaaaagtggatcttggaggaggataatcatttagttaattgtaaatgttattatatagtgacatgatgtattatttgagttcagagcattatataaaggtaaaaattatgataaaaatgagcatatttatatccaatggttcattcagtttgaggatttcttttcaaggcctgattatactgcttgcagtataaaataagcatcagatgagcgatagctaatggtttcatgaatttgctcaccattgaaaattaggaagaaaaattaaattgtagggcttttaggtaacaggttctcaaaagatgtttttgacctgaaacgaagtgctgtgtctttcgattactagaggagacataaagatgaaatcattttttttcttttgcatctttttcccaataactgcctcttttgctcaataaaatagttggtgagggaaatgagaatattagaacctttattttctatcagagcagctaattgctgtctgccaaagcactatttaacaaccaatgtaaaaatacaatttctataaaactgcaggagagaatcagaattctagtacttaggaaaactgcacagtaaatactgctatcgactttctgaaaatgtgttattaaacaataggtaactcaaaaggagttaaatatgatcatggagtatagcaagttcattttatcaatcttttataatattgaatattaccaacaacaaatattttataataattgagtcctacttatatatgttactttaaaattggatagtttgagtatatgttagcaacaagagatgatgttattggctgtgggtgttaatgtgcatttgtcttcatggtgagaaagatagttgtgatttaaagggtgtgatttaaatgaagatagaatactctcaaggagtttactctctattaggaagaaatgtgttgtatgtggtaatatatagcttgtgagatcaagcttaaaaaaaaaatagttcggaaagggctgggcgcggtggctcacgcctgtaatcccagcactttgggaggccaaggcaggtggaccacctgagttcaggagttcaagaccaccctggccaatatagtgaaaccccgtctctactaaaaatacaaaaattagccgggtgtggtggcaggtgcctgtagtcccagctactctggacgctgagggaggaaaatcacttgaacctggaaggtggaggttgcagtgagccgagatcacaccactgcactccagcctggacaatggagtgagactctgtctcaaacaaacaaacaaataaaagttggggaaaaaaattagttgcaagaagtcacaggtcttaagtaagaaaaaggcattattttattatggggctgaagttaaaatagaagttaaaagatataacagtatatactgaaatgttttcacacttttaagattattttaaatgtgtcctatcttcttaaatcaaaaatgatactaattaataataaaaatacctgccatataatataaatacaggagctacacatgcattgcaatgtctaaagtgcttatgtatggacctattacaatgctttttaagtgggtgtaaactgattagtttgaccattctgactacccatacattatcattttctttgctctttttattatcacaggtcaaaatccaaattattctcatttccttgtttcagtgagtcatagaaggaattgtctctcacacttttgatatataactcttgaggtgggtggcagaagaagccagtgtctaagatattgtgctgagattctttaggaataatacttaacagaggatgaagtttgttgaactgtctgtagatggaattgcaaattgaacaaaattactttatggccttatgtatttaaaaatctttggacaagagtataggccctagcaaaatggaaaatgaccatatgcaaagcatggaaaacctttgtaaaaagcactcatgtttgagatagcttactttttatgccctaataagcaaatggcaaaagtaaaaattattttagaattccccttaaattataagagggtaaaataaaatctatcattttcatgtttgtctcctttcttatttgttgtaggccagtagctgctagccttctcatatgagcaaaaagccatttccccaatcttaatgttctctacatattggggtatgctcctaataaggactttgtgctgagatgtggggaagagtatgtctagccctattctgtactctgctgagaatctacatatttcagagcaaggagaagagatagggaaagaccaggtggcagattctaacctagaaatttgtctagattccagaggctactacatttatttgaatctgcttataaagagccccttcaaaattgttctttttgtctgtgagctcaaaccataatatattgtttggtagtgtaaataacagttgcattaaaggcatatgaaacatgtgactgaaaataaatatgttaaattgaaactccaaaaagtataaaaagaagaagagcaaattctggatagaaaaagggaggttcacacacacatgcacacatacacatttttcatctacgtgatttcctagcaccagcgcagtgttgtcccttgagcatgaaagtaaacctgactgaatttttccatgatgacatcatcccttctacttacagtctcacatcctgcatttaacaacatgcaggcacatcagcaagacaagattgtaaaaggagtctaactggggaactgttttcatgatatttgatagcactaattgcggtcaatgctttcaaagcactgtggatgtagaatattttgtcagaaaaagtcactctcaccctatggaaaatggagaattaattattttaaaatgagctgttactaaatgtgttggagaaactcaagtcgttggaacaaatcaataatgaatatgtatgctatttcttaaagggaaacattcatagattttatattaagaaccttttctaaaaggctgaaatttgggggaaagagttgctttttcatttaaaaatgtctgagaattgctaggtaatttaaaatgtaagcactcaccatatttatgtgtgtgtggtccaaggtatgtggtactggtacattacagagtaatggaataatgctttttagatgaggtaactgagtttacaatatatagagctcttcaactgtatcttaagctcttaggggctgacgacatgaatggcttctattgtttgacttagcagtttgaaaacacattacatatcatgcatgaagcctgaagccttctagtatgtgttttgtgtttatattactgtgctagtcatgtctaatttcacaccagtgtaggctgcttgtctaacagatgcctcgctagcattgctgtttcatataagaaataaaaaatgtggtaatttgcatatcttgaagccaaaagaagcaaacaaaaatcccagctcaatcaaaaattgttaaaaaagaattaaatcttggaagtgacaaggaagaaaagaaccctacaatgaaggtgaaacaactcaataaattcagaaagtcttttgagactctgttttgtaggtgttatggaggatgtgaagcaaataagtcatggattctttcttctagatcaggatcacttaagtgcttttgtgccatgttcttttaggcacttgggtgaagcctgtggatcatttctcctcatgctatttttaaataaatgaaataaatacaaaataaagggaaccaattttattaaaatacagttatttcaatattaaaaatcaacattgaaacacaaatttaaaataatgtgcttgtattttaaaaaggttaatctggcattgcttctaataaatcctatagttataaagtagagaagagagtaaacccagtgtttccagataccaggaacgattgtaatatgaaataaaagcttctacaatttttaccaatgagaaagctactgtggtatttttgtctacatttataattgaagggatattaaacttcaattagaagccagtgaaaataaacatatatatatatatatatatatatatatatatatatatatatatatattttgctcatctcaaattcatgattctcccagaaaagaaccctttcttgtagtaaggaatattgtagattgtagtaaggaatattctaataaacaaacaaaactcagaataaatggatttttacagaataaacaaaatgcagtgggcagattaacacaggagagattaatctttacttatctaatgaatgtgtatgcaaatatatatgtgtagaactaaaccatatgttgttctatgttgttatatttgctacatttaaaattgttcaaagattgaaaagtagatacatgatcctttatttccacagacttaattaatgccatgtgatatgataataaagcaaacatttactaagtatttacttcgtgtcattcagagtaagctttttacatgtattaaatcatcaaataatttaaaactcaaagtagattatgccacttcttagctcaaattttttcaaatggcacctcaactttcttggagaaaaagccaaaatctatatgacagcctacaaggctctatatgcactgttccttggtgacctttctgatctcatttattgtaacttttcccttacccgactttgttgcagccacactggactccttgcaattctttgaacctgacgagtaggtcccatccaccacagggccttcacaattgttcttctagcttcttagagtattattttcccaggggtgtgtatgatttgcttctcactctcttcatgtccctgctcaaatgtcatgtttatctgaggccttccctgaccaacctatataaagtgcctttcaagaatgcttttccagacttttcaactgctaaacatttattgaatgctaactgtgtacaagatctgataaataaaagaagactaaagcattattgggtcctccccaagaacttgcagtctagttaggtacataaaatatgaacatataataatatagatatcaatggaagtgctaaataagtgatacccaccagtggttctcaactttcgtttaaccataacatacattacaatgaaaacattcaattgattattcaacacatgtatactgaacacctaacatatacagggcaaaatattggatgctcacatgcttcatgcctttgtggattagcaagggataataacattaagctggtaattaaaaagtatgcaaacagtgaatttcaactgctgtgtataaatacaagaaagtgtacatacatgacctcctttaagaggaggacctaaattagtcatgtacaaaggatattttagattattctgaagcagaatgggaataagcaaggcagagagggaatatagagtgtgccaaatacagtaaattgcacacgtgaaagccctcagatgtaaaggtgcatgatgactttgaggaagtaaaggaaagcaagtatgtctggagactagcacataactcaagagaatcaagagatgagaccaaagctaagtcttgttggatgctggcatttatcttaagtataacaatatgccattgaactattaacattttaaacagaagcatgatagactcctttaaaatgacaacattagcagtgtagagaatggattggaaaggagaaatgaaggtggaaataaccacccaagtcaggaggctattgcctagctcaggtgacagataatgaccacttatcctagggtagtggcagtggaatgggaaagaagtagacggtttttttttttcttttattattatactttaagttttagggtacatgtgcacattgtgcaggttagttacatatgtatacatgtgccacgctggtgcactgcacccactaactcgtcatctagcattaggtatatctcccaatgctatccctccccgctccccccaccccacaacagtccccggagtgtgatgttccccttcctgtgtccatgtgatctcattgttcaattcccacctatgagtgagaatatgcggtgtttggttttttgtccttgcgatagtttactgagaatgatggtttccaatttcatccatgtccctacaaaggacatgaactcatcattttttatggctgcatagtattccatggtgcatatgtgccacattttcttaatccagtctatcactgttggacatttgggttggttccaagtctttgctattgtgaatagtgctgcaataaacatacgtgtgcatgtgtctttatagcagcatgatttataatcctttgggtatatacccagtaataggatggctgggtcaaatggtatttctagttctagatccctgaggaatcgccacactgacttccacaatggttgaactagtttacagtcccaccaacagtgtaaaagtgttcctatttctccacattctctccagcacctgttgtttcctgactttttaatgattgccattctaactggtgtgagatggtatctcattgtggttttgatttgcatttctctgatggttttgagatatattgagaccaggtggacttggcagagcttggtgataaattgtatagaatgggtaagggagattggtctggagtttcctacttgaggacacagatggatagtagtgctttgttttgcaagtggaaaggccacggaagagtaggattggggaaacatcattgtttcttacacacatgtgcattgtaccttcatgagtacctgagggttatgagccttgttggctccctgtcatgccacacctttcatttctgctcaaggaaacataaacaaatgagtaaggaagtgctttagagataaccttgaattttctttgacctagtccttaaaaaatatttcagttgtaagctgttaagatccatacttttaaaagtcacaaatgtttatagacttgactctcagctgatctagacataccattgtttagacagacctctgctgatatacttagtaggttcttgtaagggttcaggaaacagtttgtctaagtgctcggggaagtttgcatgtcagcagtggaatttaaattgtccaaacatggtgcaaaaaaatgtacagagaaattggtggcaaatgcaatataaatatgtggtgagtgaaccaaatattaatgctggaaaaatgcaagcatgtaccaggaatagtgaatagaaaaacatggttgatgtggatcatatatggagagaacgtttggcacatggactggtgaagctcacatctcataaccacaagacttaagtatttgaactttgttttgtaaacattgagctggagaatgagaacattaaatttaggaagattaatctgaggttgatgtgtatgcatattaggttggagaaatttgagacaggaaacaggaagatcgttgggtaaagtttctacatttgtttagatctgagatgttaaagggtctgaggtgagtgtgtcaatattttattaaaaggttcagggtaattgaagagatattcattggaaaacaacaatgagctagattgatgatttactgggcacaaaaagaagggatgaaggaagaatcaaagctaccataatttttacaatttgagacaatatgatgattaggggacagaacaaaagaaggaaattctgtttttgtgggagacatataatgacttgatagatgtactgaatagcaagatatgtaggtggatattatggatatttttgagattgtgtttatgttttttagtgattattaaaatccccaaattttcattggcaccccggactaaattttatttaaattagtttaaatgtccttttcttcagttttctaacaaacatgcacttaaattttaccatatgccagtcattatttcaagaacttctgtttaaacttatataaccctcatagcaacgtcatgatgtagttgctattattatgccatttcacagatgaagttaatatgcctcatgtcaacacaactagtaactaaaaatccagcattcaaactcaggcagtctggttccaaatgtacttatgaccactccattctgctgcccgtgactatatatggaatatatgcctcggctacaatcatatttgtatttattcaataaatgtttcataagtaatatttgataggtattacactaggtgctaggaataaggtggtgaacaaaaccagtcactgttccattcctcataaagcctacagcctaaaaggaaagatagttgttaatcagttaatcatatgaaggaacttgatagcaggagcacttaaacagtgtggattttacccaggtaaactgaagtgtaaggggtgggacttgcaattatttgggcaaagaaatatgggaagagcagagaggacacttaatgtgcaagaagcctgtggtgggaggcaggatggagaacatgcaggcattggaacaaatgctagcatggctacaggagacagagggcccatggtagtagagtagacagtgtgcgggctaatacaaaccatggaagccacatcatagggagctttctttatcctaaaagcactgggaagtcattgaagatttttaagcagagaaaaactcaatcaaattttccgtttgaaaaccctaatttgattagactgtagaactcagaggtgaatgcacagcatggtaatgaaaaaaaaaaaacacagaagacattgtaattaaatcaccatagaaaggtaaagcatttgtcttaaatgtttattttttcctgtgtatatgttggcttactacagtaattacagatgtggtgatacaactaatagtcaactctcctcaggacattctttgtaaatgtaattgaaagtagacatgtatttgaaaaaaaattaaattaattgaagataagctattatctaggattggtattaggtgctttctaggacatcttatttaattctcaaaacatgttacaaatgttaggccttcagttcgaaaggttaattagattaaattactgttcttggtcattattagtgcagtgaagttagcagcaaagttcaaccattgtggaagtcagtgtggcgattcctcagggatctagaactagaaataccatttgacccagccatcccattactgggtatatacccaaaggactataaatcatgctgctataaagacacatgcacacgtatgtttatcgtggcactattcacaatagcaaagacttggaaccaatccaaatgtccaacaacgatagactggattaagaaaatgtggcacatatacaccatggaatactatgcagcggtaaaaaatgatgagttcatgtcctttgtagggacatggatgaaattggaaatcatcattctcagtaaactattgcaaggacaaaaaaaccaaacaccgcatgttctcactcacacgtgggaattgaacaatgagaacacatagacacaggaaggggaacatcgcactctggggactgttgtggggtagggggaggggggagggatagcattaggagatatacctaatgctaaatgatgagttaatgggtgcagcacaccagcatggcacatgtatacatatgtaactaacatgcacattgtgcacatgtaccctaaaacttaaagtataataataatttaaaaaaggaaaaaacaaacaaacaaacaaacgaaaacaactttttttcccctaaaattgtttagtaatctgtgagccactaaaataaattcctttcttggaatccatctattaaaaaatctttgaacttttgaaaatacttatctcatacataatttacagatgagtaccccaaaatagttttgactaaaatattaaagccagagactctgaattcacaatttgctgccaacaatgataaattatgatgtcatggaacatgcagaatatttgttggaaatgaaaaattcaagatatatatatatgtgtgtagatatatgtgtgtgtgtgtgtctgtgtgtatatatatatatatatgtttcttactcctaaggaagttcctcaactgtggaagagacagaaaaactgatgcacattctcgaaaatataactatcatcaatttgattatctataattaataataatttctattaattttttggagaatctgagggttgtcacacctgctatctcaagctccttcctctttctgagaagtcttgcatattccattttgtatgtcactttttctgtcttatcactcagctctgacttaagggtttccaagatggaagtgtcaggagaaaaagaaatcactgtttttccttctgcagaagtatcattaattttttttcctttagtccatccttgacagcaatgtcataattatttttcccaaagtctatgttaattcttagtttaaaatgttaaaatctacaattcaagtaggaaaagtggcagataagagacaggactaacaagcagctcccacttagatggacagaacagtgtctggagactcacattgtgaacttttgctccaagaacatcacaggaacaaatcaggaaaacagaaataattcacagaccctttgaaacaagcagcttgcttctgcaaatgccattagacagctgaaaaaactatgagttcccaaagtgtgaggggggaaaagtcaccctctaaacacatatccccactgtgaactgaaaaatcctgatcatgggagaaggatttaactttacttagagccaaaacagatttaggaagccaaatgaaagataaaagtagaagcagcagccagaagagtcccataggcacttccagtcttcaagtgaagtccagggaagccatttctggccttatctcacagaggtccttggggaaaggaaagcagctggtggaatttgggaggtgcacagggtgaggtaagctcctaggtgaactttgtaataatttcgactgagcacaaactttcctgagcagaatcagggggagacggggaaaacaggtagtgcagatacaagtgcagaagccacagatggtgtgggtaggcaggcccaggcctgagagccctgcttgctttctcaattgggacgcttatagcctggggcaagatttcagccatgctcacaagctgcctggatataaactcagtgcagttctggaagcatggtgggagtgagattggccttgctggctatgtggcatctgggtgagccctgtcactgccagctttcccccacttccctggtgacctgtacaatgcagcagaggcagccataatctccctgggaacataacttcattggcctgaaagccaccccaaaaacccccacagtggctgcagcaagccctgcccaaggagagtctcagctcaaacccacctaaccctgcccctacctgatggtttttctttgcccaccttggtaaccaaagacaaaagacataatctcttgggagctgtgtgaccctgcccatcacctgagaaacctaagcactcatctggccagtgtagggcaaaattatatccctcttctactgctatcctcctttcactctctttaaagcaccacctcctggctggaggccaaccaactcaagtcattacagcaactcataacagaacaaccctgcttcgaagaaggaaaaaacaacagctaattctaccacctgacacaccctggctagccagaggtcctgaatctgtccacatgacaacttcactgctagcataaccaacattcaagaaaaccagtgcactaaacaaaactacaaccaaggactcccacagagtccactttactcccctgccatctccgccagagcaggttccggcatccacagctgggagacctgaagatagactgcatcacaggacactttgcagacattccttagcaccagcctagagcccagttgccccactgggtggctagatccagaagggtaataacagtcacaggagtctggctctcaggaagccctattcctagaagaaaggggagagcaccacatcaaaggattaccctgtgggacaaaacaatctgaacagcagcgcttgagttccagatatttccaatgaaacattctacctaaatgagaagaaactagaaaagtaattctggtaatatgacaaaacaacattctatgacacccacaaaagatcatactagctgtccagcaatggtctaaaccaagaaatttctgaaatgccagaaaaagaattcagaaagttgattattaagcttctcaaggtggcaccagagaaggatgaagactaacttaaataaattaaaggccgggggcagtggctcatgcctgtaattccagcactttaggaggccaaggcaggtggatcacttgaagtcaggagttcaagaccagactggccaacatgatgaaaacccatatctactaaaaatacaaaaaagtagccaggcatggtggctcaaacctgtggtcccagctacttgggaggctgaggcataagaattgcttgaaccccggagacagagccaagattgtgccactgcatgccagcctggacagcagggtgagactgtgtcaaaaaaaaaaaaaaaagaaaagaaaagaaaggaaaaaagaaatacaaaaaacatataggatacagatgaaaaagtctccagggaaatagatataataaaggacaatcacaacttctggaaatgagtgtcacacttagagaaatgcaaaatacactggaaagtttcaacaatagaatcaaacaagtagaagaaaaaattcagagctcaaagaagacttctgaattaaccctatataatgaagacaaataaaaataatttaaaaaatgagcaaagaatccaagaaatttgggattatgttaaatgaccaaacataagaataattggtgttcccaaggatgaagagaaatctaaaagtttggaaaatttatttgagggaatcaatgaaaacttccctggtcttgctagagatctagatatccaaatacaagaagctctaaagaatacctggtaaactaatcacgaacacatcatcacctaggaacttacatagtcatcaagttatctaaagtcaagatgaaggaaagaatcttaagagatgagaggcaaaagcatcaggtagcctgtaaaataaaacctatcagattaacaggagatttctcagcagaaaccctgtaaaccagaagggattggggtcctatctatagcctccttaaaataattatcagcaaagaatcttgtacacagcaaactaagcttcatacatgagagataaagtctttttcagacaaataaatgctaagagaattattcaccactaccaagccagcatataagaaatgctaaaaggagtcctaaatcttgaaacaaaaccttgaaatacacaaaaatagaatgtccttgaagcataaatctctcaggaccaataacacaatgagaaaacaatgagaaacaataacacaatgagaaaaaaaacagggtattcaggtaacaactagcatgatgaatagaacactactatgtcacatctgaatactaacattgaatgtaaatggctacacttaaaaggtacagaatctcagaatggatcaaaatcccaaaaccaagtgtctgccatcttcaagagactcatctaacaaataagtactcacctaaacttaaggtaaaagagtagaaaaagatattccatgcaaatggaaaccaaaagtgagcaggggtagctattcttatatcagacaaaacagactttaaaggaaaaacagttaaaaaagataaagagggacattatataatgttagaaggattagtccaacaggaaaatatcacaattctaaatacatatgcacctaacatgggagctcccaaatttataaaacaattaccgctacacataggaaatgagataggtgacagcatagtaatagtgaggaaacccaatactccactgacagcactagatagatcatcaagacagaaagtcaacaaagaaacagtggacttaaactataccctagaacaaatggacttcacagatatttacagaatattctatccaacaactgcagaataaagattcttttcttcaacacctggaacattctctaagataggctacaaaacaagtctcaataaatttaagaaaaattgaaattatatcaagtactctctcagcccacagtggaataaaattggaaaataactccaaatagaacccttaaagctatacaaatacatggaaattaaataatctgcttctgaatgatacttgggtccacaatgaaatcaagatgaaaattaaattctttgaactgaatgataataatgatgcaaccaattaaaacctctaggattcagcaaaagcagtgctaagaggaaagttcatagcattaaatgcctacatcaaaaagtctgaaagaacacaaatagacaatctatgctcacacctcaaggaactagagaaacaagaataaaccaaactcaaacccaggagaacaaaagaaatgacaaagatcagagcagaactaaatgaaattgaaacaatgacaaaaaatacaaaatataaatgaaacaaaaagcttgttctttgaaaggataaacaaaattgatagactgttaatgagattaaccaagaaaagaagagatacgttccaaataagcttaattagaaacaggccaggtgccacaggtgtggtggcttacacctgtaatccagcactttgggaggccaaggcaggcggatcaccaggtgaggagttcaagaccaccatgaacaacattttgaaaccctgtctctactaaaaaatacaaaaattagccaagtgtggtggcacgtgcctgtagtcccagctactcagaaggccgaggcaggagaatcacttgaacccgggaggcggaggttgcagtgagctgagatcacgccattgcactccagtctgggtgacagagcaagactctgtctcaaaaaaaaaaaaaaaaaaaaaaaaggaaagaaaagaaaagaaacaaaacaagagatattacattcgataacacagaaatacgaaagaccatttaaggctactatgaacaagtttatgcacacaaactagaaaacctacaggagacggataaattcctggaaatatacaacccttgtagattaaaccaggaagaaatagaaactctgaagagaccaataacaagtagcaagattgaaatagtaatttttaaaaatgccaacaaaaaaagttcaggaccaggaagatttatagctgaattttatcagacattcaaagaagaattggtaccaatcctgctgaaactattccaaaagataaagagctaatcttccctaaatcattctattaatcaagtattaccctaataccaaaaccaggaaagaacataacaaaaaaaaagaaaactacaaaccaatatccctgatgaacatagatgaaaaaatccttaacaaagtactagctaactgaatttgacagcatatccaaaagataatccgccatgatcaagtgggtttcatactagggatgcaggggtggtttaagaaatcaataaatgtgacacaccacataaacagaagtaaaaacaaaaaacatacgatcatctcagtagatgcagaaaaagcatttggcaataatccagcatccctttatgattaaaccagtcagcaaaattgacatagaagggacataccttaagttaataaaagccatctatgacaaacatactgatcagggaaaaatttaaaacatttcctctgagaactggaacaagacaaggatgcccacttttacctcttatattcaacatagtactggaagtcctagccaaagcaatcagacaagagaaagaaagaaagggtattcaggccgggggctcatgaccataatcccaccactttggaaggctgagacaggcagatcatttgaggccaggagtttgagacctgcctggccaacgtggtgaaacattgtctcaactaaaaattcaaaatttagtcaggcacgatgacacacacctataatcccacctacaagggaggctgatgcacgagactagcttgaacctgggaggaggaggttgcagtgagccaagctcacgccactgcactccagcctgggtaacacacacagtaagtctctgtctcaaaaaaaaaaaaagaaaaaaagaaataaaggacattcaaattagtaaagaggaagtcaaactgttgctgtttactgatgatatgatgatatacctagaaaaccctaaagactccttaaaaaactcctagatctgattaatgaattcagtaaagttttagcatacaaaatcaaggtacacaaatcagtagcactgccatataccaacaacgaccaagctgagaatcaaatcaagaactcaaccccttttacagtagctgcaaaaaataataaaatacttagcaatatacctatccaaagaagtgaaagacttctacaaggaaaactgcaaaacactacggaaagaaatcatagacaatgcaagcaaatggaaacacatcccatgctcatggatgggtagaattaacattgtgaagatgaccatacttccaaaagcaatctacaaattcaatgtaattcccatcaaaatacaatcatcattcttcacataactaggaaaaaaaatcctaaaattcatatgggaccaaaaaagagcctacatagccaaagcaagactaagcaaaaagaacaaatccgatggcatcacattacccgatttcaaatattctgtaaggatatagttaccaaaacagtatggtatgatataaaaataggcacatagaccaatggaacaaaatatataacccataaataaagccaaatacttacagccagctgatcttcaacaaagcatacaaaaacataaattggagaatggacaccctatttcataaatagtgctgggaagactggcaaaccacatgtagaagaatgaaactggatctctgtctctcaccttacataaaaatcaactctaagacgacctgaaactgtaaaaattctggaagaaaacatcaggaaaaactcttctagacattatcctagacaaagagttgatgaccaagaacccaagagcaaatgcaacaaaacaaagataaatagatgggacttaactaaaaagctccttcacagcaaaataagcaatcaccagagtaaacagacaacccacagtatgagagaaatattcacaaactatgcatttgacaaaggactaatatccagaatctacaaggaactcaaacaaatcagcaagaaaaaaaaaagaatatcccatcaaaaagtgggcaaaggacatgaatagacaattctcaaaagaaaatatacaaatggccaacaaacatctgaaaaatgctcaacatcactaattatcagggaaatgcaaatcaaaaccacaatgtgataccaccttctgcaagaatggccttaatttaaaaatcaaaaaataatagatgttggcatggatatggtaaaaaaaggaacacttttttttactgctggtgggaaattaaactaatacaaccaccatggaaaacagtatggagattccttaaagaactaaaagtgcaaatactatttgatccagcaatcccactactgagtatctacccagaagaaaataagtcattatatgaaagacacttacacacgcatgtttatagcagcacaatttgcaattgcgaaaatatggaaccagcctaaatatccatcaactaataagtagataaagaaaatgtgtcatatatatatatatggtgtgtgtgtgtatgtgtatgtttgtgtgtatatatgtatcatggaatactactcagtcataaaatggaatgaaataatggcattcacagcaacctgaatagagttcgagaccattattctaagtgaagtaactcaggaatggacaaccaaacattgtgtgttctcagttataagtgggagctaagctatgaagatgaaaaggcataagaataatataatggactatggggactttgggggaagggtgggagggggttgagggataaaagacagcacattgggtacattgtacactgctcaagtgatgggtgcaccaaaatctcagaaattatacctaaagaacttagccatgtaatggaacaccacctgtttccccaaaactattgaaataataataataataataaatattaaaatctttctattactcctcattatgaacactgagatttctatttaaattttttagataggctcaccaattgacttaattttaaagtgtagaactagatttttggaggttttaagaaattaatctcagtctgttcatatgcaaacgattagttgggagaaaagaagctgttcgtagttgatgatgattcccatgtggatgtatatataaattaggcacacagtatataaaaatggaaggaatgcatttgttgtcaaacttcctatactttcccctttgcgaagcatttgatacttctcaaactatcaatgacatagtaatctttttgtagacattattttaaagctttgttaaggtataattaacatgtaacaaaaattacatatatttatggtgtatttgtgatgttttcatatatgcatacattatgaaatgattaaatcaaggtaattaaaatattcatcactccacttatttttttctgacgagaacgtttaaaatcttctctcttagcaattattatgtgatacattgttattaataatagtcaccaggttgtacaatagatctccagcacttactcatgctggctaactgaaactgtacccttgactaacatctcccaagccctcaacccctttctcctacccctggcaatcaccgttctagtccctgactttatgagttcaacatttttagatttcacctattagagaagctttcagttcacagcaaaattgagtggaaagtacaccagagtggtatatttgttaacagtcattgaacctacattaacacattgtcacccaaagtccatagtttttagggttcactcttagtgttaaacagtctgggtttttacagatgacgtgtatccaccaatataattacatacagaatagtttcactgacctaacaattctgtgtgctctaccttttcatccatccctccctgctaaaccctgatctttttactgtcttcatggtttgccttttccagattgtcatgtagttggaatcatacagcctgtagtatttttttagattggcttctttcacttagtaatatgcatttaaacttccaccttgtgttttcatgacttgatagctctttatttttagcaccgaataatccattgtctgactttaccatcgtttctttattattcatctactaaaggacatcttggttgtttccaacgaacagaactgctgtaagcatccatgggcaggtttttagtagatatgttttcaacttatttacatagtaacttttattgtccatcttgtaagcctgaggtttgaggactaggtttgaccttcatttcaaacattagtttatattactccagagatgatttcagataattcaaagtgctgtacttatttgccaactttgttagttaagtgattaatttcatgattttagaggaagaaaggtgtactaaaactctgctctgagaaacttgttttatatttcctttttgtgtatgtgaatattcctatggcattacagcatgaatattgcactaaaattttgatctaagatctgttctatataaagtggaatttatcttggagagggagaaaggagaaagggtcaattttggattcaagcttagtgtgttcaactgtcctaaatcatagctcactgcttgaggcacagggtcttactgcagagtccccaggagagggttaagataccacaaagttttttttccctttttaaacatttctataatttttatcttaaagactatattttcatcatttttcaagccacttggttgttatagttagataccttgatactatgaatgttcaaggaaataattttattgaaagagattattttttctattaaatatacagtgaaactaaaagtagcaaggggatacaggcggaaacattaattccatcatggaaagagtgagtttattgcctgcctatttgaaccgtacactctatataccctttggaaaagaaaaaatattagttcttggcaagcctcatgtcttcatttatgtatctcttctgttttatatctcaaatgtctacttgatgtaatcaaggggagtagtatgactcaaacttttgtgaagaatgaattatttaaactaccagtattaaattttcagttcgcacaatgcaagggaactaaagataccattctctcagtctctttttttctcttcacttgagtaggtgaaagagaatatttgattatttgttttagtgctgcctggacaaacatttgggaaataaatcaaatgtgaaatatattaccttcaaggcattggtgggctatcatggaacagttgaaagtgtaggagcacaagagaccaaatgatttggtttgaactgtgcataagctcagtttcttctctggaaaatgagtcttcttttacctacccaattcatttggtgctgtttttttgagaattaaatgggacaacccatatgaaagtgaacgttgtgtacctagagcactgaaggcacttacaacatgagtaccctcctccccaacctcaccataactttcagaaaacagtaagtcagtacctcctgcgtgtaaagcaccacatttggcactgtggcagtataatgctaaataagatccggttctccagatgcagattattacaacactataaatagaattagttatgaatgcgcttcatgacaccataactaggacatactgcagcatatatgtacaatttttgaaaatgactttcatgtttgtatgtcttagtaactacacccagggtaactactggatttgatgggagttgagagacatggagatgatttaggagggaagctagtcatgtagtcaaacaccacactttataaaactccaaattataaattcacttctcccactatgaatgtactatctaatatgatagccactatccacatgtggctatttaaatttaagttgataaatgaaataaatgcttaaaagttcaactattcaatagccacatgtggctaatggctagctaccatattggttagcacagatataggacatttttatcaatgtagaaagttatattagaaaactattcagaagctaaggttcaaatttagggtaaagataggaagaagtaaattatttggcagtctatttctgaattcttgtacccataacggaaataatgcaatgttggcaagaaaatatgagagaaggaaatcatagatattcagtattttttacttgcatttatgaccttttttgaatgcttactaatacactttaattaatttgcacccccatacacatagtcaatgggttatacatcttgttttatgaacatcgtatagcagaggacactgaaatacagattttaagtacatttcctaatcatagcatgaagggaaatatagctgaatttgaactcaagtaattggactccagagccctacctagaaactaatctgaaaggcagtgggttgaattagtaataacagcctttagaggaaaatttaatttttttctgtttattgccaccaatcttggttgtttcctgatgggaattggaagggcacttttggaatgcataactgttctcttatagggtcaatcaaccaatgtataagtattttagaagctataagtatgtatgttggattaatcttgctgagagataaaatcagtagtcttgatattataaattttactatttatcctgttgactgcttgcacacaatcccaatagcttattggtagtaacttctcattttgctaacacaaaatattgaatcctacactatggacactgttgtacaatatagcatgactcttgctagtgagtgagtgagcctaaatttctatccaatttaggttcagcttgactgttttctattcattattcatattcagtaagtttcagaaaaggtttgaaggtattaaatttttcagttatgctttcctgaatttattgaaggcattttatgcatagttatgccattaacttagtgaattttgaaggccctgggaacatgtcccttggggatgtaaaaattctaatacagagtatttggtcctgttctcaagccgattatgatctagtttgaggaggcagtctaacaattcattcattcattcatctattagtttttgaggacataatattgtctaaaaaagctttcatgagtaaacaaagataatatacaatttaaatgctgtaattctttggagaattaagcagttagttaatggaaaactaatccatattagtttccattaacatatcatttccataaacatatcaggtgagctattgaaggttctcttttaaattcttgataagcagagatccttatttctagttacgtgtgatagacttgataggactaatgagtgtgacttaaaaaaatcctcaaataaaatattttatctggatgaaaattggaagcttctattcacactgtttactatttcccagtcttcagctggcatgggaacactcaatttaacggaagcaaatagcccataaattacctaaatgccaagtagttagatcagtgttactgctaaattcttctacactggggattctcaagttttggagtatcaatagccagctttcattttatttgtcttaaaatgacttacctgtcttccaatatgattgcactgaattttaagtaaattctgagatgctggcatatgataggtacgtgactttgtaaagggaaaataaatgctattttcatttatacgctcagtggttgtccttgtaatttcttcaagagtgggctgaatgatatttgagggcttgtcacttgtgcatattctttcaaaatgtatcccttagtggattaagtgtcaaatcaatctcttgcttcttcagtgcaaaatggatattttgttcctttttgccacatagatcatgtacctcatgtcatttagcaaggctgtagctatgtgaattattttatagttcctagattatagtttttacatgcaaactcgtatattgatttgaagtggtagttttttctgcccgccagggatataggtggtagatcttaaagtggctcattgtttggatttaattttgttcttttcctaaacatagcttttaccttattcatgtcataaaaaagttttaccatcatctcttggagattttattcagcatattatttttataatatgttttggctgacataacttgcctactactttgatttttttttaaatttggtagtattgataaaatataaaagtcactaaaaatcctattacttgttttggaattatataaaataagtaaatgttccttgatacatcaatcaattcccttcctcaagggcaattactatcaatttatgcatgtccttcttgaattatttctaaatttacatactataatcatgtaaatatttatatatgtatcacaacatatttacctgcaatttaactttatggccatctgtgttgcatgtgtatacacacactaatgtgtacacatgtacatacatcataaaatgatacatcataggaaaaatatctgtttgcaaatttgtttctgcttaagagtatattctgaacatatttctggttcaatacatgtacatgtgttgtattttttatgattgtatagagtttcattgtatttatgtattatatgtcattctaccagctctcttgatgtatttttgttttttgctattcaatcagtgttgcaacaaatatacttgtacatatattttaatcatgaatgctattttatgtgtagaatatattcttagaagtgaattgctagatttaaggaatttatattttaattttaatacatactaattaatgtttatgaatactttacaagggaaacattatactacactatttctgattgtttttgtaagtcatctaggaaagcattcttttgaaaaccattacttgatatctggacaaaatcatttaaggaaatatttctgtatagggtaaccctatatatggtttatatagctatagtgcctgaagtatatatctgtgcatttatgcagaaactttgattatatctatcctaaatcaaattcgagttgcaacaaagagatggatctttgagattagacagacacccattttaagtgatgtggtaactgaatgttttaagttattatgtataaccacaaaatccctggaactctagtaagaactctagtaagagttgcatgttggcaggacttcaccaatccacctaagccactattttttttttataaccatccttgtaaatgagttcaacaatcaacaatattttggttgtatttaagggttcactgtgaatataagaaagattttataaatttaaatcacaaagtgcttctcccttgatttttttgcttgttgaggcaaagtcctatgtagcccagttcacccgaagtcatgctcattctttcacatcacaaagaattacattctttagcttcatggaatgtcatggaaataatttatttctattaaagaaaaaagataacacttggtatggttccaagggagatttcctgcttaaaattttacgagatggttaacagaaaagtctatccaggttcacccccacccttatcttaagcacattcttatcccagaatagaaatgatgcagaatgtaaaccatgcatttcaaggtcagatagcagagttcagaccagaattatgtttgtattatatgctatcgctatatcctgtggtttaaaagaaaatagtctggaaaaaagtctgtagaatgttatatttttgatagaatatctcactctgtcacctgagttgaagtgcggtggcatgatcaaggttcactgcagcctcaacttcctgggctcaggcaatcctcttgcctcagctccccaagtagctgggaccatagatgtacacaatacctggctaatttttacttttatttgtagagataggataccattatgttgcccaggttagtcacgaactcctggactccaatcctcctgcctcggcctcccagagtgctgggattacaggcatgagccaccacacacagcaaatgttatcatgacattattttttaacatttccctttcttggtattgatgactgagacttgtgatgttaaataattctgctgctctcttttgactttataattcttgtgtaatttttacagtatgtgtttatacctctaagaatgcaggtgtatatatgttatatgtatatcatattcatatatttgtatttctcccattcctctttcaccaatgagaaatacatttataagtactttgtgaaaaatactgatagaatgcttagatgaaagggaaggccataaaaattatagaagagaaagagaagcagcagcctgagccaagaaaagtacttaactatcttaacccctaggtactaaaaagaaaaggatatgtgcttgcaggaacagattttcagtcccttactgccaggttaattgcatagcattatatttcctttctagggttctttgcaaacctacttattggcatgaggtcattccgaagcattttgttgaaaacatgtttttaaaacatcattgtgctaactttgacagatttctcctagaacgaatttctttatttttcagaatctaccgttgaagaagatcccatgcaaaaccagtgcaccctcgggctccttttttgccagagacaatacagcaaatttcttatcctggtgccgagatttaggggtggatgaaacgtgtctatttgaatcggaaggtttgggtatgtattaacttcagaattttagttgataagatacgcaaattatcttttgtctttgtcagtatagccatcaaaaagttttttgtatgatgtcattttgcagattattagcttaaaaagtctgagtttgttgaaatcttgcaggtttgctgctaacttgatactttgaaaatagaaaaatgaatatgccctcttactattggttacctcatggatacaagaatagaaacagaagtagcagaattctttccaagctaaatataagggccattagggcaaaattggtgcaaaattgtggatatttggaaaacagaggaccaaattttacccccaggctttgatctggattaaagggtagctgtgcatgttctagccatagagagcactcttgtcttttcacctctacaacagtatggaaacactattgaccataagctctacctttattgaacgtacagattactcattcatttatttattttttagtgagttaaaaatcaggcaagataacaagagattaatatcatcaaagatgttgaattaaaagacagataccttagtgcctacacctactgagataactgcgtagatttctgtagttgtttctgattgaatttaggcaaagtcacttccaaatcatagaatgagcttatttctttggaagaaaacatacattggagcattcagtgtttcaataccactccatacactaggataacatgttcaaactttccatgtaggctccaccacagtacaactcaaatatgtaaaatattagaactaaaggctcatttttgcaaaatgcaaccaaattgagaaaggagacatctagagaaaaaaacttcgctttctttttgcctgaagccttaaaaatcaatttaataggtcatataataacaaatattaatatcaaagtaaggtgagcatccttcagagagaacaagtatacaaattcccttccaaacagccaaaatgcctattgcccctaggccccattcccatgcgtaacctaggaaatttatggaaacagctgaaatcttactaattttatgtgcttaaggaaatctgtatttgttctcagaggagttggcgtgatatggcaaagaaataccatcaaatttttgaaaattctcttagcaaagatgggaacagcataaatttagcctgggggaatatgctagacctgaataaaaaaaaggaaacagaataatctcacagtagtctgctttacacaatagtgtgctcatgaaatgctcagtaaataaatcagcttttgattattattaccatttcctcatatcaaagtaaaaaaatttggtggaagatgtgtgcgtacatagataatacctgtttttcagtcctgtggttaatttacagatcaattttaactttcaggtttgtaggaaaccatgcgagtggaggattataggaagggggtgtaaaagaattatttgcacaaacaattaaataaaattgcttacaagatctggtaaatgttaagatcgtgtaaaaatatatagccataaaatcaagtcttagtaacaaggagtacactctgcatgtgtggacgattaacatcacgatttaaaattctacagtgcctctgaattgccaaagaacaatcacatggggaaactatcgttaatttgctagtttgttcattgtacaatttttcattaaagaagcattttctcagtgattactataggataaattggttaataaaagctatgaatgtaaatattgtcttgtctcattttctcattgtccatgacttcttttgttgtttgaactaatgaaattttcctgtggacaccaagaagagtccatctaatattaaatcctctctgctagaaatagcactataggtgaaggttctaatgtgtatttactttgatggcttttaaaagccccatccaaataatactacattttaccctaaaattacaaagtttaaagcaacttatataatgaccctggtatataaatgcatactctataacaaataaaattatgtcaggaagaacttttagatggcctacttcttcagcctgtttgaaaaaatatattctgacattataaaaagcccataagttatatatattatatatataattgtaaaaatatttttgtacaaatttttaagtctataaaaatttaaaaatcttttgtaaacttctcagtaccaagttaaattaattagttaggttttccagttgctgcttaatgaaaagataaatttgcaatttctcctgctcagaatagaacccaaagtgatatgtaataggctctagggatgtaatagaagggggtcaatattatggcattgactttaggattagtcagagaaaggaaacagctgtgctcataaatgttcatgataatcaggaggaaggacaataagaagttccatttccacaagtggaaccgtttctccttttttttttttttaattattcattgtgggtgaggaagagattgagccgctgctgatggctttggactctacttgcagaattgactttcttgcaacaataacactgtgtcctctgcttgatgtcttttcacacttcacttttgaaaggaaatttggggcaaggctttttttttttaacctcaagatttcatttcagtggcacagaagatgaagcacatcctttgtgtcctagtgttttgaacagcaaataaaatgaaaagatgctctgatgaacgggaaaaatgtgtttgaatgataaagtagatcactgtactgagtgtgtatgaagaggcttctgtgtttagctgttcaaaggtctttgcctgcataaagcatccttatccttgtggcaactgatatgctaccctctgttgcagtgcttttttgtacaattatttgtcagaggatcttgattcacaactcactgttctcttttcacaacagctaatggcaagaaacctcagtgggtgagggaaggtgtgcaagcgatgaactggggagaagggagagcaactaattccatatgtttatgtcatgcttcttgtcttttttatgcttggcagataacttcctatgccatatacagggtttaacctattatttatactctatgacattctttagagataatttttcctctgtaaaatgtcagttcttagatcatgtgttcgctacatcctgaaatctttcagaaataaaaccatagaaaagtggagatgaagaacctatttgcaaaagacttataaaaatccaattaagatgttaaaatgttggaccccttagtaataaggtagattttattcacatctaccttattactagatgtgaataaaatctaccttattactaaaggtagattttagctatgaaaaaatagctaaattaagaaaattatatagttagtattggtaagtatatattgtatcagaatcttccatacattgctgaagaaaattggaaattggcatgctttctttggaaggcaattttatatcaaagacctcagaagtatttatacactttgattaagttgttctgcttccaaaaatgtattaaaaggcaattagtagagataggaaccagaatgtctactgaaacattaaaaaaatagctggaacctatgatatttggtagcagcttaaacaaattgtagtcatccatagatgccatccaaagacaatattcttgaaactatttaaggatatgggaaaatatgatatatgattaacatgaggtcacccgtttgtatctatatttaacaataaaatttcacattcagaatttgaaggaaaaatagatagtaattaggttgtaaattatatcattttcttcaattatctattaacaaacttaagatagtgaagaattatggcatgtaatctgaaacatgaacaattgatttatattatgatgcaattggaccaattagcctagatatttattgacataaaattttatacatcagtatattaaaaggatttttcacattgttgaagttaaactgatactttaagtgattacagaattctatgttgtatcataacaaaggtttttgtgtggtctgcagagcatgttgtaaccataaaggtctacatataatactcactctgacccctgctgttcaaaccatgttgacgtataagtgacaagagaaacatttcttttcattactctgatatattaagatcaataacattttcattagattcctttaaaatatttaggattgtgctttaagttaaaaagatgaacttaagtattttcttgaattcaaaagtatgtagttgatcagtctataaacaaaatagaccccaataattattttataagaaattaacttttagttgtagagttaaaaatatatatagctatagaaggctctaggtgtgaaagtatttatattttcagtttcaccgaaatgtaaaagttattggactgtattaatcaataatcttcctaacagtaaatttagtaatttttcaaatgttcatttaaataaataatttaaccacgttttctaaaatgatgttgagtgtttttatggggctaagttttacaatttaaattaagatcagaaatctatactttgttttcaagcttaaaaagagttttcaattatgaatcatgaaattgatgcttttatgtcattttttactaagatattttaagtaactaaccattttcttaaattactgctagtcttgctgtacagtttattatttgtaatttgcattggcctatcaatttagaaattgtcaagttaactttttttcctagaaatttgtttattttgttttatttatacacattctggtgagctgggagatggcgaaaaaagggatggggaagtattttaaaaatacacactttttttgcttgctataattgtgtcaatatcattatgttattggataattataggatttggaggccagtgactatgcttcatctatttctctgagaaagaatctactcaacaagaaaagggtttgctatctgcggtgtagcatgcaaatgtgtgtgatttgtttgagtataacttttaaaaaaatttattttctgtgtttgtgtttgctgtgtggtactgtcttcttttgatgcatcatcctgatgaggaattctacaaatttttttttgttttgttgaacattggtgagcattttgcttcaggggcaaacattgtctacctgaagtaaaaaggtttgtgtgtggatttttaaatattagcattttccatttcatttcttaaagtcacgtgttgcatcagaaaaagaatctatgcctgcctttaagtgtttgataaatcattccttattcttgtttttgtctatattgaagactataagagtatttttgtgggaaaaaagctatattacttttatgagtattaatttatgataataatttcaggatactcattcagccctggattatttatattaatttctttcccaggatcattttattttagactttttgttttttaacacatttttgttttatgaagtacatacttcattagtatttcaattcacttttactctggaactcagaaaacccttttcaaatctggccctctcccctatgtcagggaagatgcaggagggagcagttaaatcccttacgcaatgttacacaacttttaaatggcccagctacagtttgaattcagctccattcaccttcagaaatcatgccccatctgttatagaaagatgtactttgtctgcgttcattttagatgttattagaattatttcaagcaaaaggaaaaaatatataccaacttagaagagactcacctctgattgctattctgagtgatagtggcttaatccattattttaacctgggtgctgggtgctagaggaaaaaagagcgctcttttttccaggatatttctcaactctggggcaaaggcaatgaaattcattcaattctgtagggcttccattactgatgagattatgaatggacactccttgttcaaatgatttatatggatgccatattctattttaaatcattcttactggtgattctgagaaatgtggatactcacacacatcattattgagcttgtgagattcttctttgtttgctttttccttcttctcagcagcctcagatcagttttatagcccctaaattgctatccctatttatcacctacatttaacctcacagatttttgtgtgggtcttactcagagtgacatgacacagagagtagtctgtgactgtcttcactttcttgggaagcatgaaagtttttatgtatcttatagattccggcaggagagaaatgcctataatatttattaagggctaatccaacattcgcattatttcccctccatttatcatcatcatcatcatcatcatcatcatcatcatcatcatcatcaccaccaccattgctatccttcacatttgtggagcatgttacatatatcaaagcacacttaaatattttcagcaaaacatatgtaggaattataactactatttattattataacattgattaatacagtacttatcaaactttagtgtatatacacatcacctggaaaatttttttaaatgtagtttctgattattagagctggataggtccccaaatttgcatttttaataaactcccatgccatgcctatactgctggtctctgggtcacattttggtgcaagagagtaacatttattgtttaccgggtaccatgtgttcttaaccatatggttacctcataaaggagtgcaagtagaagacatggcacttgttttagagttgaagaaattagccttaagtagaatccaattcttctgacttctagtttactatttcttctactataccactctccttggcatattagaaccaattctctactctgggaaagtaggcagccattaatttataatatttttataagtgaacaacatttatcctaaagtatattttttcaagttcccttactaaataaaaggctaaaaagctattttcttcgacattaccattaatgttgtaacctctagttatatagaaaccaaatggacaacataatttttcatgctttcatttctttgcccatctgttaaaacttaatatatttaactaaactatacattcatggtctaatgcattttatccttgcagattctgtgacattgaaattctaccctcttgctttagtggaaagcctcattttctattcctggagctaacagcattccatttgacatttgatgcccatgagattttttttaatagaatctaggttatgagagtgagtctcttgccacatatttttgaatggaaacctgtgttacttttcccagaggtgttttacattatgcttttcttgaaatgcttttgattatttaaaaagaagccgccaatgataaaaccatttgtgtaataatcaccattgactagagagctctttatttgttttgaagagaatttgttcagaagaaagctacagcaatcctctcttctaccccaactcaaagcaaaagaccttgttaatgttacaatgatcaagtggggaaaatgtctcctactataagttttaatgtaactagatgttcttttgaaaaagataaatgatgacatgtgcttaaaatgagtagtacatatgactgcatgctagggctttagtacaaacacagtacaatgatagttgcctgtctaattatcttgacaaaggtatacattcagttattttatcttctaaaatagacaatacatgattacataaataattattaaaagtgaactctactaaattattttaatcacaaaagaaaattaaaggcaaggtatttggtgtttcaaaaactgacatatgtcctaatgcaattgttacttgaactttgtacttagcatcaacttgtaattgctgaaggatatctactttatatctttacatgttggccaaattgactcatttaacctgaagtttgattaaatttagaattaactatatctgatataatataaaagataaacatttaaaatatactcattataatagaaccaatctaaattatatctcctaacagtaatcttctcttcattccagagtttctctcactgtctagtaactgacacattatgatgcacaaaaagtgcttgcagggaaaaaagtgaattaatattaatcgactaaaccaaataaaataataatgaaaagaaaaaaatataaaactatcattgggctgttattttctatgtgccaagtactatgctaagcataacagtaaatattattttgtttaatcatcacaaaaatattatgaggtgggcactattgttttcctgcagaaaaatgtgattttgtagaataacctcccaaaataatatgaccagcaagtattagtgctcatactcacacccagatctttgtggcttgaattacgcaaccattatactcttttcatctattaactttagtttagaccttgctctagtgccactaccaaagtcacctttttagtataatatagatactacatacagacatttgaatttacattttatagcaataaggtaagagtgcttgcttttgcaattaaacatttgcatgatttaaattcttgccttttctaaagatgctaggtaaaactttagcctttattcagtttgttcatcatcacaacccctatcaccaccaccacataaccacataactatcatcttccttgtcttacaaggcattgtagtcactaagtcctttctctgttctaagtattgcattaagttatgcaactctacagatttatcttagtcattgcttgctggtcaccaatcattcttttttttttttttttttttggtccattagtggccaggcttggtatattcgtatttgaaaaactattaacatatgaggtaatattacagatgtgctttaaaagcaattttattgctttataaaaaggcaatatttacacaaagaagtgaaagtaaaacaccatttttctgttagcattttcctaagaaatgatgctggggaagaggtttatctgtcttaaattttaacgggctgattctgttaatgaaataaaatgaagaatcatgcagtttcttctcagtttgccaaattgcttttctaatgagtctgtgatagagttgatattgagttttggcatgcaaaagctgttttaaattggcaaatgaagaagcaaagaaatacacaatattgatgcatcctacatgtgaaattgtctttcttacagcactcacattattatttttcttcagaatgaatttgattttccaaattagtactcagaatatgtacagtaagttggttaaagaaccattattatcaggtattatcttttatagttggttattagctgcacattgacacaatttagtcagttaactaatagtttttatattttgacactcttgtcatcaagaaatgcatgacattgtatcaaaagctcttgatgctatagccactgcttcacacagattttacttaggatgagggcattagctttaaaagtcctcctctcctcagtttttacatacttctttctcccactcaaaactcctttttgttattttgtaccatggatatgttaaaaaaaaaaaaaaaagtctgaatcagaaaaaaattgatgatctatacaggaagatccattttcacttgtttatttctgtttcgtaatatgtgttattgttctctgtatgaaattgatgcctgtgtggcattacagcccttatgttactttgtgctggaatttatttaatatactaaaccttatgaagttgatatcattctagccacagtcaacttgtagtagatttgaaactggaggtagtaaatatcttcattttaagcccttttaattaaaagcaattaaaaattccctaactaggactttgtgacaatttactgatggtcatctgaatctaaaatttgtgttatcagtaatagaaatatcctgcaattcagattttccataatcggctatgggatttaaaatttaatggtgggattagaattctggtaggattcaaatttattttaaaagctttaaaatgccactttataaccaaataataatacatttggatgtctccttaaaaccaaatgaaatcacacacttttacaatcaggtaaaagtgtttattctatttactacacacacccagcaaattccactgtgctgtcagtggatcaaatattgccactatcataatctgtagaaagaagaaactagaatatttaagtgaatagaataatactggaaagttaaattattacggaattctgtgtttaagaataaaagcaatattgctctttttcttaaaatctatcaataaacaatcaataagctaatattttccttttttagaatactatgtgtcagtgtaagactgttctcagtgcaaattttttccaatctctcttatctttattcagtgctgaataaaagaacattgtaaaaatccccacattttgcttaaaaaagagaatagtatgctcttttacatgctcttcttgtaggcttgacaaaagaaagtatgatttgtcacattactgaatgtctatcagtaaagcaaatgcactaattaatcacattatattataatagaaatatcaattcaaagtatagccttctaatttgcttctgtgatgggcaaaacttgctaatggtgcattggtacatatttccaaaattcagtcagttgaaattgtttctttctaaaatattatttaatcagatttgattagaagggcacatgaagtgacagggtctcactttgacattcatctttggaggataacaaaggaatgtagtataaaatgtttatccttatttcattttttttcctgctaaaatcactgttggaggtaggcccatgatattaaaatggctagcccttgctccatagttgtgatttgtgtttttaaatatcaattattgacaggtatcataattacagctacataggcatccaatattgatgtaccagtattaattaattgaataaaacatttttagggtgagatttcctgagggtttcctgagatttccggggtgagagttcctgagacgaatagctttcaagaggaagcataggcagagttttgagaactaatttaagcctttagtagagctagatgtattgaggtatgggatgggttctatgactgtcagaatgaagactagatcctttcctgggagcacgaggaatgagggtcattggcaagcctgtgctgttgagctgcttattccttctattgtaaaggtgttcgcctctgtcttgtctttcagtcctccacaagcaacccagagaagtgtgtctctgtctgctagagcttggccggattgcagccaggtaggtcaaaccactgcaactatgtcaagacattgacgatttcagcatccaagcaacacagaagcttgctggcttttcattgctaatgtttaacctggatgttgagaagctactcattcacgatgataatatgaacttcttgagggcagcagttaaccaaattaaaagtgtgccaccaatattcctaacctcaagatcttgttgtcaaagccactatgtctaagcatttgctaataaaatacattttccctccaaaactttcctggggaggggaggacattgtacatgcagttttatatgacagttctccttagtggaaagtctattcccatattctatcttcctcctccttcacctccttgcttcctttttactttttaataattttcagcctccccttttattccttttcttcattaccctcattcaacactttgctcttttagtttccacttctgactaggatgatagttttaaaattatctacatttttattaggaaaagacatagaatgttatccttatgtagaagcatctttgaaacctgttttttttctgtaggaaggaaaaacaagaattaatttcagaaatcatagctaaataagcagaggaaggaactctgttagctaaagcaacttgctttggttacctgttttcccatttattatcttgcataccatcagacagggcttctggccagcccatgaagcccaaagaacaagaaatgaagatacaaatgtttgaagaagtcttgatgcaaattaaaaattcaagattaattagaaaatggtttcttatccacatctgggtatacttttagggttgagatcagatgaataagtaagataaagtgagaactaacactgaatgaacattctcaaagaatttattaataaaatcaagaaaaaaaataggtgaacacaccagcaatttacaacttggctagaaaacttgctgccaattaatagacctttctttgatccaatagaaaattaacctgtaatcagaatatgtaacctcaagttctttaaatcatcatatcaatataatcttcatgaattgtgcatcgggtataaatttcattttgccacaataattgggtgtgcaaaagattgctttaatgtttttcaattcaaattaaatatttttgagccttacctcaacatggagtaaaaaaacaatttgagacatgtgaaggtttttctatttaccccacactcttcccagttaattgtgggaaggcctctgggggagaactctctagtcttggtcctttcagatgtctactgctcaggcatagttcaaacttgtggcatctggctgtttcttaggacttcgttctctatcattgctgccacatacttgggttctgtgaaggagcaggataaagatatacctcttgcttctagcacccggccacacctactcccccaccaaccttggggcttctggcctggaagacaaatggccttaagtcaagtgaaaaccaaggactcggcatctattgcttaagaaaggggaagttggccgggcgctgtggctcatgcctgtaatcccagcactttgggaggccgaggcgggcggatcacgaggtcaggagatcgagaccatcctgactaacagaatgaaaccctgtctatactaaaaatacaaaaaattagccgggtgtggtggtgggcgcctgttgtcccagctatcgggaggctgaggcaggaaaatggcgtgaacctgggaggcggagcttgcagtgagcctagattgcaccactgcaccccagcctgggcgacagagcaagattcgctctcaaaaaaaaaaaaaaaaaaaaaagaaaggggaagttaaaaatacaaggggtaggaaatcaaactaaataaaatttcaataaatgaactgctgccaaggaaatgttcaagtaaaagaaatatggattgtctagagttcctacttaaagagagaacagacaaaaaacttttttttagttgactatcacattagaatactctaaaatgccagatataatcttgttacttaaatattctaaatatttcatcagataagcctcttgcttctgaaagttgtgatacagaagtaaagagacggggttatactgtctctagaattaggtgggatttataaattttcctcccatttaagtttatagcatttgccttatttctggattttattttatatattgttattatatattatattaaatgagcacggtgattagggagcccgctgaataaacattttaattatagccaagtcatcaaagaagaagacaagctgcccaattagaaaatgcctttaagaatcacctttcctccagctccgagtctggcataaattgccccttgttacaggatgtaaaacaaattaaaatcttggttaatgaaagtgaattataatggccttgtcattttcaaggtaatacattatgtgaatagttcctcccacccaaatattttaaaattgtgatttgggtttgttccatttctgaccatgattcatttccacgcaacctgataaaagcagtgattattcacattaccaaaaactatattatggattttacaaaagaagttccataaggattaagataacccttacattaaaatatttaatttgtaaatttggccttttatcttcttgactcaacttggatggtgtgaactattgtgtaccttcagcaataaaaaaaatcctaataaattattcatggtgctactattattctagtgtgtgacatgatggtaaatagttgaataccagtaggatagattgaacatttaagtaagaatgtcttaagtttctctctggatacatttaaagtttttttgattttgttgcaaattcaaacgtgttttacaaatggcaacccaataaactcagatcttactgttttacccctgtgttgaagcataattagttgaaagaaaaaagggaaatttctcttaatctaattttactcctaaattttgccttacatacattagacatatatctaaatgcttaaatttgtgcttctcacagacccatagaggattatacaaattaatgacttaaaacagttttaagcagaactagaagtgattttgggagagctctcaataatcacaacagtaatttgcacacagagcagatgagtttagaccttaatgaagtctccagtacaatcttgtgagttttgtgtttttcatcattgatagacgatgtattcttatatttgattctaaacacttttccagattacataaacataattttaaaaccataaacatcactttggaaatgattcccagtgagtttctgattctctgccatgttttcctctcgggacacttaggaagctcctttgcgagctgtgggcttctctgagttctgagatggctgaatgagaccacttatttttgttctcatgggtaaaacttacttttattttcaactaaatagagctatcatcactgaagagtgaaatccctctgctaatatttcagaaaaatatcagtttctgaatataaaatatgtgtttgacttgtgaaaagtaaaactctgtgtaaaagcaagttaataaaacctcaaagatatttttactgacagtgttttgatattcattgctgaaaacaaagttagtataaattcagcattttttgactgtagaattaagatgatccttataatagaagtaaaaaaaaaacttttgatattttcgtttagggtcataatcaataatcagtggtatagtggagttttttatgaattttattttttagtatttctttgatttggagcaaaatttatgatcatttaaaagaaaaatactttcggaacattttctttaatctgtgatttttattcattaccttttaaaaggaaatgttacttaaaagaaaaaaatattcttatacaaagatgattaactgacccatcctatttaaagcacttgaactaactgctgagaacatcatatactttcacatggttgaaatttccttccaaatctaaatcaatctttaaattgctttaaaacagaagataaatgaggaaaaaattatcttgcaggaatctataaactgtctgttatatgccttaaaaaggacagtttctcgcactaggctgtaaaatttgtccctctaaccctagtaaaataggatccagatgtcttttgtttgaaaactctagactactaaatagtttgagtaaattttctagtttaggcctcagtttggggtcttagtaattttacctagagctcaaaaactgtgtcaagtgccagaaaaatgagaaatccattcctaaaacctcatcataaagtcattaaccataagacctgttccctatcactttaaaaaaaaatgagacaaaaatatgttgccctttgagtattcgccctactttcattatcactggggtataaaggtatgaggatatgattttagtggattctaccttcttggtctctttagtgtgacccttaattagtttgagaacaacagctaccccattctaaaactctgaaatcttgtggttggaagggagtggaaaatactataaatgtgtgaaaacctcattgacaaaataaaaatgtggagtggtatagagttcatggaaaccagaatgaagcagccttttggagaacagaaaaaagatctatttgatgactaagttgacttgcaggtgcaagcccccaacccaaagggaattttgtgatttacaatctgttgacatctccagacagacaggaagccagtgaatcgtatttaagtatgcatttcaggactggctgactgtaccttaggcagtttgaagtattcaaaagccaatataagcagagatttgggacttagtgttgattttttatgttcagcggcataactaattttcagcattcccagataaagaaaaatctccagagaaaggttttccatgtgtgactttgttaccaattttattcaaacctagtctactttgtttatattggacatagagccaagtctgttgttactcgaacataagtattattatttcactttgtaaaaaaatttaaaaattatgcaatctattcctgaaaggtggcatgaatccacctacaattacaaatgaaatcatattttccaattcacctaatttaagtttcaaatatgatatttttcacttatggatgacttttaattggctgtgacttctcacgtcttaagttactctagcctcactaccaagtttatgctattcttttaagaccattaaacataaccaaattttatagcttcctggaactaagatggcagaaaagtttacagagtttaaaaggggttgcttgacaaattttacccagtgagttagtagcaaagctgaatttataacttgatctgctaaactccagtactgagatagttctgacatttcacaattctagggaaatttatttaaagaatgactacagtaaattttttggtaaagaatataataatattactttgtattttaacaccttaattttgaagttaacatgatgtcattcagtggtataatatattctaaaaaccaagaattttagcaacagaaccttagtgctgcagtttccagattgtacaacacttaatttgtcaattaacttatcaacaatctcagatgttgtgccatgtgtcagagactatactgggcacatgaagtacactatttaattccttctaataatactaaaacatagaaattagaatttccattttatatttaaataaaactgagtttcagaaataatatatgtcaagatatccagcaatgtcagatgcattgaagatgctcagtagcagttgcttttctaagattcttcctcttgcctccctccctccactgctacaacagaccttgagaacaggccattttcatttctacttttctgatggaaaatagactcatcgaagttaagtgatttgtgaaattttagaagtaggttataaaggaaatagaagaataagaacaaactaacccaaagctagcagaagaaaagaaataactaaaatcagagcataactgaagaaaattgagaccccaaaatccatgcaaggaatcaatgaaacccaaagttggttctttgaaaggataccaagattgatgcaccactagttagactaacaaagaaaaagagaagatccaaagaagctcagtcaggaatgacaaggatgacactgtgattgatcccgaagaaatacaaaagatcctcagagactattatgaacaccctaggtacacaaactagaaactctagaggaatggataaaatcctggaaacatacaacctcaaaagattggatcaggaaaaagttgaaaccctgaacagaccaatattgaattctgaaattgaatcggtagtaaaaagcctaccaccaccaccaacaacaaaaaagccctgggccagatgagttcacagctaaattctaccagacatacaaagaagagctggtacctattctactgaaactattccaaaatttaaggaatagggacacctcccaagttcattctgtaaaaccagcatcaccctgattccaaaatctggcaaagacacaatgaaaaaagaaaactacaggccaatatttctgctgaacacaggtgcaaaaattcttaacaaaatactagcaaactgaatttaacagcacatcgaaaagttaattccccatgatccagtaggttttattcctagaatacaagattggttcaacatatgcaaatcaataaatgtaatttaccacataaacagaattaaaaacaaaagccatatgatcatctgatagatattgaaaaaactttggataaaatgcaacatcccttcatgataaaaaaaaccctcaactaactagacattaaaggaacctacctcaaaagaataagaaccatctatgacaaaaccacagccaacatcatattgaagcaaaagctgggcaaaaactggaagcatttcccttaagaaggggaatgagacaaggatgcctactctcttcactcctattcaacgtggtactggaaattctagccagagcgatcaggcaaaagaaagacataaaatgcatccaaataggaaaagaagaagtcaaattatctccctacaaaaaagtaaaataaaacacctaggaatacatctaactagagaagtgaaagatctctacaagaagaaccacaaaacactgctgaaagaaataatagatgacacaaacaaaggaagaaccaatatcattaaaacggccatactgcccaaagcaatctataaattccacaccatttctatcaaactgcagctgtcatctgttatggaagtagaaaaaagtattctaaaattcatttggaaccaaaaaaaaaaaaaaaaaagaaagaaaaaagcccaaatagcaaaagcaattctaagcaaaaagaacaagccagaaacatcacattacctgacttcaagctataccctaaggctacagtaaccaaaacagtgtggtactggtacaaaaacagacagaacaatgaaacagaatatagaatccagaaccaaagctgcctacctacagccatctgatctttgacaacattaccaaaaataagcaatggagaaaggactctcttattcaataaatggtgctgggataatgagtatccataagcagaagaatgaaactggatccataccaatcactatatacaaaaattagctcaagatacattaaagatttaaacgtaagacttcaagctataagaattctagaaaaaatcctaggaaatactaggattcctaaatactagagtaaatctgcaaaagcaattgcaacgaaaacaaaaattgacaagtgggacctaattaaactaaagagcttctgcacaacaaaataaattcaatggagtaagaagcaacctacagaatgggagaaaatattcacaaactacacacctgacaaaggtctaatatccagaatccataagaaacttaaacaattcaataagcaaagccaaataacatcattaaaatttgggcaaaagacatgaacagacacttaaaaaaacatacaagtggccccaaaacatacaaaaatattctcagtatcactaatcatcagagaaatgtgaatcaaaaccacaatgaagccaggcacaatggctgacacctgtaatgccagcactttgggaggccaaggcagacagatcactggaccccagtttgagacgagctccacctctatgaaaaattacaaaaactccacctttacaaaaaaatacacacaaaaaatttagccaggcatggtggcatctgcctgtagtcccagctactcagagggctgaggttggaggatcacttgagcccaggaggtcaaggctgcagtgagccatgatcacaccactgcacatcagcctaggtgacagagcaagatcatgtctcaaaaacaaacaaacaaacaaacaaaaaacccatcagttactggtgaagctgctgagacaagggaagacttatacactgttggtgggaatgtgaattagttcagccactgaggaaagcagtttggagattttgtgaagagctgagaaccactattcaacccatcaatcgcgttactaggtatatacccaaaggaaaataaatcattctaccaaaaagacacaggcactcatgtgttcatagcagcaccgttcacaatagcaaagatgtggaatcaatctaattgcccatcaatggtggattggataaagaaaatgtaagacatagaatactatgcagtcatagaaaagaatgaaatcatgtcatttgcagcaccatagaggcagctgaaggccattatcttaagcaaattaacacagaaacagaaaacccaatactgcatgttctcacttatacatgagagctaaacactgggtactcatggacataaagatgggaacaaaagacactgggaactctagagtggagagcaagggagggaggaaaggctaaacaaaaactaatttggtactatgatcactacctgggtaatgggatcatttgtaccccaaacctcaacattatgcaatatacccatgtaacaattctgcacatgtacccctgaatctaaaatacaagttgaaattatttaaaaaataaaaaaattaagtaggtcaatggaacagttagttcaaaataactcagagaagaatgagaaacaaatcttaatgtgagtattgttggtacttgtcaagagcaaggtaaccagatgctgtctagaattcagcataatcaatgattactagaaaactaaaaaaaatgtgttctagttttggacaaggttgaagtcttctagattaacttggtcaagcatttttgtacatttaatacttacatgctttattaaagccttatatgcagttagggattcaaaaccataagactgaatttatattaagaaccttatttttatatgagaatagagaatttttttacattcaaatggtagctgttaggttattgccctgtgccaagatcttatgtgagatgcttgtgattcttggaaggagacagacagtgatctctaccactatgtttgcagtctagcagtttccaccattgtcctgtcccataaactggtacctatgtacaaaagtttagaaatatgttcaatggtgcctacagtcttttagcaagtgatatctatgtaagtaaacattaatctgtgaactagagtctgttctaaaagcagtaattgttcagtagaattgggctcactagactgttttgtttaaattttccatctctcaaagggctcctaacacatagcacccctctttactatctgaattctgaaaaaaatagaaaataaaagacttgcatgtcacctttacagctaaaaagatccaagccaatagacatgcttggtgtctttaacagagctccagaattaggccaactaactatctagtcacaagcaaagtggggggtccatgtggagggctcccggtggacagcttcttccccagaagtagggtaaactaagtaaagcatgctcagtttattcataaatttactaattttataaatccctttatcttgtagtggatgggtaatgaagcagaaaagccaggaataaaactacttgagcatccactgcaaaaacaaaacatcaagaatagggaaatcgctttcccctcggagtatgtactgaacatatgtgtaatggtatcagttaaaataataagcagttagaataggacaattacttaaggttaaatctaatgatgttttcatatactgttcaataagaagtactaaaacattgtcaacatattctctatctatagattatttactttgtatattttttaaaaatagataaaaaagtagataatagtagattaaaaaaaacatgtttttaaatctccaagtgacttttcccctcctttttaacacccagtcacctgattaaagtcagagaaactgcatttaagtctttatcctgctccttgctagttatatattttctctagatctctattatctgtaaaagtgagagggtgtaaattgatgatccccaaaacccttcacaactctcaaattctagaattattattggcctcccccacctaggtacagttgatatgtacctaggaaaccaaatctaattttatatttagctaaagaaatatatgattacaggagatagtaactatgtctctccctttgaacttttctggcatttataatttgcaaaacacatgttttatacattgttactctaaattatgtctctgtttcctctatgctcagttgtttcccaaaacaatatatatgctttcattatgctattcctaggatcataacctatgacattgtataacccatagtacaatgttctggacccataggaaatatattcaaagttaattcttttctgctaaatcatttaaagatgtttatttctggggattgctgtttgcaaacttgagtctgaccctctggttgtatttctatttttaacaaacttaggttcaaaatagtttcattacagcactagtatcagtaaacctggtaaatgtgaatgctgaagaccaaatttacatggttattcatgttgctgtttcattaatatattgcattgagtgtttttatttatttttagtatactatgtgtgtccatatatgtacacgtatgcatacacagcaggtatacatgttttgcctctgcttagaaggatgctaattcaagagcttacaatttcaatgccagaaaaaaagtgaatgttatttttaaaagtcagtgatttactcccatggtgctcatcatcacatgtaatatatggtaattgtatcattataagttatgcatatgtaatgatccagggtctttttaaaggtatggtgtggagcctcctggtttgataaagctggaaaaagagattgaacaagaagaaacactttctgccccttctccttcaccttctccttcatcaaagtcttctggaaaaaagagtacaggaaacttactggatgatgcagtaagtaaaatcagtcagacttcttaccaacggttagtctttcttgcactacaaaacatattctgtgcaatctcgtatcagtctaatctttacctatatcaattttcttgaaatttattttaagcccatatgaaaaactttgtagtcctacaattcattttgagattcaaaactgaactagttgttcaaaataaagtgtcatttaatgctgcagaccaatatctaaaactttagaataataagtcaactccctgaaaattgtatttgaaaacatgaaagtctctttgtcactggatcaccattccccctttcacagatgagaagtctgaaaacaagatcttgaggattgttaaagaagggaaagtaaatgtatgatagagaagttaagtgccttttatggactaccattgtttttcaagtgctctcatatatgaaaggcaggttccctcttgagaaatggaaacatagaaattgagtaacctgctgaggggaggagaggagcttagattccaacaaaagttttgtctaactcttcaaggtcgctctacttagcagagcccttgagtcacaatttttggtagttaggaaatgttttaacagaatcacagtaaaccgtttttaggtataacagcaaacatggtgaattaaaactctcaagtgaccttggttgtctgttaagtagttattggttatgaaaagtagtgtgcttgagtatgtgtgtgcatatgccctccacatatattttaagtgcaaatataaaaaaaattaataaaggagataaatcatgagtgactgggatgttgtttatgcaaagtttgtattgtgggagttgtagttgcttattaattttatagaaaatggcaatgccagaggcattagagtgacgtatgtctcacatacatggggagagtccttagaaactagcaccaaccacaatgccagctgtgaaaataggcagaactgaaaaggactggtggtccatagctgtgagtttcttcctccaggatatgagcagaaaagagctgggaaaatggttggacactacaggatgcagaaaaagagatttctctgacttttgcttttctccatgtgacacgatcaactatattgcagatttagatgagccgaaatataacagtttgtctgatagattaagaaccctcatttctgttaagggcagcaagcatattagctcttaaaggtatcttagctagtttaatttggtttcttctgggtaactgttcaatcactcaggaactaaagaagaacaggaaagacattttgatttaaagctactgaaaaggattttaaaatcacataacttttttgaagaattggtcatataccttgcttttcataggatttcactttttattttgtaaggaaattgagtaacattatattattagtagataatgatctattgtttatatattgatgagaacattttttcttctgtgtcaattatactttttttattagacttactttagggtaagatgtacctctagtctttatgttataaatatatttccctggggcaaatatacttccttatagtctatttcctttcagctatcaccttcattcatttttttttaaatgccttatagtcagggttccagaccactaaagagtatctggctaatgtccctcttatcctcctattgaatgaattactggatcaaatgaatttttttagtccggaaattatgagattgcttcctggtatttgacactgttgaccactccattcttgaaatgcatctctacaacatttctgctaccagaaggataaaactaaatgcactttggacttgattaaaattatatagggtgctctataacatttgggtgaaatccaagctcgttcatatgtcatatagtccatagccctccatgttctggcctactgtgtgttttctggctattttgtctgctgcattagtccctgaattttgatgtagccattgttgctttctcactatacttctgcctactcacctgttacactacttttaaacacctttccatcttttaaaattcaggttgtgctaccccctatataaagatttttctggtatctctcatcccaggtataactggcaaatcattccttggtgctgccaagtatttgtatctatttaatgaagcatttacctttttgggtataaatgtcctttcatctcaaggtgcagactttgtactcaaagacaaagaccatattttatcgatctacatccagtactgtgttttttggatatattatcaatgtagctaattaaggttgaaacttctcccttattctgtttatccatgttggccacatgctctggaaatgcatgcacctttcatttctactgtagctttttagagggtggagatgctgccacttgaagctatttctgtgaacctagaagtagctaggatgattttctttcttcactagcttgtcccctatctggcaatccttgagatggggagaaaaagaagagagggcaagaaggtgataggaaaactatgaaaaggacttcagagtttaccaatactccagttcagaaaaagagagtgaaataaagattttccatacaatagtaagccagtcagtcaatacatggtggttctcccctactcccaaattgtatgctctcagttgagaacaatggaatggatttctcaggagctttaagccttcttcaaagtttaccagaatttagaacgtaaacatctgctcaaagttttaatcaaatgtaggaaatatacaatgtggatatttctgtaactttgtcagctagaatattatgtttcacaagtctttaaaatggcatttttcaatcaatgtttgatcaaacacaccacggttaaattagtttgaaaaatacaacttactatatatagattaggactgtagtcctcatgcagagtctggtgataaactttggcatatcaaaggctctagtgagttccataataagatcttgtttaacctggaatcttctaaacttatttgaccacagaagtctcttattccttcattttacactggggaaaactgcattgaactatttgcattctgtttgataggtttttttttactgaagtgttttatttcaggaacagtggagcagagagaaaagtaatctgagcttcactaatgttttaaatcagaaattaatacatctaatataaaaggaaattgttcctatagtaactgcttcactgcatgtgaggcacatatagcagttcggggttgaaaatgatgtactccaacatgggttttagaatagaaatataaaatagagattgcttgcagagtttctgcgtttagttaataatattggctaattttactctgggaaagctattatctgccaccccaaaaaagaaaaggaggaggaaaaagagaaagaggaggagtaaaagaagggaaaaaaaaacaagaagaagaaaaaagagagaaagcaaaagaagcagatctgtgttaagatattatagtccagtgaacagtttcagcaataactgccagttttgaaaccttcaatgtttcttcacatttctttgtttgatacttaggggaatagtgggaaaaaataggtgaccctttatgtggaaaatacatcaccttctttaatcaagatatcatgaaagaaacacagtggtttccattcagattaatttattctccagatgtcctgatagagtgattcagctgtgataaaacggtggagtcaggtttagttctcctcttcgcgagctagttctcacacaatgagttgaatacagttctcagaaatcattcttactttcttcctcttctccatcaacttcctcagtctggggatgagagatagtataattctgagtaatcaggctcctcttgaaatcccatttcagcagaaaactggctgggttcctagccaaaaaagaacacctgccagactgacttttccctaggtaatgtaagaagcacagatgtcatcagtcactgtttacttaacaatatatttccactggccacagtctggccttgtttcttccatttctgcttccacctctcatacaactacaaaaacagcccttgacttttaaaatgaactccattttcaaagctagaaaggcatttgagaagggcaggccacttgagaaaatgtttcttgtattttatttcatttgataccaagagtttctgtcttttgtctaagaagactgcaaaatggaattactttccatacagacttgtgattgtcattttttagtggaggaaccagttgaacatcaatttactctttggttaattaccacatggcagcaaaattgtgccaagcatgatcctcctaaagttcaggcctcaggccatgtgctttcttgatgctgtcagtctgattttcttctggatgatcgaccccttctcccaatgcccctccctttcttcatccttgctttcctcatggaagcccttatttgtggtgataaggaaaacagtaccacttctagcaatggcataaacatattttacatgtatatacacacatttatatttaaacatattttataaacacatatagaaagagatacacatagaaaaatactgaaaacaggaactatagacaacattcattggtcctgtgaccctaccctcagtcctagaatgtggttctgcattattggaaggaaatgatgtgctctttattcaacttttatatatcttgttttattatcatcgtcccattcagaaataacctttcaaaaaatctcttagaacagaaatctattagtgttggggtgaatgtatctatagaccaagtataatatgacagaacaaactcagaacacaaagtaattgccctaatcactaacttaatgttaagtagttttctcattttttgatgaaagctatttttaaggttctttgaatccatgattattttgttcctctaatttccccctgtgacctgtatagattcatgttcttatatatctatttagtcaatgtgtatttaatgaatatttatttgccattaagatgtgctttacatcaatgattttaaaatataatgaaataccatcttaactccaaaggaactcagtctagcaagaagacattaaggttaaccactaaatgagatacaatatgctatgataaaaataagtgccaaaagccataggtttatatgtcagcaaaattaaggatggcaaaaaggactaatggcaatgtatatattaaagttggttcttttgttcttttccccccaaaatagtgttggttctctttgtatacatcctcactgagtcataattgtacatgcgataaatttatgagataaatttaatttcagggtttttttcctttttttttggttattcttctattgtcttatgctttcaaactttctggaacatttcttattctaggaaaaacaagttgtttaattcctttacattaacattcaattgagttcatgttttactctctgcacagtttttgcttagaaggctgattaaagtcaaaaatcgaattatttgaaggaatgattgcatttctttcatgacataaatggggtagaccccatgacatctttgtggaagaattcgggtgaggaaaatccaggccaatttctaaatttgttctatctagcttctaaattcagactgcacatcatttacggctttctgtttcttccatggaaacttttcctcaaaacacaggagattattgttttgggttgtttggttggttggttagttgaagagcagacagagtgggtggttccccatcagggaaaacataaacataaaattgttcctaaaatcgtggactattatattatcatctagtaatcacaactattcataagctttatgcacatatcatttagattatgtatttttagaagagtgggagaatagatataacagggataaaaatctgatattcaggcatcaattacatagaacacacataagctataaaacatggtcaaagaagtagggtttgataggtaggaattactgagatggagtgagttgcagggtaaatctgagtatatgagagattaattcttagagaaaatcttagagttcaaaataagatgaaacaatagtctccttaaaaaaacaacttgttaaactcactctcatttattttgaaactgggtaaaattaatatgattaaaattatactgaagtaacataaactctatgttaacatactttctattctggttttcaataggttgaccttgacaacccaaatgtgcatggtctttttagtcctccaaaagtaggaacccagctgattatgtatagtctataatttcagttggtttcctgctcattatcctccagcatcatcactgtcattagctaacttatgccttagtgcagtcatttgccttcagatgtctttggggcctgaactttacatggttatgatttaatgtgatattcctatgctcacatgatgtccatagataaataacaagtttaaagtcattaagggttcaggggccgtggagtccttggagcaaattaacataaatgcagcctaattaagacaaatgaatgtgcctgctcttctatttcaggtgaaacgaatttctgaagatcctccttgcaaatgcccaaacaagttctgtgtggagcggctctcccaaggaagataccgagtgggagaaaagatcctcttcattagggtaaagttttacttttcacttatcttgtttttatgggaagattcagaatttgagttaggggaaatatgacagataagagcaggaacttccatatggtgcttacgtttaaagatacatggtatgaatttttttaaagtaacatacattataatgtactactgaaggctaaatacaactgttttctctttgtacatataccaaaacgcatatacaccaaagacaccatggagatcaaatagatgaagaaggctttccacttgtgttatgttttgctaagaatcaagataatttaatctctcaaagtaagtttgtggcttttactaagaccaataattctttttttaaaaaaaagaaaagaaaagaaaatgaaaaatagagatacattcctagaaatctgcagttgtaaataaaagtaatttgctgctttatggtttagtcatttctaaaggaacagaggttgtgatgttttttaaaaaagctatattctttcctcagttgaaaaagttaaaaaatatcctgctgttttgtagaatagaatgatttgaatacgtacatctagtaccagcaatgtgtagtctcacaatactcaaatctgcaatgactctgttgaaattttgcccttgtaaagttttcttaatttctacttttgaccaaaacttattggtataacaggtctttttaaaggccctgcaacatgtagttgcaaaaagaaagtttaatcataattttagccttaaaatataatgttaatggttttgaattttaatctaattttagattagcatttactaatatatttcttaaatttccaggaaataattgctattctgctttggaatagcagcaaaagtatataacaatgtgttattattggagtatgagacagatctgcgtagatggcctcactaggaaaggcagttgtctgagttgcttattgttcttttgttctttattgcaaggatagcatacatattttgttaagtcaaactgcctgctgtcatgttagtacattaaataatagtgatctagaatctccacagatgtgtttaaattttaccgggttgacctttctcaattgataatcagtctcctttagaatattaggctccagagcttagaatcaaaacagagagagtcatttgtttaaacagttattcctttttgtaataaaagtgttaataaagcacatgattaataaattatatacttctccctgcaatgtaacctaatatcttcagtcaaaaatatatattacatatgtttatttgcatctgtgatttcagatgcaaatttagtcatttgtcaaggattttaatgtccacatttgtgaataacatgtttttatagtccttactatataaggcaggttttttgatattccatttttcttttcaagaaatagttatcttttgattaaatctattcatgcattatttatagagaaattgagatttgctgtactgaaaaaattgtatcaaatttcttagggatattaatttaatatcaactaatacataagaacatattgtgcacactcagtttcttacttctaatgttccaggtgaacctgcaataagagagttaactgtgatgtggttattcactgattagtccagcaagtaatggcatcatgctattatgacatgttttagaatagtgtcttaacgaacgttaatcatttattctcttgatttttatactatccacatacaattttactatttttataacatttccctttaaaatgaaacgttttttaaaaacttaatttttagcaaagataaatttctgtcactgcctaaattacaaaccgaaactatttgtcaaaaaaggaaaacattcttgaacatatattgattgaaatacctatcctttggcttgtcataagttcatttccaccctgaaggagtaatatgattctaaaaaaggctcctgtctatgtgtctggttatccgtggaggcttaaaaattaaaatttcataggtaggtcacatgtgccttgaattgtatatttttccctatttcctcctctgtgttaactagaaaaactaaacatgtctccttgatgtgcatatgattatgctagtactttcagtttgtggtagggactatatttaattgattgccattctgctccttactaatgtaaggaactggcagttactactcaaaaaatctcataggtattgaattggttttcaaatgatcatatggttgtcactgctaatgttttaactatatttccttgaacacctggattaagtagtaagtgcctgtagtcaaattctcacacatactaggtgaacaactgcctcatagtgtcttcattgcagttcttgcatttcttaaatttgcatctttcacatgggcgtattttaaactttgtcatatcttttttgaggctgcctaatacggtcatatttactgacagtatttatgtatattattctataaagtatacatacaatgacacatacattgtgtcttaacatttgtcccctagttagttgttcaccctgagagcagcagtgtattcatatggtcataatgaacctgtccaatgcaaagaacaattcagggtcacttaaggctaatgagactgtttacctttacttaaagataaaacaattaccagaacactaactcagtaagaattgttccttaggaagtcatagatacgccaggcacagtggtttacgcctgtaatcccagcactttgggaggccgaggcgggcagatcacctgaggttgggagttcgagaccagcctgaccaacatggagaaaccccacctctattaaaaatacaaaattagctgggcttggtggcgcatgcctgtatttccagctacttgcaaggctgaggcaggagaattgcttgaacccaggaggcggaggttgtggtgagccaagatcatgccatcgcactccagcctggacaacaagagcaaaactccgtctcaaaaaaaaaaaaaaaaaaaaaaaaaagagaaagtcatagatacaagattcttttgataagcctgtgcctaacactgttaactcttgactgatgcttaactaagccagggttaacaattccattgctaaccaccttacaaggtttgttgaccacacctaatcactttatgtgtcgacttatgattatgtatgtatatgaacatatcttccctatacattcaaacagatacagtaacaacaactatgaatgaaaaaataagaatgcctgcaaatttcaaaggaagaccgggaagatattttctgcagagaatatctttactaagcatatgtcttgtctgtgggtttctggaaaccaatgtatgaatagatacttcccatacatggctatctaatgtgtacttatgtattaatagaggcatctatgtacttttgtagacaggcttgtttatgttcatatttctccatttacaggtgaggattaatccatgcctaaatgttaagaatcctttagtacagagaaaaacctctgaggatttaggaaaacatcctaataatccattgccaaatgggaattttttttgtttctagcttatgaaaaataatttgtcaaagccaaatttttgcctggtactttccaaagagcaacattgtttttttgaactatcaaatgcagctaatttttatctatattgtgcagatgcaaatgtactctcctccaagatataaatatttcagttatttttcagtgactttgaatttggacagcgatgataaaaccttctgatttctgcagtaacagagatttggattaacagagatttggattattcccattcaaccataatacgtatctttgaaatgtaaataggtggatctcaggactaatgtcttgatttcagggaggagagaattttctcttgttcatttgtttattcagtcagttggtatctacataggcttcaagtatcaagaagtcacttggcaattgaaatccgaatgagcctgtaaaaagggacttcagaaatatgtcttagatgcaataataatgtccatggtatttgacttatcaattccaatttgatggctatgttctacctaagtactccaagttggagtgcagtgctgcggctcactgcaacctccatctcccaggttcaagcgattcttgtgacacagcctcccaagtaactgggattacagtgtgtaccatcacacccaactaatttttaatttttaatttttttttttttttgtattttaagtagagacaggaattcatcatattggccaggctggcttcaaactcttggcctcaggtgatccgcctgccttggcctcccaaagtgctgggattacaggcatgagccaccgcacacagtgtcttccaacagtaatttttaaaatggccaaagattagcagcatcagcatcatttggaaacttgttagaaatgcaaattcttggggctcccccaagacttactaaatcagaaactctgagggtagggcccagcctcctgtgttttaataagtcctccaggtgtttcatacatgtcctgaagtttgaaaatcactttaaaacaatatataggaagggattcagtgtaccaacaacgcaattcaaaatcatttgcatgtctgatcatgaaagcatattagcagtcaggtgctaaaaatgatcattttgaagacttctatgtattgttggaaggaaatgcttaagacgtcattgtaagtgaaaaaaagaggcttttaaattatatttacatataaaatagctctgtgtagaaatgattaggataaagacaaagaaaatgggaataatagaaaatagtttttatttgtcaaggacacagaattatgagtgtgtgattttttttctgttcttcaaatttctgatgatcattttaaaaatatgaactctttaaggtaaaccagcaaacagatacagttaaaaatttgagaataaattaaaagccctttgaaagttgtcaggttaattagcagactgctcatttgaatcgcccttttgctgagcttcctatcttccggaaaatggtggggaggttttttggagtcatggtattatttagactacagagaatttttgcatattgttgtgaacttatagcatatttttcgttagatgaagctgtcttcctttactattttctctctccattttggaaattgatattgtttaggattagcacctggaaatatgcaaatgtttatctactgtctggataatatgccttgtctttccttatctttgcagaccctatcagtgatctacgtactcagttttttctctactaatcattacaattttaaccatttggtgttccattcctttagggctcagtttttagtgagaggaaaataacctaatatgataaacttatctgtgctaatttatgaaatggatgcagacagccccagtgaatagaacatctatgtgataaggtctttacacttaactaagctgctctaatgttctgataataaaaatttctgacaaagtagcagccagtggggtcacatgttgtgaggtagataacattttgtgctacttggtttgctcactaatgtaatgaatacttttttacttaattgcaatttatcactaccctaatattgtaccttagggttgttcaaagtgtgttcccaagaataatagttccagaagatgttcaaaaatattatttgtaaagaaaaattaacatggttaagagttgaaacaggtttctttaattgctcttatttactgataattgcctttgttagcctgtatcagaacacttgatatatctcattataacctcccaaactcgtgtggaaaatgttgttgccatttccattttacagatggggaaactgagacactgaggttgagtaacttctcaaagttctaaggtaataagcattggaagtgggcactaaaccctggcagcttaactcctaaatttacactttttaccactaagcagtattgatcactttacctggaatttcttggatgattcaatatactaatgtgatctgcaagctcctagagggaaatatattgttcagcattttccaaatgtatttaaccatagaaatagtctccctcccacctttttatcccccagagcatcttcctgtgctaggaggtcatagaaacatagtttgagaaagacattgtcaattgaagcaaatggaataatttgtaacgtagaatttatattgaaagttgtccacatcttgccacaattaaatctcatatatttttaaggtattaaggaatatttaatttgttttcatttttaccttcaaattccatttggaaatgattttcaaggacatgactggaaaacctttaaagaaaagacagctacaatttaataaggatcgtttgttccaggcattttaccagctgctttatgtttatatttatatcacaggattctttctaaaccatacaacttggaaattgtttttatctttttattacaggtgaaaaaataaagtcttagagaagttcttaagtaagtagtaaaataagtaaaagtcaaagccgtgacttgccaaacctataacacattccactccaagctgccacctgtgcatgtccattaaatgcaaatatcttattcaaaaggctattcctctataaataatccataccttttataatatatttcatgctcaaccacagtaaagtatttttacacaatttttactttaaaagtattcagaatacaaagggcattcaattgcataatcaatagtgcctaatataaagatatatatttgcctgactatattatgacaggataaaaagtatgataatatttttgttactgtatgatggacactgtataaaattctttatgtggtctatctccttaataggcaaaattaactagaattctataataagacatattgctatctgtcctgatatcttttcaatagaaatcagaagataattctcccatattgccagtatagtcttgttgagtcttctcttgctaattgtagttattttttaagtagactggtattacgtcaagacattttcatagcagaacttcacagttggataaaataatatgaaattccatactgatgctccagtggcttaagggtatttttctagtttaagaaatatgagtacttgaggggcctaaagaaaagacaatgaataatttaattggaagtcagcaaagggatttgaaatgttatggcgttacttcctttgtactacttttaaattaaatcatcacagatcaatagaaaggtcacacacattgttattgactctgtgtaatttcttccttagcataaaaattcttcaggattatgcctgtgtggtaaaaatcaactctctgaaacaaaccaagcaagagaggcaccaaagctctgttgctatagcaactgaacttggcaatgtcttctgggacttgctctaaggaaaggtccatgatagtgggtgatattacgttcttttttgctcttatggcacatactgatttactgtgagtaaaaagtagcatggttcaaatttcatatttttcctagtgatgaaaaatgggctgttgtgtgaaaatgtaaaggagttttaaacaactagcaaagaagttaaaacctccatttatccttagtggaaatgctgcagaagcagccattactcagcagctgaaagtcaacaattcatttaaaaaaatacacatacacacacacacacacacacacacacacacacacgtcatctaatttagcaatgtatgagaatagtggatgccattttaaaattatattaatgcctagatttgtttctagggggaaaatatggccgtgtttgcttctgatgtatataaaatctcagacatttatagtgctctaagccatagtaagagaaatatgagtgctatcaatacatgaatatttccaaactcagttctcccaactgcctcaaaactaaacactaattcaggaaatgcaagcaataacatttaaaatgtgttcaaatgcttttagcttttaattcttttatgtttttgcttcactaaagacactctcatttgttttgtcatccattgatgtaatttacactttggtaaaacatatctcaaaggactttgcagatattgataaatactcttaacctatagtctctaagataggcatatgttttagataaatgcaatataagtaataactaaccattgctgtaaataattcagctaatgtgtttttttctgagagttatcctttttttaagattttttaaaaaaattttaaaaattcaaagcaaactgtcaagaattgcaccctgaaactacatccatttgacaccactttttttaaaaaagcaagaaagacggccgggcacggcggatcatgcctgtaatcccagcactttgggaggccgaggcgggcggatcacgaggtcaggagatcgagaccatcctggctaacatggtgaaaccccgtctctactaaaaatacaaaaaattagccgagcgttgtggcaggcgactgtagtccccgctactccggaggctgagtcaggagaatggcgtgagcccgggagacggagcttgcagtgagtggggagatctcgccgctgcactccagcctggatgacagagcaagactccgtctcaaaaaaaaaaaaaaaaaaagaacaaaaaagcagaaagacaatgaaatttggtatttattacaataattaaaagtaaagacaaaatccgcaaatacttttgcaccaaccgaataatacatctgggcagttttctatattctaatttaagttagagagctcatttcttcttccactgacattaaatgtgaaaaacaataaataaatagaagctcaaaaccaaaaattattcttcattaaaaacttaccactattggccatttagcaatgagtagatttttcaatagtgtctaccttcacttgacctaataagcattcttactcatctccaactcagttagcaaggtttaccatggctttaaattgtgcaatacacatgctaccttacttcagtttgaataattttcttttgccattatgctgtatctagaatcaatgtacaattgctttttcattggccacaaatcatattaaggaagcattgaaaagtcaaatgacgtcattgaaaaactgcacagcttctataatctgcattcccgatttctgcattgctatgaccttcctgccattaagataaatttgttccatatatgtgtattttatatctagtgatgttgtgtgtgtgtatatatgtatgtatatatagtgtatgtgtatattatacagatagacacacacctccatacacatacaaaaaatatatacagaaatatatgtgtgtatagtgaaaagcaacaatatagtagagagttgaaccggtccactgatttgacattttaactgattttaacagggatctcaggttgatttttctacaactgaaattgaaatcccaagtcaaaaattttgtggaaaaatacacctttttatcctatatttctatatacatatactgcattaggccattactgcattgctataaagaaatacctgagattggccgggggcagtggctcatgcctgtaatcccagcactttgggaggccaaggcgggcggctcatgagatcaggagattgagaccatcctggctaacactgtgaaaccctgtctctactaaaattacaaaaaattagcctggcgtggtggcaggcacctgtagtcccagctacttgggaggctgagacaggagaatggcgtgaacccaggaggcagagcttgcagtgtgccgagatcgtgccactgcactccagcctgggtgacagagtgagactctgtcaaaaaaaaaaaaagaaaagacagacctgagattgagtaattataaagaatataggtttaattggctcctggttctgcaggctgtacagaaagcagcatctgcttctcaggaggcctcaggaagtttctatacacggtggaagaaaaagagggagcaggtacttcacacggtgaaagtaggaacaagagagagtgggaggggaggtgccacacactttaaaatgaccaaatctgtgaactcactcagtgcgagagctcacttatcaccaaagggatggcccaagccattcatgaggtatctgccctcatcatccaaacacctcccaccatgccccaccttcaacattgcggattacatttcaacatgagacatgggtaggagacaaatatctaaactgtatcatatactatttaatactcaccaaatgctttctgtgtatctgttgtctaagtgctttcctcggattcttttttttttttttcaaccctcacaactctttgaggtaggcactgttgttatcctcatagtaacaataaggaaattaagtgttagagagcaaattgcttgtcagagattacacagtaagtgtcaaagcctttatttgaatttaatgtatctgatttcagagcccacggttttaattatatgctattcattccatttcagaccatatagacatttggcatgtcattttgtaagtattactgttcaacttttaaaatccattagtaatttacctatactcaatgcatagctcctagtttgcttattcctttgcctatgtgctttggcaaaacaaggaatttaacagccaattcctattctagagtcaaaaaacaaaaaagcacccaggaaacagaatcttacaaaacagcctcaataacaacaacaacataaactagaaaacccaacaaaaatagttcagtatagttatttattttcttttctttgcttgaaaagtcttccagaaacaaaaatttattctaggaatgaagaaactaaggaacatttacaatttactacaattataaacttatatttatggcctttggtcagttaagattaaatcctcttaatttcaataggtatggaaggattttctgagcatgctatggtatggcagagagatgaatttgcattttgtatcattttttacttttattaaagggtctaaactaaacatatgaccaagtgcaaactgaaaacgttggcatagcaactaatgctttgaaagcaagtttcctaaaattgtcaagtaatttttacataacattttttcttaactgtttttgtcttgtttcttgatagcagtacagatatctttcttttatattgtttgtaaagtactttcattttatacattatctcattttagcttaattattactgtatgacaaaaatgagtgtgattgttaatttataaaacttatcgatgaagaaactgcagctaatagaaatttagtaattttcctaaagtaatcctgttagtgattgatccaggttaaattatattatgaaaatttatatctaaattttatatgatttaaacttcacacagcaaaatttccttttgaagtttttttttaaaaaactttgtataaatgaaaatagttcttcactgtgtttttgattttggcattgttttccttaaattacaaagcaaacaatacatagtaatgtctactcgcaatgtttgtaagatttttcttttaactttctgtagacatcctgacaaggatatttctttgtttatatgttctatactgatatgtgaatgattttttttgcaaaggggaaagaaatgaaataattatgcataatgtgttgtgttcttgaataactgatgagtcttctagctgccaaagaaaaaaacctgtgaaataactgtcatataaattgtctatagttctcccatgggttcaagttgcataaataggatgtagctggattcagtaagaaatatgctttgcaagtgtggccattttgagtttgtattgaacatagtcaagcatggtggaaatgctgctgttacaagattcactatgataaattaggattcatttatttagtgctatctttttcataaacttagtgagttaagtttctacatgactggtcattttagagcttgtcttgcatttccctttaatacttgacattttgaatttcaccacctcagtaaaaacgcataatcttggtcctggacccagcaggcacctccttcatctaaacggccagtccttccattgcaagaggtttactgattcacatcaacttttagttcactgaaatggtgtattaacattttcatttgaaggctgggtgtacagtgtttcatgatatagtctgccatcttgttagaagcagaataagatcttaaggagctctttatgtaggttttgggaggaacagtgtgtgaaaatttgggtttacatgttgtcctaggaatatatcattcaattttctttataaagaaattccagatgttactaaaacaacaacaacaaagcaaaatgacaacaaaagccctggcaaggtatttaatggcattttgtctatttctttaaacaaacaccagcaataagaaatcactacatcaaggtgttattcatctcccaattgtagctttcttttacatcactatctcttttacacaccagcttttcatgccaacttctaatctcccagcactacactcacagcttgcccttcaaacactcttgccaattatggaaaactgccttctctctaggccagagtacttgatgatctagtttatgttataggcaagttttatgggaccacaaactccgtgggaacaaattatttgagacatcaccttgtaatgggctttctgaccttttgttgttgttgctaaaccaaactatccaatgttttattatttccttttctcagaaactcataccttggttcacagtctctaactttcactcccaacatagttcatttgtcatatttttcctaaagtctggcttcatagactatggaggaatgcagagaaaatgaatagtctttctaagatctcatttaaaggcagataaaaggcaggcctgatttcaaatttgtcttctagcttttgtattaggcataaggtctctaagaatttcattccagaaccatgacatgcagacaaagtaacacattaatttgtcatcatctaccaatgataacattcatgctaatgttactcagtcctggactctattttgataatcatgctaagatcttaaggaactccttatgttcctaatgaggtccagggttaatagaaaaagtatggaaactcatatggcagacagttttattcacatcacattgcctgtccacctggtaggacttaacctaaggtggtctttagcgttgcccaaggaggcactttgaaccacaggatatgtgtcacaaaactcccctcccagggtgatatttacaaaacaccttatacctcctactattcctctaacaacctatagccaacatgacaggcaggtaggggcatgcattccaaggagcagagcaaggaataacatgtccaaccttgaagaatttatttatctcctgtatttccccaacatcttgtaacaaaaataaatccaccaataagtactgaaagaattccaggtgaacctgaatgttaattgacatcttggcaccagtgacatgaacaggcttttccctcatgtacagcactcatagatctgatagataacatgtatacatatatcaactagaggaaaagtgaagatgaaatattctaaagataaaagagaaagtagccttaaataaattttaaaaattacagctataatactatctaatcatgggaggggaaacagttttcccaaagatgacttgactttgtcatcctgatgcttagtcagagaatctgaaacatatcctttgattcctattgaaagcctttcaacaaattacctttcagataaactgtctccttgtgagtttggaatctctaattttgagttaatctctctaattgtgagcttaagatgctacataaattacattttttaattacaaccaaagaaagtggtagagtagaaaagagtgtctcctgtgtcatgtaactttctgagggtaaatattaggttggtgcaaaagtaattgcggtttttgccatggaaatgaatggtaggcatggaatattatgcagccagataaaaggaatgtggtcatatcctttgcagggacatggatgaaactggaagccatcatcctcagcaaactaacacaggaacagaaaaccaaacaccgcatgttctcactcataagtaggagttgaacaatgaaaacatatggacaagggcaggggaacaacacacactggggcctgtgggagtaggggaggtgaggtgaggaagagcatcagaacagatagctaatgcatgcagggtttaaaacctaggtgacagcttgataggtgcagcaaaataccatggcacacgtatacctatgtaacaaacctgcactttctgcacagctaccctggaacttacataaagtttaaataaacaaataaataaatagcaatggtagggccattactttcataatacagtggtagggcctagacaggaagcaaggggccaacacacgtgagttgagagggaactcagaacaatatagtaggatattcccccaaagtagaaagttttacactgaaattaaacgtttcacttacttaacaattttctctaggactttattacacattctctggagtctgatatgtttctcttgtagaattgagacacagacttgatatctgtcatcttcagcaaaaaatatttccttacaggtattttttattctggaacaggagactaaaaccccagaagagagataattctaacatacatattttaaactgccaacagccaacgtagcctgtgattctcaaagtatatatgtctcaaatatcatttaatgtggattactatgcaatgaaacttcactatatgaaaatatggaaatagttattctcattgtcgttcaaaaagcttttctttagtcttgtcacaaaggatcacagtttgcatttttaggtggcgttcatgtacctttcttcattgaagacggagagcattttatgaacttcatatcttcttgtttcagtagggtcttcatggttgtgactatatctccacagccaaagcaaagcagacatttaaggtaattacttagataattagtgggcaaatctccactttgctttcactgtggtgccttggccttcaatcagttgagggaagttgggcactcagaagttaatattttacttttttttttttcatgaggtactaaaacactgtttcttcttttgtttttcccatgatacttttgaaaaatggcaatctcagatctattgtgggtggctagaagacagtaacctagtaatacaatatttgttattttgttagtgtaattcttgtgctccaggaatgttgagcttattgttaaaaattgcttgtatgaacctgggttttagcttctgtatgcaatatcatcttggcctttgctttcaaatatttggaacaatacatttatagaataaaaaatgaaacaccatataatttcagaatgtctcaattctactcccatttgtagtttaatgcaaaaggaacctcatggacctccaccacatcttttgctcctgacaccataccaaacttccagatgtatcagtcatgttttaacacttcagtatgatgaaagttagagaggatggaaatggaatgggacttgattttgaggtactgaggttgcattgcacataggaaaactggctcatttttagtttttaaatattaataattatatctagaaagcacagcttacttaagtcttgtctgttatacataaatgcaaaataattataagagaaaccccatattataaattctacttaaaactagatgaacatatcttgaaactacattatgagaatttttagatttctaaaagagcacagttaaatgtatttccttaaccatcatttattctatcattcattcactacatacaagagggtgtgctatttgaaagaactgttagaaagcttgaggatttaatttctttgtagcttctgtttcctggtaaagataatgcttaataatgtaaatattggtcatatactattaattattctgacagttcaatataatttaatttattatccccattaataattgacagagacaggatgtgagtttctgaaaatctacttctaaaattccttcaacagacgtgcaaatgtgtcatacaagatacaagtataactcagttgtgtggcagaaacaccagacataacttttcttggagctgttgaaaggcattgtatagacttatgaagcaagttacttgtaaatgaacatgaaacctaagtctgtggagctaatctgaccatgacagccctgacccccatttatcaccaaagtcgattgaacccctctgcctggctggtgttaagtttcccctttcactatccaggtgtcacttggttcaagaggaagatgttggcggacaggttttcttcaaataatatgagtacctctgttattttcactacttaaattgccacaattctccttgcatcttataaaagtattgttttttggtttttgttttttgttttacttttcatcagtatcttttaaaggggtgtgtgtattggactagagagatggtgtggcattttctaaaaaccctaggaataattcttattttggaataaattttttttaaaaatcgctgaagttagtatgatttccataggcatcatggattttatgttggaggtttgtaatggagtttgtgtgatagttttttgaaggcagttcaggtctccatttggaggggctaaaaatcatgcagagttctcttctttccttttctctgccttccgtcttttcccagagatgagtagaaggagggaggataatttgctaagttttggcagtggtatccccattttgatttgtttttctttctaaatgcatatatagaatgacagcattggcattatcctacttaaagtttaaatgcagtaaaatcaagagcaaagcatgcttcctgcatttctcacaccctgcaatgcccaaagaaataatctggagctgagctacaccagtgggctctttttcagtcctagaataaagagaggggcctttagtggatatagccctttctagggtcatctctccttccactcttgaactcaggaagttccagtagagtgctaagaggttcaggctttatcataccttggcacctagggctgaaacacctggagaccagcagaggctacatagtgccaatctcataattctttctcctcctagaggctgcagtcttctgtctgtggtcgcggttcattttcccagtattccccagagtaacttcagtcctctggctcttctgacttttggtaaggaggcttgccaagctgtcttcattcctgaatctcattacctacatctgggcccggttttccctgcctaatttcaagcacttttccaaggatgggacttatgctccagtcatctttgctctttatgtccaatgtcacacctcaatctttttttttttttttttttttgagacagagtctcgctctgttgcccagtcttgagtgcagtggtgtgatctcggctcactgcaagctccgcctcccggattcacgccattctcctgcctcagcctcccgagtaggtgggactgcaggcgcccgccaccatgcccggctaatattttgtatttttagtagagacggggtttcaccgtgtcacacctcagtcttaatctctcctctttagaacaccgtcaagtcttccaagatctttgcagggctggaattggcactctccttggggcttatttgctatgaaatgttttctctctgaagcaagatggccctttctacttgtttttgtttgcatttctcagatcagtttctttcacttgatcatcatttcaacatgatctccttcctgacctcgcttccacagcaggttataaaaaaggtgacaaacaccattttaagcatttagattccagcaattttcacatagccagaggctagtgagggaggcatcgatatatgtaatgtgcttcccacctggcatgcacttcctagacattcccagttaaatacatcagagctccgttttaattttatgtgcaattttattttattttgaaacagagtttcgctcttgttgcccaggctggagtacaatggcacaatctcggctcactgcaacctccgcctcccgggttcaagcaattcccctgtctcagcctcccaagtagctgagattacaggagcatgccaccacacccggctaatttttgtatttttagtggagatggggtttcaccatgttggtcaggctgttctcgaactcctgacctcaggtgatcggcccgcctcagcctcccaaagtcctgggattacaggcatgagccactgcgcctggccttttgtgcaattttatgttcagtgatctccaaatttatttattctgttacaagtatttctctaaaataacccagagctctctcaacttactaggtgttagagctactacaaatgacttatcttcgaacatgatctctttctgattttcttaaagtgaagggctttctaaacaagacctatgtttcatgaaaatgtggttagtatgacattttaaacaaggcattttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtacatttcttctggttaaatttggggttgaagttgccagtagagtttacctatcgtgattttttttttttctgttaatctggatttcaagagtcaagaaaggatatctgcagaaagtcatgtctgagatgagactcaaagaataagcacatgttggctaaacaaagtagaagtgaaagtgtttcaaccagaatcagaaagaaaggagacagcatacaaaaaggcccagaagtaacagaggaggagatgaggggaagagagagagagagagagacctcatcagaactgtagaagtgcagccttgagagttgaggacaaaaggaggagtgggcaacgagaggctggtgtagcaagggagacatgatgccaggcagacacacagagccagctcatggagagctacctgtatgatgagagctttggctttctcctgaaggcaataagaagattctaaataatttttagacgaggagaaacatgagtagattgcattttaaatcattcaggctgtagtgcagataatgaattgaaaaggtataaagttggaggacgagcattccaccgttttggcttggagagtgtggaggtcaagagggtggcagctcattctggggacctacctcttgaaattccaggtatatatattattatctactgtgtgaggctatcttgtgtcttggttatttaaaattgaaacaccgttaagtttatctttgtcctgcaaacgataacagaaaagcaacatgttgattttggcttattctgatacatctgcctggcatggaggaattggtcgggtttcaaaatgtcagaatttctgcttgttaatgagtggtttctttggtgagaattttatgtagaataaaattgtgggctactcacagaaactaaaagagaatgatgggaaatagtcttttaacattttaccactgtaatgagtttttgtttgtttgtttgttatttaaaaaaaaaacctccaggtaatatcaattgacaagagtcaaataaattaataaaaagcacagactagtgctcctatcaacaagtttttagaaatttgttaccctaagctcttattctccagatgttattcagattctcagttccaggtctgcctagtaatttagtacatggcttgtttagcatagaagaactgtaaaaaatatagagctctgcccacaataagcctttcatagagactaagacattatattaaaactgttccttgggccaagatccttccagagcattctttggccatttacaaatttctttacatgagttcattacaaatatacccagaaagcattgattccagatgtacggctgagttaagagttttgggtacgcgttaacacaatttatttaccttgtattgtgcctgttgattttcagtagcagagagtaagtacctactatgtgcctggaactggtgtcatgaattgagcagtgaacaaaatagtcaggtttttatgttctgggagtgggaagacaggaataaatacaaagaccaagggggccagatataactgttttaggctttgtggggtgtatggtttctgttacaactactcacttctattgttttagcaatgaatttgcgtggtggctgtgttccaataacactgtacttacaaaaataggtatgggccagatttgttctataaaccatatagtttgctgacccctgacattgatcactaaataaggaagttcatcttatctactaataagaaagaaaatagaacaggataatatggaaggcagtagttgtggcagcttcggccagagtgattgggcaagagttttttgtgattgagttaaatcagtgtccgagtgattaaagagcaagttgtcaatatcatctatttatcatctatttacctttctgttaaaattttatataaagctaagaaaattaagttacatattatacatttataggaggtaggaaccatatagaacatgctgacatgtacctggactcaacaattgttgccctgtagttgaagagagtttcagaaaatatctttctcaaaagttccagccttctttaattcatactttcctctgaatttctatggcatttattaaatgatgagattcacttagccttgagaaaatgtaacattggttagtgtatgttttttgtatgctgacctgaagtgtgtggacagtgttatatgttagtttctaaactggcctctcagcttggcattcttctgtagctggcatgtcataactattgaattaccattttatgaggatcaggaaagttaaaagagagtgcagctaggagtccaacaggaggtggctcagattgataatttgctttcacaatgcataaaaacttcctatatggaaaacattagctgaaggaaaaggagaggcgtacttgtgaatctcaagtgatctctctaagatttgtaagacgagttgttttatgtgtactgtagttgttgttaaatcctaagccatacaacaaattaaagagtacaagtttatcaacaatactctgtgccatttggctcccttggttgatgcatgtggaataatctgtcagacaataggcattacctcttgtatataaggaactggatagaagccatggcttcagacctcaacgatcagtttaagaaagactcaagagttaattacacaaataaaataagacaaaatgaaaagttccatgaagcagcattatttagagtacatattcattcaacaaaattttgctgagtacttataatgagctgggtatttttctagacactgatgaattgtgacaagtaggatcaatatgatatagatttatctggaaagctttcaaagagaaggtagaaattcaccagtgtcctgagaagtatgtgggattttaatttgagagcaccattttaaagggtaagcatggcagaggaataggaagaactcaagggctcttcaaacaatgaatacagttagtttgattggagattatgtagagaattccagcaggaataatgtaagaaaggtaggttgggggcaattgttggagggccttgataaatccaaaaactttggcattttaacctgaaggcattacacggcaattggagatactgagcaatagcatggtacattgaagtttaagccaattaatctggcagaggtttgtatatacaattgtaggtggagcagaaagaaaccaaaggcaattctgccaattaggaggctatttcagttgttcatatgctatgtgcattcacaaaaatggtagagagaatgggaaaatgatgaacaatgttagtggtattttgggggtagacttaattggctattaatggaatagagggaagaggcgaagaagaaactagaattttgaaaataatgatttcttaaaacaaattactcctcccctagaaaaaaatttagttgaaaagtaatctttccagcttaaaagagttttctcaggtcaaatgattctgctgtccacttgctatataaccttgatcaagttatttaaaatctctgtgactcatctataatgtgaattataatgctactcatttttagagggctgattattcattcagccgatattccataaattattttctagctcctgggaatagggtggtgaatgagacaaggtccctgctgttaaggagtatattttctgatggagacagattctttctcagtaagcaaatatacaggtaattttgagttctaataaatgttagaaggaaacatttgattcaatgtagaataatacggttcaggaggggttactttgggtaaagcttgaagagatggcctctccaaggaagtgatatttgaagtgagatgtaaataatgagaaggagccaggcttgcgaagagcgggaaaagcagtttagaggtaacaggaagagcaagtgcaaaagttggcttatttgaggagcagtatagcagattttttaggaaatgcacacctacaaatgtaatacttaattgtcagtctgtaggtagaaatcatcgcagatttaaaagggtcacatgccctctagtgtcctctatgccttatttaatcctgttaataggcttttccaagtgccatgaagaatgttgaaactgtgtatgtgtgcatttgttctgtgaaatgcattaatatttctttatgtaggaaacagaattctgagaaggcagcttctgttgaagggggatatatttatttatttttgtaaatgagaaggaatggaaacagaggggaacaagaagtgttctgttgaaagggatgacttgcatattttagtttggtctgttcattcttacataaactagggcaaaacaatgatcccattaagttttttgtttttttttttttctcttcagtgtttttcttttttgggtttaaaataaaggaaaaaaaatagaatcagggaatactttgattctgttgtgtgggttgaaattctatctctccacccacaaaaaaattctgaaaaatgggtcttggaatttttttcttcatgagtcctagtcatcgccctcattttgtgcccatctccctagttttggagatgatggagagacaatagagaatagagtgaaaatgtggggatggtgcccacctccacacctatgtctgagttcttgtttgttctgtagccatattggtcttcccttctttcaacacagtgtgttgtttcttgttcaagggccttttgaaatacaatgcctcagctgggcgtggtggctcacgcctgtaatcccagcactttgggaggccaaggcaggcacatcacttgaggtcaggagatccagaccagtctggccaacatggtgaaaccccatctctactaaaaatataaaaattagtcaggtgtggtggcatgcacctgtaatcccagctacttgggaggctgagacaggaaaattgcttgaacctgggaggtggaggttgctgtaagccaagatcgtgccactgcagtccagcctgggcaacaaagagtgaaactccgtgtcaaaaaacaaaaaacaaaaaaaaaaccaaacaaacaaaaagaaagcattacagtaactctttctggaatgtacctcctttctctatccattttctaacatctcattttaattttttttagtggttactcccaatgtcctgtcctacaaccaaccaaccttcctccccaaattaggccactgttagattaggtctcccttttaagggatactgatcccaagcaccctgtaattttctttcatgacattcatgatgtcataatctttgctgtgttttcttccattctttacgcttttgaccttaagagttgactcggagttgattgttgctctcttcccagtgtggtgtactctctagtacattgcgtagtatatacgagttgcttaatatttatttatcaaatgaattgagctaaaacaaacaggtactgtttagacataatacaggattttgggaagttggggaactctgaaaaatagaaaagtaatttcactagctagggttgagattagctatgagggctggacgtggctcatgcctgtaatccaagcactttggaaggctgaggcaggtggatcacgaggtcaggagatcgagaccatcctggccaacatggagaaaccccgtctctactaaaaatacaaaaatcagccagacgtggcggcatgcacttgtagtcccagctactcagaagccagaggcaggagaattgcttgaacctgggaggcagaggctgcagtgagccgaaatcgtgccactgcactccagcctgggcaacagagcagaaccaccttggaccatatgtgtctgagacctaccactgtctctctttctgggcaacagagcaagactctgtctcaaaaaaaaaaaaaaaaaaagattgtaagatttttctattagtagcagaaaccaatcaagcagtagttacttaaagaaggtaaaagattgcttcttcatcataaaattccagagtggtttgatgactctgctccttgaagtccccacagactcagttactccagctcaatactttgccatcactggtggtaggtctcagacacatatggtccaaggtggttctgtgtctcaggcaaaaaaatggagaaaaagatggcttttataaggaatagaatgtttttctgatgaaatgtattgatttggaaacagcttaatcctagattcaggattaaattcaatcagccttctatgtctgtaaatttcaaaaagtatgataaagtaaatgtggttcataaattttaaaaagataatcacagcatcttgaccatttacaaagcaaagcattctgaattagggcatttgacctcataacatccccccagactagatagattaagaggtgagaacctgagaaaaaaagcagatcagagtagaggcagacaatttgcttaattactgcagcaaaaccggaagttgcagagtggcagagtctgctgtcctttggcaaacaagggacagcccacacacactacagacatcctgtggtccacactctatggtcacttagcaaccaagaggagatttctttgtattctgagctattcactgaggtggggatggggggtctcctagaaggcccttcagaactaggccacgtggagagttagattaaatgaaactcaagggtattatggcttttctcacagaatatctatttcctgacatgttcccgcctctgctactgaagcaggtcatgtatgagtgcagctgccactcagcctgattcagacttttcattcacaggtttaattaaaatttctagcaagcaccatctatcatttctcttttgtaatttttctctctgagagaaacaagttcagtgctcatgatctcttgcatggttatggtgcctttctttctataggaagagattagtaacctctttaacaacttatagattttcactgggaaccttgattgaaagaaaatcataattgttagtctgtgtttggagctaaagataatgtgggtaaactccctgaggtttattatggtactcggtgtaacacattataaggtccaaaaaatattatattttttggaattgttttttatgatactgtaatgtaacaaagcagttcccctctaggactgtctagatccctgggtcttgtgcttataaaaattgggattcataggctaatttcagtgttttagaaagacaatggaacttgaacctttaccaatggctatgttgcatggactcaccagataccatgctttcggccaaattaatataaaaattgtttctttatactaatcagttgatggtctgcatttcatgtatatgttttttattagttaaaatggggaccaagttatttactaatgaataacatttgctgataaagtctttcagcactgtgtgtgtgaaaaataatgcaaatattggaaggaattgtaagatggaaccctggtactgactgttttgtcactttgagtaagttatgcaactattgtgggaatgaattccctcatctatataaaggggattaatagtattaattagacagatttgttgtgagagctagagaggacagcctcttaatgatggagagttatcatcagcaacagaagcagtagtagcatcattatcattatttttctttcgaaaccagaagtttaaaagaaaaataaagttaaggggttccttagttgtgaaccaattggaaagtactgtgttttttctttctttttcaacttttattttagaatcagagagtatatgtgtaggtttgttacaaagctatattgcccagtgctgaggttggggtatgacttgaacccatcatccaggtagtaagcatagtatccaacagggagtttttcagctcttgcccccacatccttttcccctctagtagtccccagtgtctattggtctcatctttatgtccacatgtacccagaatttagctctcccttataagtgagaaaatacagtacgttgttttctattcctgtgttagttaggttagggtaatggcctccagctgcatccatgttgctgcaaaaaaaaaaaaaaataataataataatgtgattttgttcttttttttttttttttttggccgtatagtgtctacgtaccatggtatatatgtaccatattttctttatccaatctacaactgatggccacctaggttgattccacgtctttgctcttgtgaatagtgctgcaatgaacatacacatgcatgtgttcctttggtagaatgatttattttcctttaggtacatacccagtcttgggattgctgggtcaaatagtggttcaattcttagttcattgagaaatctccaaactggtctttacagaggctggactaatttacatacctcaccaacagtgtgtaaatgtccccttttctctgcaggcttgccaacgtccttttctttttgacataacaaagccattctgactggtacaagatagcatctcattgtggctttgatttgtatttctctgatgattagtgatgatgagcattttttcatgtttgttagccattgtttgtcttcttttgagaggtgtctattcatgtcttttgttcactttttaatggggctatttgttttttgcctgttgaattctttaagttctttatagattctggatatcacacttttatcagaggcataacttgtgaatgttttctcccattctgtagcatgtctgtttacttccttgatagtttctcttctttcgtagaagctctttagtttaatttggttccacttatcaattttcgcttttattgcaatgctcttgaggacttagccataatttctttgcaaaggctccttatgacttgccatatgcttttcgttcctgttaccccactccccaggccaagttttccagtgacttttgaagtagtttgtacaactgcatagggcctcactctggccctttaaggatcccacttacttactttttttgagttagcacccctttgggaggaggggaaattcttcctttgccatttgtgagtttttactccaatccccatgtcaagaaggatatttcctaggttttcttgtaggatttttacagtttgagacatatttaagtctttaatccaccttgggtgtttttttgtatatgtgtaaggaaggagtccagtttcgttcttctgtgtatgcttagccagccatccaagcagcgtttattgaattagcgtcttttccccattgcttacttttggcaagtttgtcaaagatcagttgattgtgcgtgtgtggctttatttctgtgttctctcttctgttccattggtctatagttctgtttctgtaccaggaccatgctgttttggttactgtagccttgtagtatagtttgaagttgggtaatatggttcctctggcattgttctttttgcttaggattgctttggctatttggactcattttggtttcatatgaatttcagctttttctatgtgtgtgaaaaatgattggtagtttgataggaatagtgttgaatctgtaaatgggaagcagtgctgaatgaagtcaagactcaactgattctgtgtttgtattttctgttataaactatcttgggaaagtaatgatatcatttaagggttctgtgtcttcaactatgagaaggaaagctttggattgatgatagtaagttactagtaaagttaactaaagttcaaggtactttctaggtcagatagttcatattccttaccatataccaacctccccaggtctgctacacatagtattgtttggcaaggcatgaatcttctgtgactctaaatttcattatctgtagaatggatatagaaataactgccttccaggtgattatacgttaagagcctggcatataatagtcattgctcacaatgtaaatggtagctgctcactcagcctttccccacaagcaaggtttcataggttttttaccatcctatgcacatttattgtatatgctccaagatgactatgtcgttcctccaatatgagcctcagaatcaaacccagtcctacaaatatgttctcataagtagcctaaatcctctgtgtatcttccctcttctattcctatgtagaggcattcactttcatttctgagacatttctcctgtctctctttctacctggtttccccaactcattgttgcttttaactataagatctgaggtcatggtttagattcatttgaagaccactttgcgtcttctggcatggctacagaaggttccagtaaacctgacacaggcaatcctgtggttaaattgcaaggacaccttcagtcttagaggacaaaaagaggaaaagggatagcaaaaattccagtgttcctccatcacactcgacatattccaaatgtagagattctgaatgccaagaacagcttgtttggtctgtgtgagtcgtggatgttttgtcatctaagcccgatgtactctcccacactttgcatcattactgagggataaaaaacaaaaacaaaaatccccccatagcactcagaaagtgcatctttatagtccgcatggaaaaagaaggtcagtggcacaaagcatttgatgccctaccacctcctcttttttccattcatcctgggtgaaggaagagtgtgtcttttctcccactcctacctagcctgtctgattcactctgttgcattgtcctcattggaaactgctttcctggactcttgacacattcttactgtatcagagctgtgcttaaccaggaagtgccagatggtactgaatcactggctgcttaatattcaagaacaatattacatacagaacagaataatgtatgtgttgattaaaggactttgctgatgtcttgggaatcaggaaatgcccttgtcacctccacagctgtgccttgacaatttatgcagattacaagttttgtgggggactctttgctaagcatgtttctaccttttttttaaactatatcttcagcacttggttttttgctctaagctgcttgccattcaaagtcctagatatatgctactttcgttgaaaagattgttttctagtgtcctcttccttgtcgctctcttcaggattataagtctataagggagtataggacaaaaactgtaaacatagatagctgtacttttttcggggaactggcataattctggaagatgtcaacatattggcacattcaggaattaccttcatgatgctatggactgtgagtaatatgtagttatctgaaacagtttctgaacatgaaaggatataataaattcaaggcatacttcttggataaatccttctaaaagacttagttttctaaggggagttttggttaaaatccaaagcaaaccaagcagagaactacccttttattgttctatctgtccacaaacagattctgcttctgcggtatccacctcagaatagcttaaaatgttcttaattatgtcccttagttctgttaaaacaatcacaaagcttaccaggcttttatttttgaaaatagatttacatttacatgagttggataaaaaaaaattgtgaaaatgaacttcatccgagctgtcaccatcaatctttattatttttgaaaacaattggccagatagaaaaactggtaaaaattactgagaatgtcttgaagtgggtttttgaagattaaccaataagatcagctgcatatctcattacctaacaagtcctcctatgtccattaatctacttatgtatggatagataagcgtttatccacttattcatgcagaaagaacttatcactgtccactatgcaaggactggttttcagtaatagtaatataggatagtattagtaataagtcatatctcaagacgtgtcttgaacaatttgctgaatttctagaagataatcggcaatgtagtacagaaatgattgtaattgtatctaccgtttacttctatgaatgttggccttgtgtggaaatagacaaaaatagatacctgtctctgacaatgaagttacaaaattgaccacaaaagtagatgcaaatgggtaggacattgtcagtgttggtgagtgcaaacttgtatctccttcagtgctaaatatcacactgttaggtattttcagttttatttttgaggacttttcagaaagaagtgagaaaggcttctactacttcttaaaatctcattctcatagtcactaccctatagattctgaacaatgcatattagaatcacatggataacttctagaaaactacctccataagaaattctgatttcatttgtctgaagtgaggcctgataatccacatcttaacatgcatcccaataatcactttcatttccccacatgaattctttttcttcaccaccatgaaaatacacaattgttcttaaaactgatataatacatttttgagcatttgtctatatttggtgagagagaatagatactaatgaaacaagattcctgctctcaaaaagctcccagacttggagttttctgaaatgtatgacgtaaatccaggctctgtagctatttatgctgtgtgaccctggacaggttgctcaatctctctgatccttggcaattaaactgcaaagggagaaagcaaatatttttcttcataaggttactagaagcattaaatgagataaagtgctcagtagaaagtaatgttgttcctattattcagtatttattatcaatttaatgtgcataacatacaattatatgcgatatatgcagtgcatgtacatatacatagttatgtatacataattgttgtgtgtatgtgtgtatacatacacacatacacattaaatatttgttactttcacacagagaaacatatgtgctggagtgacaagtagatttattacgaaaaaaaaagaaaaaagaaaaagaaaaaagatcagctaaatagtttttagcccagtaaaatacattggagtcactggtgagaagcgttgggggaaaaacacgtttgcttctttagttctgatagaatttaaacaatgcagcactgcatttttattcggggacaaacccacgcatttaatgtgctgctgccacctagtgcttagattcaataactactattttgctaggagtttctttcaatgtcaggtattcagggttggaaaacagcttggtatcttgttagttcttttgaaagagatcttaaatatggttgagatatgtttgtgttagtttattggttcgcatttctttttaaagtatgtaattttgaatagctgctggcttaagtggaatggtttattggcttcttgcttgtcatgtagctcatctttttgaaaggtgtcggagtgcctctgcaacatgaaatggtgtgcgtttccttaagtttgtatttaagcaagatatgctgctctgcaagtaaaaggaatgtagcactacgtctgctctatttgcactgttattatgttatagtaaaatgttatattgtgagtcttgcatgttaattaagctcatggtagtaaaagtgacaccaaaaggagaggccaagagacatgagaaacaagaaattatcactgagatttagaatatgaagaaaatatgtttttcttcctttgacaggaaaagtttcagtatgatttgacttcttcatatgaacaatcatatgatatagaataggatttttcaaactcaggctcttgatattttgaatgagatgattccttgtttggggcctggggctatcctgtgtattgtaggagatttcactgggttgctggcctttacccattagatgccagtgtaagcacttgtatccctgcccctacttgtgagaaccaaaaaggtctgcagaaattgtcaaatgtctcatgggttgagaaccactgatagaaaaagcacactatggtaattacagatcaaaagtgatttttatatttttaattaatctagggtttgtactaattggggacagagcttatgtgatgcttcatgaattgccagcaaattcaagctatttaattacttattccctcatttatatatttgagagagacaacatcgtataatagtcagtagtataagtttgaatctcaattctgccacttactaaattttgtgattaaataatttactatctctattaatactaaaatctaaaattccattttcttcaaccataaactggagataattattgtatttccttcacaaaataagtataaaaattaaatgagatattgcatttaaagtccatatcacagtgtctaccaattaggtaattactcagtaattattaattatcatttaatagatattttaaatccctctatgtgccaggaattgtggcaatcactagggaaatactgatgatttacccataatttcccaaagtagatcagtgtagtgggaaaagaattcaaatataattatatatataattatcttgatcattactgtaatagagaagaagtacaagatcctatgccatgtcattgttatcaggattgacactaatttgatggagatacttttgggaatcaattgctagtcagtagttaattggctgaagtagaaaaagttcaatttcctggggcagtatgcctagatttcatatatatatatatatatatatacacacacacacacacacacacacacacaaacacacacacacacataggcatacatacacatatacacatatatatgtacatatatatgtgtgtgtgtgtatgtgtgtgtatctcatatgagatatatatatatatatatatatatatatattcttttttttttttttttttttttgaggcagagtcttgctctgtcgcccaggctgaagtgcagtggcgtgatctcggctcactgcaagctccacctaccgggttcacgccattctcctgcctcagcctcccgagtagctgggactacaggcgcccgccaccatacccggctagtttttttgtattttttttagtagagacggggtttcaccgcgttaaccagaatggtcgcgatctcctgacctcatgatccgcccgccttggcctcccaaagtcccgggattagaggcgtgagccaccgcgcccggccatgatatgtatttttaatgtagtctttgaaactagcagaaaagaaatatatatctctctatatagagagatatacggatatatattttacttcagaatgctgaccgagttataaaacaagtaaatggttccttataacacattagctatgagaaagtatgtttatttttctaacatggtatgatacataaacatggctctccgggtctgttctggaagtcattagaaagagacaacatatttggtaagcacattttccttctgtctcccttttctcctctgttaaatgggttatgtgtacccctacctactctacctacctaacacatgttacagccaatggcatgatctccatctgtgaatcagcagtgcatcccggaaaaaagagagcaaaaatctggtgggaaattggatgagagtgaggtaattggaacactgagagaaggattctaacatccacaccacccctggtgcagtcaaccctctttagcctggaccactgcaatagcgttcagacgggcctctcctatccctctcgcatttgtgtataacaaacctgcacgttgtgcacatgtaccctaaaacttaaagtataataaaaaaaatagtgaactactcagtgctgtgtacagagccatgctgctttacatttctgtccctctgcacctgatttccctcagatggaaagcatttttatactttttcatccaacaatgtcctacttttctttgatgctcatatcatttcctccaatgaggacactttcacaaaacctattgccctcaaagactcggctgaaagtatcctcaatgttttcttcttctctattttttttttttttttttgacagagtctcgctcagtcaccaggttatttttggtagagacagggtttcaccatgttggccaggctggtctcgaagtcctgccctcaagtgatccgcccatcttggcctcccaaagtgctgggattacaggcgtgagccaccacacccagctttcagtatgttttcttagcatcctttattagaataagcttaacaaagatatattattaaatatagatagataatatagattattaaaattgcattgtaataagaaatttgaaatgtagcatatgcagagaagacctgttttttgcttcagagtgtcaaagataattgggaaataaaacagctatataaatggacatcagaggagaaataaaaataacactgagagcatagataacaaaaccacaaaggtgaagaaattctagcaaaaatagctgctatcagagatcaaatactcaaaatgaaaaagaatagattaggcaagattaaatccccttcctgaagacctgtttgggtaatggatagacagagaagaaaaaaatggtaaatttgagatttgagaatgaatttatggtgaagatactgagtgactggataatggaatttcttgtgaaactgagttaaagatctagaaaaggtgtagaggggatgggggtgtctctaaatggagaaatagacaaaaataaaatataaagggagaggcaagccttttaggtgctgacatcagacatcagagattaccaccaggtccatggtgtagatggatagcacatctcagtttgcaggtctcagtgctgaggtcttcaagatctgacagacatgcttttcgcaactacttttagaagttaatgggccaaagatggaatatccatttccattaaagtgtatgtgttaatcataatatacaggaaaagaaagaggaaagatcttaaaatctggaggccactaatgtgactttaacattaattaattttctttttctgatctcactataataaactggctagatactagggagaatgaatcacaaagtggcagaaaagagatatgggtgaacttaaaagatattggaaccaagaaaagagggcttttaagacaaatgaaggaatgaacagaatcagaatgagttacactattgccagctttgcctccctacacatatactatagataaggcgatgacttcatgaaaccaaagtgttggcaacttaggaatggttctgtatatgaggcccttctacaaacaagcacatcactggaggctgagctgaattgaaaacaattaggaaatataagttagacttatcaatgaggagtgaatattggtgttcctttaacatcattttttagcttaaaatacaaaaggcacaggaaggtgtttatcagaaaactcatagtttctcactgacatgaagtgatatggatatgcaggtaagattctgaaatactaaagatatttgtgcaagcaggaacatatcattgcacacagtgggttactggagaaagaaaaggaagtggctgagggatccacatagctgaagatttgtgccatagtttgtcataagaaaacacatatcatttgagagaggtggactaaacaaatagaaagtagttctagtatgccagctgggccctaattagataaacaacatccctctaacaacagttgaaggaaaaaagacatgggaatgggatggatatatattttttatatcagatgggaataatttatacacatttttctctactacctgtgtgcatctaacagacctgtgcacacacatatgaaagactttaggaaatcatgagaaaaattatagaaatgagagaatagaaatataaaattgtggaaatataaaaatagaagttgaactggtgacaatttttagtgtaaactttgaaaggaataaagttactagaatttctagaggcaaaagtaaatttaagagcaaagagtcaacatgggagctttgggagtttatgtctaaaaactggctgaatttcagcaggcagtttgtagtgataagttcctagggcattcgttatgtatggcttttataaacagcgtttgtgtcatcctccctacagagacctctgggtggccccatggaacaataggctcatttatgagtcagcatgtgaccagctctgaagcaagggtggatagacatagtcagtgatgaattgtttaattcttctggacttcatctttaagaagactgaaaaatttggaagtgagctccaagcttcacctactcatattggaaaatgagtgatgggatcagaatattcagtaaaggaagactttggaattcagaataggtcaaacaatttaaaagacataacaaagatgatatgtatggaagacaaaaacagggattacaaagaggccatggctgagcatggtggctcagcctgtaatcccagcactttgagaggccaaggtgggtggatcacctgaggtcaggagttcaacaccagcctgaccaacatggtgaaaccccatctctactaaaaatataaaagttagtcaggtgtggtgccacacacctgtaatcccagctactagagagcctgaggcgggagaattgcttgaacccaggaggcagagattgcagtgaactgagatcgtgccactgcactccagcctggatgacaagagtgaaactccatctcaaaaaaaataaataaattaaaaattaaaaaaattttaaaaagaacataattacaaaagtgagttttacgtatagataatgaaattggtttataattttcttctatgttcattaactgttcagatagtaggaaaactttatgaacattaaagctttgaaagaagtcaactagtatagtctgggcaaaaaatgattgagaaacacagagttaaagaaagaagaagactttgtgccccagagaaaatgtttggagcctattagatttatagagaacacaatgatgaagctatggaaagtgtgaagagaaataggaagaacagggaatgatgatcttggggagaaagtttctgagagagaaatatgaaggcttataattattcagaagtatgttatagaaaggggaagataaaacaaaggaaaagcaatataaatagcaaagctttgagtcctaattcagtcatggccttgtctgaggatattatgatggttgtgttttgtgatcagaggagttcaaataatgtgtaatatgaaaatagtttaaaaagtaacattaaaggataaagtgaaatggtacaagagaggattttgtaaccataaagtacaattaaaatgttaggaaatggatttgaaattcagtggctagattgtgcctaaggtcagaagactgttccattatctgctactcctgaagtatggtgggggaggggaataagatcattattcatccttacttttgtaacgatttcagataaaattacatctttatatagtgaattgtatgacagcatgccagctagtctacaaaacaagaataagatcttcacagtaataaaacaattttttttttttttagtgaagaaaacattttcttatgtagatattttggaaatatttctgtcttcttgcttttttttaagcagctgagctgggcattttaaacctaattttatttttatgaagaaatacatatacattgttaataaaatggtgctgtaagacttatgccctcaaaacagcaaacctgctcctcctttcttacccctttccactcttattttccctccctagttctccccagaggcagctgttatcactgtttcttcttgtatttatctccaagcttctaaattatttaattatgctgctttatcttagttttaaattttagatattttctgtggcatattcatgaattcagtgtagcaggagtaggaagatgacgatctagccatcttttctctccccttcccccactcaccacacatattacacttcctttctttctatttgctcaacatcattagccatgccataacactggtcaaatcattattcagcatttattttataatgatcatgtaaatattatagtgcaccatgattacttttcctttttgcaataatttcaatttttctggaagtcagtaatgcttcattgtgttgtcctaagtatgatgaaaaggcccttaccaggtccccttagagaagggtaaaaccctcacaataatgtcacaggcaaacatgccagtgaatttatccgtttgatttctggccccctacatttccctagccaggtctgtctcacagtgtcaccctgaaacttctctaccttgttctgttggatccactatttactggatcagagtcttgtgtagattactccctcaatttccagagctcatcctgagaaaatcagtaattcattcatccaacatatatttattcaacatctattatgaaacaaaaagggttctaggaaataaggatgtatcagggaacaaaacaggagatccatgactctctaaaggacttcatatttatgtgtgtagtgtgtagcctagccatatacaatacagagtgctctattccatttgaacttcagacaatgaatacttttcagtaggaatattttctaaatattgtaaaggatatacttatactaagaaaatgttcattgtttatctggattccaatttgactgtgtgtcctggtatttttatatgctaaatatgacaaccctagctgggagggattagactgtaccagaaaacctaggtaaataaatagcatggtagagagtggtaaatgccatgctgcgatggggaaagagaagcagaacagggtaaggcagattgggagtaccaggaggagggatagcaatttttacagggtgattaggataagcctcattgagaagatgagatattagcaagggcatgaaggaggtgaggtgtttactctgaggttatctgggaggaaagattctagacagaaagaacaccaagtgaagaatatctagagtggatctgagtgtttgggaaatagggacaccagtgtggctgtcacagagcatttgaaggatgcagtggtaggagatgaagttagagaagtaacaggagtccagatcctctaggaaacttaggctattgggatagctctgtagtttacacccagggaaatggggagccatgcagggttttgaagagttatggcatgaggtgacttctattttaacaagatctctctagttgctccattgagaaaacactgggtggcaaaagtgaaagctcaaagaccaatttgaaaactgttaaaataatctgggtgagatcaaaaaattttggactaaggagctagtagtgaagatggtgagaacagattgcattttagatgtatttttcctccaatattttactgtgaaaattttcatacacatagagatggtaatacccatgtaactcccaaatagattctgcaatgaaattttcgctgtatttgctttatcatatatttttccttctctccatcctctggctgagtcatctgccagtcagacatttctgtttctgcagagataaaccttcagtctcctgctgtgatgacacagtcactggcattggaaatctggggtggggacatagtaattctgggtgctaaccaatccttataccaattttcaacccattctcctttattaaactgcatttttctcctcacctgatggaggtacctggtgattctaaagcccacattttctatagtttccaggcattgtttggcttgcttctttttgacagctgccatttcaagctttagttccacctctgtcactcttagttacaactcatttgttttccaacttctaaaaatgtattgctctttcttctctatcattttatcctctcaacttcccttatcctttgactttgtaacatttttctttccctttcatttgagtagggttttaaaaggaaggaggcccatattttcaaatattttaccaatagaaagaactgaatgtatttagtaatacttatttttccattttaatgtcaatatactaaagatacattaaaaccagtagcaaagtaatagtttttcagagtatctaggttactattttgttgccttttaagactcaaggggacatcagtttggaaaccattgttgtgtatcatcatcatggagtgttaaactttggctctcccagtgcttacttattctagcctgtttgttggattttggtattagtgtttagaagagataatggaattcagattgaatcaggcaaatgtggccctgtctgcttagtagagggaatggtttttctttgctccatggagcccagcttcccttcctaaataggttattatatctgtggagtggataaattctaatttcactctggtatagaccagctacaaatccttcctctgacaccaacattttctatctcattgctttcactatgctgactgttctgtaaaatatttattatgactttgtcttctctgtctgaaatggtgccatacactggtaattagatggagactaagccttcttaatttcatttggtgcagggctgggaaaatggagcccttacataacaacgagatgaggactgaccggcagttggcgttaagtgctcctacacatatttccaagcagatgcaaatggaacttttcaccagtccatcatcatatgtcacttgcttgctgcttttcccatgtttgcttccagaaagaggctacttgacagtcatttgtctctacaatgagcctactttatgaagctgaattccctcccccaccagagggaaacaattacagcaggccaggaacttttttctgttcagttccaatagtcagaatatttctgacccaaggccctgtccatgttgggagattggttctcaacatctagggcactatagtagttcacccttcaaataaagatttgaggattacatctttatgtatgtatgatttatcactggagacaatgtctcacaactgggcatcagaagactagtgcactgtgtgtccttgagctacccacttaaccactatttctctatccagataatggtaacattaatacttgcctactgagccactgggtagttatgataacaaaattaaataggaggaagtactatcaggattttaataagatttcatttttgaatgtgagctcaagggctaagcacgctggctgctgctaactttcagcatttttgtatggctaaaacaatgaggctcagattcataaattgttccaagcatgtaaagcaccttctttattgtggttttggggttcattcccagttgggcaatatgatcatcagcaaggacttcataaaatggcaatatgtatccctaaagaaaagaggtgttgcctgtggaaagacctttaaaaactcaggtgactgtacccttggcaaagtcactttaggatgtatagttgagtggtaatgagtattatctgaatcctaagagattttcaaatctgaacttcgttgcttcttagctaggtgaccttgggcaattcacttaaccttgtcgagccactgttttctcatttttaaatatgaacataatgcaaaccacttagagttgctccaaggattaaatgaaataaaacctgtaagaaccttatcattatcagtggcagcagcagcagcacaacattattatttaaaaataacaatagcaggctatttattattgagtctacaccatgttccaggcactgtttctacatgcttacacatattaatatctgtgtttgaacaactatgggaggaaggaattactatagtcattattttgcagatgagaaactgagacacagattaaagaaatttattctggtcatacagcaagttggcagcctgataaaggaaaaacaaataggagcttctgctctgtttactgttatttatctctctgaagttttatctaagaaaagggtataataagctaaaggactattgggaagttaaaatgagatagtaaataagataataaataagaaaaaaatgcttgtaaagagtaaaacggtaattccagaagcttgtttatttgggctgtgattaacaatttgtaatcgcacgtaactagagaagttgaaatgaattccccacctttggcaaggacgtctttaagtgtcatttgttattagtagtgcctcagtttgccctgctaacaggtgatcttatcagttatcttgaaaatgctagaatcaagctttcaacatggcaaactatccatggaacacctgctgtctcactcctccatgtgtcaaggtacctcagggagatagctgaattcccaatcacccaattttgagcatatgccatttcagaataatattagacaatgacagagtctgttgtcctataaattaatttaacacttttcctctggagagcagatgactgcattctaaaaacaatattttctctcgagttatgatggcttgtaaaaacacacagtgaatggagttgacaggaaggtgttgggaagcatatgatatcccagggggctgaacagatctaaatttaggtgggttgtctctactaggcagttggtgtcagataccattgcctcttaaaaggatgacttcagtgaagagcagttaacagattgtgcagaaacataagcctctgtggtccattaagtggggaatcatttaatgagacccagagttgcactgagggaaccatggcacttaagcattaaaagacagaaaaggaaggggtgaaaattttatgaagcaatttattactgctgtaaaccatgtattttaaaaaatgcattccaggtataataagaacttgtgaatgaagatcatgaagagaataatgtacttaattcactatggattctgtcatgatatttgtttcttctctttttgcttcccttttccccatttcttcttcttctgtttctctcttgattctcaatacaatctcccactttcttatgcaattcctgttatagcttcaatttttgacccacgtctatctttctctcaaagaaattctctaagcaaaaattggtctgaattatcattcacacagatttttttcagactcctctttctaaataagggcataaaccattttacctttctctttctcctatcttttcctaaataagcaatgcagatataatttataaaggtagtgttgcttggaatggggcattagtaagtattagttttgttcatccagtcgtttaacatgcatttattcatttaatattcatctaataaacattgtgtgcccggcactgtgctaggcacccagggtatgaaatttagcaaggaataaccttgcctgccactcaacaaatatttgttgaatgatcaaaggaagggattcactttaattcacctagtgaatggggaacaattctctgcatgtataaaggcaggaaactttcttgggattttaaggagttcacaatatctatggagtgagtaatttgttgagtgggcctgggctcagaaggtaggactacatgcagtatagtacagttgtgcagtgcacatcctgaacagtcatacatgataactctagcatagtaagaaagaatgtgggaaaagaaaatagtagctgggctataaagtgctttgcgagccaggttacttgttcttatggagggatgagggtagaagtaaaagagaaggtatcagaattgctgtcaaattttccacattatgtatgcttctgaccaccatggggatgctgatgtcctccccttacccctactactttcccaggatcttcgccacattgccaatttactgtaagtcatatttctcaggtgagctgtagctaagaatgtctgagaaacactagacaatggagagccctcacaggtttttaagaaggcggtagcatgttcagattttcctttgaggaagattactgtggctctggagtagacggtggactagtgaagagtgagagatgaggagacatcctgctgaaaagcgttcatgtcctcaaggtctaatgacatctgtgttcagagcacttgacagatactcctgctgccctcagttttcagggccaccagcacaatattagagacagaatgaaacagatttgtcactgtcatcctgagagggcgatgacacctgacacatttcatacgaattacgatttcaaacagacagggacattcaagcagatctatgctggggaattaaataaagctataaaatataaacatgaacttttaatttaaaattctcattgaaaagacatttcctgttgggtagtttttatttttgttagtggttttgcttgtttgttgtttatgtaatatagctaggatatatacagcttggttatcttaaaaaacaagtacattaccaataaatgcatatttttttctggctctcctatgtggccattactttttcatttagtaaaacatatgattttctgtgatctacatgaatgtagactttaccttttcaatgaaaagcgagttgatatatttgtttctaaacacaaatgttcccaagaaaaaggaaaagacattcttctttttttattgctttaagttcttacctccatataatgtgattccagcctgtcttgctaaactacataactaagagacaggggaaaaaaaactcctttctgaaatcctgttatcacatatcatagaagccagagcactagaccccttgatactgcagtgacctccccaagacccacaggaagctgctgactgatcatttctacaacttacgaaattttcattatgttctaagttaacatgggaaagttaacttatttcatttcaacttatttttcccctttggattaagtatctggatgagctaagaaacttgattggggtgggggcatgggatagtttttttttttattatttaatgttaggaaaataaaattaaaaggtctcaaaaatgtgtattcaattcagtaaaacatagatagtgacttacgtgacatgatgtaataaatcactgctgtatcaatatattaaatgatacacggaccattaaatattgcattcattattaggaaaataatttttgaaataacacagctccttaattctaaggtcatatgctagatggggaataaagatgtggtttctagcctggctctggtgaaccacctatgtgacctctcagactgtgcatctgtgcaacattgccagtgacctcgatgtttctttttaatcctcttaatttcaacagggcatattcgtagattacttggcacatagtaagcactctactattgtatgactctatgtcattcaaggaaacactttccctcttactgtcacatatgaagaggttttctaattaaaacacataattaagcatcacagtaagacaaagtcatgaaacaaaatgctcttgattaagaatgggagtgtttcttctcattactgagagaaaatataaaaaaaaaagcaaaaagacaactttgagacatattgattctttcctcttgacaaggaatgtgtatcattaatagaaacaaagaaatgatttacagtgtttgcaacagcctgagtatgcttatagagcttcattagggacactgggataaaagctgagataatttccaaccatcattctgagcaaactatcacaaggacagaaaaccaaacactgcatgttctcactcacaggtgggaattgaacaatgagaacgcttggacacagggtggggaacatcacacatgggggcctgttgtggggtggagggaggagggagggatagcattaggagatatacctaatgtaaatggggagttaatgggtgcagcacaccaacatggcacatgtatacatatgtaacaaccctgcaggttgtgcacatgtaccctagaacttaaagtattaaaaaaaaaaaaaacccaagctgagctaagattttggtcacggtcttttttttcccccttcagaattgagaaatgttgcttaagtcagtaatggatcgccttgactttgctatgatcagaggcacagtaaggaatgaagccaattgttaaaaatgatgacagccataataaaacctaacatgcaaaaactactgctttgcaacttatagtgttggaggctatttgtagcaactcttttatttcttatcaacaacaaaaataaagaaaaataacaaacaccaacataggactaaatactcgatattcaatatagtcatgtactctataacaatgtttcagtcaataagaatggttctgtaagattttaatacagatttttactgtactttttctatgtttggatatcttcagatacacaaatacttaccatgtgttataattgcctatgtattcagtacagtaatttgctgtacgggtttgtagcctggaagcaacaggctatcttatgtagcttaggtgtgtagaaggctgtgccatctcgttttgtgtaagtacactctatgatgttcacacagtggtgaaattgcctaacacacattctcagaatgtgttctcattgttacgtgttgcacaaccattcctcaattgacatatgcattgatgctactggtcaagagccgctaccttttagaatgaagaacacaaagttcaactctgtgaagcattaaaataaaaaaccagtgagatatacactggacagaaatcaaagccccttcttacttatgccaacagataactagtgtattccgtcgtgttacctcactagacacgttttcttctgaaataattagggctacttgaggataatcttctgaaattaaatttaatgtttatttaagatttgttaggacataagcctatgaatcattttaaatgagcacagttaatctgcttacactacttactacttctgatattagtgatatcttgcctgtgctgaattatcacagataagtaaccaagcatgggtgaaaaccaaaatctagcactttgcagaatatgtgggtatgttttaatggaataaaggattcttgtcccagttctgctactgatttgttgtgtgatcctgcctaagttgcttaacttctcagagcatcagtattcctatctataaaaggagtaatactgataatgacattatagattagataaagtaggtacaacctgtggaagtatcaaatgaaaagaagtattatatgataacagtattgaccctgttctgagtttgcatatatgagattccaaaaatgaagactacatcatccctctcttcagagagctcacatattctgaaaagggacatacaggtaaatcagcaattgcaatattgtgggattcatgtaactgtgaaatcatgtataaactaaacagtacacagcaaggaagggttcacttatctggggaaggagatgaacatggaagattttccatattctgaaaagggacatacaggtaaatcagcaattgcaatattgtgagatgcatgtaacagtgaaatcacctggaaactaaacagtacacagaaaggaaggattcacttatctggggaaggagatgaccatggaagattttccagttgggggtgatgttttgaacatcagggaagaagcaagggctagagttataatttgggaaacaaaagtaggtggtagtgaaaaccatgaggttacaaacagagaatggttagagtcagaaaagcagtagacaaaggacagaatatgttagaatggcaaaacttaacaatgtagaagaaatgtaacctatcaaggaggcagagaaagaacaatgagataggtagcaggcaattcaggagacagacttgtcacaggtagtcaagaagtggggagtttcaaggaaggagtgggcaatatcattagataccttgcttgacaaagttatcatgaaaaataaagtttaaggaccatatattgtatttgatacattagaagccgtctggcttcctttctctgtgcagtcagttaagaggtagagggcagaagcaaagtgtactgtaggttgtaccgtgatgagcaagtgaagacaccaagtgtgaatgtaactatcaagaaggtcagatgtaaggagaaagtatgaaagtaagagtggaaattaatgagagttagaacatagtgggaggaattgaacttggacaggagaacttctgagataagaaaggtggagtaaatgataagtgtagattcaggtatattggccagtagaggtgtcaagagaggatgcatgcttgataaaggtgaagtcattggtaggctgatggagggtggggacaagtagtgtgtttgagaataatagataaaaatgggaaatggagctgaccaaaactaaaaggatcacttaattgcaattggcctgatgtcactaatctgtgagatggaagagttcttggatgaagtatataatcttccttctaaaccagctcagcatctgtgctggaaaagctcattgtagtgcaagcattctagggaaagggagggaagagtttaaataataatagcaggctgatttgcttttaggttaaacagtgggagtttggtttatggagatggaggtgagtgttcaattttttttttttagatcggtcacataccagaaaagcatggaattttaatctctataatcagagctataaatctctatgacagtaatatcttttttaaaaaagaatttatatatgggtcctcttctatttacatatgtatttgtttaaattgacagataaaattatatgtattcatcatgtataacgtaaagttttaaagtacatatgcattgtggaatcactaaatagagctgattaacaaatgtattacctacatagttatcatttttgtggcaagaactcttaacatccactctttttgcatttttttaattaaggaagaatacaatatatcattcttaactatagtcaccatgcagtacaacaaatcttttgaacttattcctcctatctttctgtaattatatatcctttgactaacaccttcctatcaccctcacccaccaaccacttctgcttctagtaaccaccattcttttctctacttctatgagatcaacatctttagattccacatatgagtgaaattgttgcagaaaaggggtctggatccagacaccaagagtggattcttggataagtccacagagtaaagtgaaagcaagtatgttaagaaagtaaagaaataaaagaatggctactccataaacaaaacatccctgagtgctgttggttgcccatattctgattatttcttgatgaaatgctaaacaaggggtagactattcatgcctcccccttttggaccatatagggtaacttcctgatgttgccatggcatctgtaaaatgtcatggcactggtgggagtgtccagtgaggatgaccagaggtcactctcatcgccagcttggttttgatgggttttggctggcttctttactgcaacctgttgtatcagcaaggtttttatgagctgtgtcttgtgctgaccttatcctatatctgatcctatgacttatcctgtgaaatatctcattctatgacttagaatgccttaaccatctgggaatgcagcccagtaggtctcagcctcattttaccaagcccctattcaagatggagttgctctcattcacatgcctccgacaaaatcatatggtatttttatctttctgtgcctggcttctttcatgtaccacaatgtcctctgggttcattctcgttgttgcaaacaacaggattttcttctgtattatggctgagtagtattccattatgtatataaaccacattttctctgcccattcatccattaacggacatgtaggttgacgccatatcttggctattgtgaatagtgctgcagtaaacctgggagtgcagatatctgcactttgatatactgatttcatttcgcttgtatatatacctagtggtggaattgctggatcacatggtacctttatttttaatattttgaggaatctttatgctgttttccataatggctatactaacttgcatttccaccaataatgtgtaaaggttcccttttctccacattcttgccaacacttgttatcttttgtatgaccctaatatcttaatcccaagcttgaaaccttcaaacagcttagccactggctttcttagcaaattataggttactaattagcaaggtctaactgagacgtcagcaagaataactcagaattgaaaatctgtttactagagtatatccccagacagggccacctatttcatggagagaggttgtaaggtttgctgtggaaacctcataatattgacctaaaacccttccatctcccaagagtagccaaaatgaggcatgaggaaaggtaatggattccacaattactcctcatcaatatgaaatcaatattcttctttgaagatgtagaaagtcctttctgttttaagtattatgggtaagtacatgaatcatggatgcttacacccttgtcaaatacagcatcaaggaagcattcagtgaaaggcaatagtgtatttatgtatgttttcatttttttcagtgtagcttagaaacagaaaagcaaagaaaaaagaaaaaacgactccttcaaagcaagagagaagcattttacagttctgataaatttataaggacccaagctgcagagcactgactaggtccatagagaagatcaggaaaaatataaaactgtctttgcaataattggaaaatccaaacaaactactaaggctgatacctaggagaaatcttccaagagaaagaaacctctgatatctgattttactattagtaatgtcccattcttaaggtgtccgtataaggcagtgtctcacgtaagatgttttaaaggaagttgcatctgtttctaaaaggaaaacaattctctaattttgtggaacatgtttttaaaatgtagctataaattgtctgttcattatttcctttaaaagcctgggagtggaaggaggtcagctcacgcctttggagaaaaacacctctccagttactgcctacagaacaacagtcaaagggaaattgttaccaatacaccagcagtttggtctttgtcctattgctctctgcgtggaaagtcaatcactaggcaatgagtgttgccaggaaagaaggctttttcaggtgctgcagcctgtaataggagatcagtcccaaatccatctcaactgactaaaattaggggtttatatagcagagaagaaatataactatgtgtaggaaaacaggaattagggatgggcaaggaggagaagttggttacaagaagcaggtggtcccttaggcaatcatgatgggtgaggggtctggctcccatggtgcagatgtgatgatctggtaagtttcagttgcttgacactgtctgggagtcctgatgattgattttctgagaaaagaactcagataagacagttttaactttctcaaattttaagactgggagggtcaatgtctatgtttattcaaaagaaatcataaacatcagttctatgggacacttgggcaagtttcaaaaggatgagataatctcatgaaaaacctagattcgggtttcaaaatgagaaaacagcaaatatatccctccgcctcacaatcacacaaaatcaatcaacaaagatgtatgcctcctccaactatagctcttatcaaaggaaccttcacatgataaagctagactttggagatagatgttattcacaaaaatacaattatgtccattagactcctcttacaaaggcaggaaagtaaacctagatacattgtaaaagtatttcctgctaatcctcccctattgactgtggtaagaatattggactgaaaccaacatctgcagtagaaaggatgtggaagaggaagtgagcagaaatttaattcctgtattattcatattcagtatgggactctgtttcatgctgtatccactttgcaaagtactatggattcattaagaaattagcaaactgaatatgtgcctaaatggccagcatactccaggctgaaaagtgtttctgtcactgcttcctagaattgtttaaaaactgttgtgactggtggttctttctggttgaaatggcctgctcacaaacactgaattagacttgggcattttgccaggggcattgataccaagaatgtttggaggcaagtcttaaatgtaatttgcagagctaggaggtgccagaacttcaaaataggcaaagttgctctctcgaacagtggtagaaagaatcaaagtgttattctgacactggccttggcagtttttgtcccagtgacttcaaattttggaagctggcagtaagacacatgcagaaacttgtgggaatatgaatatgtggatgaaattataaaagccctagtgattttatttctttagtgaaagctgtcatgagtaaaggactagactggagtcaggtgctaagaatctggctccagtccaacctgactccagtcaggttcttgttttacagaggcgtacactgagaaccagatctttgatttgatttgcttgggtcctaaaatctggttctcagtgtctacatatgtaaaacaacatggtactgtgaccgaaacaccatgggttagatcctcttgcttgctacatagaaagctaatcactaagacaatgagtattgccagggaaggaggctttatttgggtgctgcaaccaagaagaacaaatcagtctcgaattcatttcaccaatcaattaaaattcagggtttctataatggggaaggaatgtagctacatgtaggaaaacaggaattttagggaggggcaaggagtctggcatttaattgtctggtgtcatctgttccttgcctaaaggtcagtttgctgaggaagaaactcagataagaccaatttaagtttcaagtttaagacaagggagggtcaatttccatatttatttattattattattatcattattatttgagatggagtctcactctgtcacccaggctggagtgcagtggcacgatctcagctcactgccacctctgcctcccaggttcaagcaattctcctgtctcagcctcccgagtagctgagactacaggcgcctgccaccatgcccagctaattttttttttttttttttcagtagagatggggtttcaccatattggtcaggatggtctcaaactcctgacctcaggtgatccacccacctcggcctcccaaagtgttgagattacaggcatgagccaccacgcccgaccatatttatttttaaaagtaaatattagttctatgcgacacttgagccaatttcagtactactgggagggccaggaaaggcaaagtagttacaagctaaatcctctttttatctgctttatatttcaggggttctcattgagattttgtttaatgagtatgttctgatgctaaaataagtttgaagacttccagctggaagatgtgttctaaggtccttttgttactgaaatgtcagaggttctgtctaggtcctgctgctcactgcatagaacgccagtcactgaaacattgagtatttccaggggaaaaagctttattcgggtgctgcagccaaggagctaggtgatcagtctcaaatccatctacctaatagactaaaattaagggtttatatagcagggaagaaatgtagccatgaaaacaggaattagggaagggtaaggaagaggaattggtcaacaggaagcacatggtctattaggcgatcacaacagatgaggggtctcatgtctcattgtccagatgcggtgttctggtaagtttcagctccttgatactatctgggaggcctgatggttggtttcctgagaagggaactcaaataagacaactgtaattttcccaaattttaagactgggagggtcaatttctatatttattcaaaagaaaccacaaacatcatttctatgggacagtagtgctggtttcactttctgttctaaatttctcatactctaaatgagaataaccagtagaaatacatttaattcttataaatcaaatagctttaattactatttttcattaaatttttattagttggtacaatatttgattttgaaaactgcttcatgtcaaccacataaatgaagttctgtgaaacccccaaatacacatggagaaattttagatacaggcatatagaaagcaggtccaaaacctttatcaaaacctacatgaaagtggtaagaacaagtggtaagaatacaagtcatctcccactggctgggagtcaaaaaaaaagtctagatctcaagctgacgccaagtaagaagaattgaaacagattttataggctctatgatgtgacttcccagactttctctcacaatcacatcctcttcccaacattacagtgcccgtatgtatccataacattttgggcaggagagggagtcagcagggtctttgatgatcatgcaacattacctcttaatattaaattttctgatatttgcaagaagccgatgacaaattatttggttttccatgtcaaacctccatgatatattttactagatacaaagaatcatgcattcttcacatttaaatcaataaccttgttaagttggagctctagatggctcctgggcctaggggtaagttgtttgttttaaaagacatattctacgataattaggaagaaaaagaataaagaaaaacataaatgtttgcctattcaaaaacaccttgccttcaagggctcagacaatgactggggaaaactccaataatttttttagtgcactttcaatgttattttgtattgagtatttgtctgactcttagcattgtaattcagtagcagacatttccatggtccttaaaatcctgattcagaggggaataacccactgggaaaaatggagcactaagctgagtcagtaggcaggaaccagaggcagtaataagaactgtaatagaagatcagatgtcagagagaagcctccagacacattaaaccaaagaattatacgtaggtgctggttcccatagcacagcaaagctgggttctggagatgtttattcttatcacttccacagaaaaaaaacaggacttctttcatagactatatgctaactcagacattttgcaccaagtagaaaaacaatgggtcatgaaatacaaaccaaaacactaatttcactagaaccaggggttgattcaaggtactgtaagaattctcggaatttaacacttttgatattttttcatttcagatgctgcacaacaaacatgtcatggtccgtgtgggaggaggctgggaaacttttgcagggtatttgttgaaacacgacccctgccgaatgctgcagatctcccgtgtggatggcaaaacatcccctatccaaagcaaatctccaactctaaaggacatgaatccagataactacttggtggtctctgccagttataaggctaagaaggaaattaagtgaaacaaattggtcatgacaaggggaccctcataatggcctgtatccacttctccagtatagtcagtttagttcatatgttctgaaaactgttttggagaaagatagacagaaaaatgtcatcatattgaaaaatgttcaaagagtagcactatttatttttaatgcttctgtagaatatgacctattaaaagaaaatctaaactcaaatttaaattatccaaattttaggcaaattattatttctcaatatgcgaacacagtatttagaacacaatattagaaacacaattctaactaaagataaataaggagaaaacatttaggatttgcagataagtcaacagaaagtgcctgctttacactcatgagtaaaagcactccagacatttttataattgcaagatttttatgctttttttttttttttttttttacaaaatgatgattagtgtgataatgtgctgcaaaaaatatccaacagcactacacataagtacagagtattcacaatagtaatatgttactggaaaggccacttccgaaaagtttacattcacttggaaggctgccttaaagtatatctcttatctatgaccaaatatctggggtacttttagaagttttcagtacacccccttagagaatagcttatgagttatttcacacattcctgagcacatggctgtgtttagaatgatctagtgtaattcatacatgagctgacatacgttgatactttgacgagtaaattgtacagtcaaatgttcattgatttcatgttatttcaaagcattttcttattaaaaatatatctttagttaatcctattttgctatgctttctagtaaagtaaattcactgtagctaatgatgttacagacttacgtatacccttgtatacctgggacagggctgttttataccaataaacagcaaaatattgtccttactcattcaagaattaaaaggataaattttaaaaatgttatctgtctctaaatcaatgcctcattctgaaatcaagttaattttcaaatggcaactttctccaacagttataagaagaatcaaattagggctccctggcacttcttcactttgggagatgagtgatggtggtgttagttttccttagcagagagttcaggttttattataagtgctgctctcagtataaaaaggatagaaaattaatttttcatgtattcatttttcaacatcaacaaaagaatccacctttcttgctccaaaaagtcaggaaggaagaatatttgtcacatgacaaatttagtcaaaatatacataatgtgttaattgagaagttcttaaataacatgcatggcataattttgtagtgctggaagtgatgataatcatttgggggagagaaagtcagtgaaacctaaaaaaaataaatcgattaaaaaaaaaaaccctgagatgttgtaggagatagtcaccttggtgcagtgaataattctaatatattttaaaatataatgttgagtgataaagattaagatctttaaattacctaatactgacactgagtttctttgtatagttaatgacaatatttccatcaacattttctcctgtgcctaaatttgttccataagcgtatttatatccttaataatataattccactgcctgtctctaaaacaaaaattaaagataatagtcaacttcattaaagaagtgtagcttaacaaaagtaatattaacctctttatcttttgcattagtagttatctattgctgcattaaattgccacaaacttggtagctgaataagcatgtttattatctcacatttctgcagtcattcaacatggtttcaataggctaaaatcagagtgtcaccaaggctgttttccttcctgaagagtctaggggagcatccatttcctttccttttccatcttctagaggccacctgcattcctaagctccatgatttccttcctccatcttcaaaatcagcaatgtagcatctctatgacccgtcttctttcttcacatctctttctctcataggttggaaaggttttctgcttttaacaatcacatgattagcttggatctacctggataatctattttaaggtcactaacttgagcacatctaaagaatcgactttgccatgtaacaacatattcacagcttccagggattaggacatgaacatgtttggcagggagggaaggattatgatacccataccacatctaagatggtcttttaagtgtcactgaaaacatggtcacaactggcactggagtctagctgctagtcaatcggcaccaaccagggatgtgaaaaaaactgagactatattcagcctcttactcctcaactccttattgaagactggccaggacatagaccaagtaggttaatgtcaccttattctcagctagatgtaagatccaaagaaggacaatggagagatgggtccaatagccaatgaataaaggattaaaaagtctaaatagtctagaaatctggttgcaaacagagtggaaacatctcaaaccagaagttcaagtaaatagtaaaaaggccacagtgagaaataatatcaacacactgagcagactaggctgattctgaaattaggtgactcaatgctatcatattcagtgtctcctgatgtgggtggggacagaatagtacctacaggatacctggtaaaagtgcttgaatcagagacatataaggaatgatttcaggaacgctgggaggtgttcattttttattgttaagaaattacttggaggaactgttagctgtcttgtctacagattgttttgtactagcaaaaagaatagaagcagggagaaagagtagaaaactctggatcaccaaatgtagctcaaaggaaagaggaactttgttacaaaaatgatccaagacacaatgcccaccttataaggtacttgacactttgtcactgaaaagacaatatcgactagagttgact

SEQ ID NO: 12475 - DNA, 34741 bp, Human
cccgggtggactcgcccccactccggggacagggcttgcggctcagcccacgcccgcaggcagcgcggctctcattgtctgcctgggcggcgcgctcccctcccccctcgccgtcccctccccaccctcttttctctcctcccctcgatccctcctcctcctcttcacctccagcgcccagctgctcgctgagcgcagttccgacccacagcctggcacccttcggcgagcgctgtttgtttagggctcggtgagtccaatcaggagcccaggctgcagttttccggcagagcagtaagaggcgcctcctctctcctttttattcaccagcagcgcggcgcagaccccggactcgcgctcgcccgctggcgccctcggcttctctccgcgcctgggagcaccctccgccgcggccgttctccatgcgcagcgcccgcccgaggttcggctgcttcctcctcgcgcgatctccccgctttcctcccctccacccctactcgtcgcgggcccctggcctccggctctccggccctctccaggccgcggtcggctccgacggtgtttccctccttccctccgggcgggctgaggcggctcccaggctcccgggacaccgcggaccaacttctagtctctttttctctcctcgaagcgcttatctgcgcgcagccttatctccgagttatctcggcgcaaaggggcgggagccggtagttaggcaggcagagaaacttctttcttgctatctagccaggtctgtgtgtgggcattaattttagtgtggtaatctccgatgagccgaggcgatttggaagagcagcctggaggaggccagcccggctgcatttcacctccctcccccactcgctccgagtctccctgtcattcttcctgctctcccatttggggtcgcctcggctctggggcggtctcacgctcccccctccccagcccgttgcgttccccctccttttctctgctctccgctccaccccgctacgtccgattccggaacggtccggcgtttctgctgctggagatgaccgcggggtgggccgggtggcccggccggcgtgagcgcgcacgctggtggctgcaggcgcgggccgtgtctaaggtgtgcggcgccgcggggacgccggtggggctggcgattcccgccccacaagctctccgcattgcctctgctgggaaggacccagactgctgcccccgccctggcgtcccactttccctgggccgagttgcatttctctctggggctcgcgttcgggctggtcagcgcagtccgggaagctctgggagagccaatataggagaacgcggcggtttcgttttcggggacaggttgccttccttacgcgaagggttttcccgtggggaaccctcaccccgaggcatttcgggagaggggcatccgcagagaggcgggatgcggcggtgccgacacgcacagctacttaaattcttttgtgtgtcatcagcccgggggagacactttagggcggaaggaaagcctcagccagcttctgcagatcacccctgggatctggcgcgcgcacggagaaaggatgcggccgagggggtgggcggggaggacgcggggaccggagcggtgcctttgagggagggctggtatcccagcccttccagggccctgtggcggctgcgcaggctcccttcccctcccttattgatctccacgcccggggcagaaataggatctttgagaagtctcaaatgggatctttgagaagtcagatcccatttgaactagaaaaaggagtggaggcgaggtagcgtgcagcctacgctcttgttaacccgtcgatctcctaccatacccgtctcccccaccccacctcaggagctagacgtcagcttggagcggcgccggaccgtggatggccttgactgacggcggctggtgcttgccgaagcgcttcggggccgcgggtgcggacgccagcgactccagagcctttccagcgcgggagccctccacgccgccttcccccatctcttcctcgtcctcctcctgctcccggggcggagagcggggccccggcggcgccagcaactgcgggacgcctcagctcgacacggaggcggcggccggacccccggcccgctcgctgctgctcagttcctacgcttcgcatcccttcggggctccccacggaccttcggcgcctggggtcgcgggccccgggggcaacctgtcgagctgggaggacttgctgctgttcactgacctcgaccaagccgcgaccgccagcaagctgctgtggtccagccgcggcgccaagctgagccccttcgcacccgagcagccggaggagatgtaccagaccctcgccgctctctccagccagggtccggccgcctacgacggcgcgcccggcggcttcgtgcactctgcggccgcggcggcagcagccgcggcggcggccagctccccggtctacgtgcccaccacccgcgtgggttccatgctgcccggcctaccgtaccacctgcaggggtcgggcagtgggccagccaaccacgcgggcggcgcgggcgcgcaccccggctggcctcaggcctcggccgacagccctccatacggcagcggaggcggcgcggctggcggcggggccgcggggcctggcggcgctggctcagccgcggcgcacgtctcggcgcgcttcccctactctcccagcccgcccatggccaacggcgccgcgcgggagccgggaggctacgcggcggcgggcagtgggggcgcgggaggcgtgagcggcggcggcagtagcctggcggccatgggcggccgcgagccccagtacagctcgctgtcggccgcgcggccgctgaacgggacgtaccaccaccaccaccaccaccaccaccaccatccgagcccctactcgccctacgtgggggcgccactgacgcctgcctggcccgccggacccttcgagaccccggtgctgcacagcctgcagagccgcgccggagccccgctcccggtgccccggggtcccagtgcaggtaagggtcgcgcctcaggttcggggtgcgggtccaaagcgctggggcgcacgggggacgtggagcagctgctccactcgggccctgttttcaggactttctcgtccgggtgcgcggaggtcggcctggtcccaggaaggatttgcaggcctgtggctgggtaacccagagtccggtagcgctgaggcgagttgtgccaagacttgagtctgttgtgccaagttcctttccacggatgagactaaatgcacatctgtaccttcgtgccttggggaagctcagggccttgatgagtagtgaatggcatctgctattggggaaaaacgaggctgggagggaactaacagcgcttgagccccatcgcagaccctactttgggtgagtggaagaaattccacgatgggagtaagtttgggagagtggcgggcacttgatccacccccaaacagacacacaagcacatgcaggctcacccagtttaactctccaaagggtgcgtgtttgtgttttcctagagaagggtatttagaagagcacaacagaagaacctagatgttcctagggaagctagttggcgtctcctctcccacaagggagagagggaaagaagagagggcacctggagtggtcagacttgtgacttcatggtgaaggagagctggtggataggcccttgggcttggcatcagctgggccttggtctggggctgctgctcacatggccaggctgcaactcagggatcctggagctggggcacctattctcccttcgaagtttagcccgccaatttttcagtttccaatttgactcattttttcctgtatctgggagccattagggggtaaaccgtgaaaacgctattgtcaaaaatacctggaaatacctcgttttgaaaagtgttttgtttactccagcacaggagtgtgggagccctgttaggctgtttttctcagatgcaacattctgcgtccttggtgctttcaactggcttatcttaccttatatttcacctgtttgataatctttctaaggaaacaacatctttttttattgtagtttgtttgaggggaggtgtgggggaggccccttgagtcacagaggtggcagagtggaggaaggcacattactccaaacagtcctaccccggtgtcttgtgtatcccaggtctgtgcttctcgtgggagcctcgacgctacctttaggacagcaagtcagtcctaggggccaggattccttaggataaaatgggacattcccaaccttgtccgcaaaagacacgctggaaatgcaagtggtctgaaagagagggaaccaatttgaacagctctctgatagcctgagttctttctgtcttcttccaagcgctgcaagacttggtctcaaaattccctctttttagttttgctctgtcgcccagtctggagtgcagtggctcactgtaatctctgtctcccgggttcaagcgattctcctgcctcagcctcccgtgtagctgggattacaggcgcgcgccgccacacctagctaatttttgtatttttagtagtttttgccacgttggtcaggctgtttttgaactcttgacttcaggcgatccattcgcctcagcctcccaaagtactgggattataggcgtgagccaccgcgcccagcgaaattccctctttttgcttctgctgcaaagctggccctggagaccatttttcccctgtgtgtggaatgggatcgggggaccctgttgagatttgcactgttggcttgggacttgagagtcagggctctcatccttacctctgcatagggacccgtgtttggctcccaggagcagagagatggagaggctgggaatctctaaggaggtaatggttgggtgtgaagcttattttgtcagtcggggagttccgtagggaatgtgcaagggtgttgtgagttgggtgaggggtagtatctgcagattgagccagcgcctgcagctctgcctatttcttgacacaccttagcctgatctccaggttcctttcctccaatcttccagcatttcatatggctgagagagtcttttgatgtttacagtaactggtcctgtatgagaaatccttttagaggcagtatggggcagttgtgggcaagttaatatgtttctttttgttttaaatttagcctacacttttcctaattttttcatcttctgggcacaccacagttagaggaattttctgtagacccagaagatttgttatttttttaagtatttttttaagtatgtttaaaaaaatgggaagggatttgggaacacccagcttttgcatagagtctgttaggaaatcaggaagtgactgggaccaagccagtattggggtgaagggtggggagcgagtgaccctaactttgcttgtcctcacaggtattctgaggccagcttcctagctagatttcctgtttcttagatttttttttttttttaaacaaaccgtttttggaggcagacactttaaacaccagagctaaaacctgagtgctgaacttgatcaacccgcacaatttggaggcttctggaaacccacactatgcacctctcgctgactgggtagatggggtgagcttactttggggtgagctcagagtcctcacactcctttatttcctgggtcctacaccctcctaagcgcctgcagaactgtgagtccctgtgtcttggtaccacacacagaaagacaggtggtggtgcccttctcccctgaatctatcactccccaagggcaccgcaaacagccatgttaggagagaaatggtgagttgaaaagggggaacttggtgagcaagcccccagcttttatatcttacagcttttataaagacagcatttttttttcctttttagtcacttacaggattatagctgcctggtgggtttgggaaagaggtagggagggaatgagagagattttattcaactaaaaataagcaagcttcctaggttgtatttatccaaagtggacttttaattaaattttgtctttgggttttcagatgactaaatagttctacctggggagttcacactgtcttctaataggattcttattgttcccagtcataggactgggttttccagggaatgccccactcctctatccagaggggctctgataggtaacattttaaagtcaacaacaaagacaaataccttgtttaacttcagtgtccttgaagacctgagcattttactgattaccgtagtcaatagtggcttttagggcggagaagaataaacctttgtgatgtgttgtaagttgcagtatccccatgacaactttgaactcgggttgtgtaggatgccagtttctttaaaacttaataagaaatgagaaaagagacttgttttgtaaatagtattaatggaattaaagtttttatgctaaagtcatatttaaatatcgttaccacacagttgatagtagacacaagcaataaactgcaaggggatgagaaagaaccaaaaggttcaccagcacataatcttaagctaaaactctgaagtgtaatgtttatttactttaaaaagtgattcaggaatgcttcttcaataatgcagaactaggacatttaaaccttctataatctaaagaaccttaaatggcggtctatacttttttttggtctatacttacaataagtacctttctcatttttagagacatttattcttccatatttaaccttcttgagaagtaataaatgttacatttactcttaattaggatttgtttttattagcaggtttaggttattgtgaattctgaaaactaaccaaagaataataataataaaattatgtaaaataaacacattttaaatcgattgctaactcaaaatgatcactgggaaggtcttggtaattttctcaatcagtaaggtatcaaccttttataaaaattttgcagatagaagcagttggacccacttctaaatcgggattttagcatttgatctttgtggcatgaaaataaaactctgtgcttaacgttagtgcatttttcccctgaaaagatgagagtaatcttctcatttctagtttctaactaacgtaggtgcctaagaatagtacttttaatttcacttgtgtatctttaattggagaagaggcacatatggacgggtggcagatgtagaaaatactttttaaaattacttgagataaaagttaatgaggcagcctcgctgtgtccccggatatttgtgggttgcagcggggctcagtggtcagtatttctgtgtggcttgctcgggtttggcaacgacgtactgtaatgatgatggatttcagtctttaaaagctccgggacagcctgagagtaggggtcaggggactcaagccgacctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggcaccggggctgggggccggggtccccggggtgatgcggggagggacgggtccggcgcgcccactcccgccctcacgcaccgctgtcgccgcagacctgctggaggacctgtccgagagccgcgagtgcgtgaactgcggctccatccagacgccgctgtggcggcgggacggcaccggccactacctgtgcaacgcctgcgggctctacagcaagatgaacggcctcagccggcccctcatcaagccgcagaagcgcgtggtgagtgtgacccgccctgcccctggctcgcggccggccccgggctctcctggcccggccggccccgccctggctcggcctgccttgggcgtccccctcccaggggacaggtgcggccgctgcggtcccaccctagcggggacccagcggtaccatcctgtcccggctgttccaacgcccacccgctggcgcccaagtagaagttaccccgaaactggcctctgggaagccaagatagcctttccccatgtttacgcgcaggggatgacgtccgtaaatgacaaaaacaaaaacaaacaaaaaaggaaggtgcaaaatgttaccatgttttaagcaaaaaaagaaaaaataatctatatatctctaggtgtacttgccaaagcaccgtaataattctggtaagataggcaagaaattggtgatggtaacccgaggagaaaaacagtagacctaccgaggccgggcgaaggaagacttttttcactgtgtatggtttagattttatgcttgaaaaaccatgctcacttataccattcgtcccccaaatagaatatgccagaaatccacccactcacgcctcctcacagccacattcttttgggtgccgtttactttgtcctttccaccttcttggtcacttctacctcttatcctcaggtgtatccccaaataccatatcttggattgcccttgagcctggtgaaaatttatttgctctaacttttgttatttcaaaatcagagaactttgtagaacttgagtaaaagtgtggtttgtatgttcttaagttgagcattttccccaattcgcacacgttttactgtttttttgttttttttttttttttttttttttttgagacggagtttcactcttgttgcccaggctggagtgcaatggcgcgatctcggctcaccgcagcctccgcctccagggttcaagcgattctcctgcctcagcctcccgagtagctgggattacaggcatgtgccaccacgcccggctcatttttttgtatttttagtagagacagggtttctccatgtaggtcaggctggtctcgaactcccgatctcatgtgatcccgcccgcctcggcctcccgaagtgctaggattacaggcgtgagccaccgcgcccggccaccatgttttaaagtaagggaatcctgatttcagggattaatctcgtattgtcattgttatgtgtgcttcctagccggagagagtatttaccgctgtaatagagaaaataaaggaaagctttcaccagtcccactctaaggttaacatttgtttagcgaagtactcataatctaataaccctttaaagctaaatatgttacagttagatgccagacgtcttaagtatcccagtaatttatttgttatactctaattagcaggaacaaatgctacacatgttgtttgtgttaaatagattagagtgaaattgcatcacaatgtaagtctgacaccttaaagagaagcaattagttttatggttggttttgttttaatgcatttaaaataaagtggccgaggttaatttaatgagtgtatgtgccttaaactcgttacaacctcccacagcttaaaattttctttaaagggtacccttaactgcagtgtgtgactgtgggtttcatgttttcttaaatgcatcatattaaagaagaaaaagtagtaactggaaaatatcccacagaagttccttgttttcatataatagacaacacatgaacaatgaaaccgatttatttttctggaaaggcacattgagctgagtactaactgaactttcaaaggtaacattttctagagattgagcaaaaatttggtggaatagtagtcatttaggttccagttgcattataaatttgatctagtaacatttagatagtgccatttgttttgtgcatgtaccagtaaaaataacttagaaggaaaaaaaagaacagtttttagcatttctgaatcgttagctttctttgtgcttagcaggtgtcttggccataaccaaggtcagcaaatatgctttgtaaatgggttataaatgataccaattgaagggtgtgtcactatcaattaggtctccttgtgggcttcttatttatggttttgatggatctggcttagttctcagaagcagaatgttgaactcaagtttgtttagccagcactatagaaccaatcactgtgaatttgaacttgcaatacattgcaaaataagagatttatggtgtaacttgaattccttgtcagtgaggaatatgactgagatcacttgttacaaggaacttttataacccattcacctgcatttcacatgtttatgaggactggcttcacttatgatctgcagttgacagtcataaagtcctttgttataatggcaaattctgataacaagtttgcttcacattggctccaaattccactggaaactgtcataaatggctggtttataaagtgaaccttcctgtcccttgtttactgatttcacatttatgaagagaaaggaatcctttcctaaaaaattattttcttttaaccacaaagaaagaaaaaagaaaagcctggatgtgtaaagttttgttaatatgttgtcatcattttagcaaagcagtttcccaggtagctctcctgtgagccaagcatactcatttcaactaaaggcaaattgattcttagcactgacttcctagaaatgttgtagtgctaaaaggtttgccagtgtctctgtttataacttctctgtagagtgatgctaagtaatgcaacaggatgtaaaccataaatgcagattttaatttcatcttttaaatttcccagcaaaggttttggaagtctctgtcctgtaatctgtgaatattcgatacatactcaatttacatttctctcttcttcattctttacaattgatcttaacttcccaaattttgtaattttcaacttggtttggtcctgaatctttctctgatttttttttttaactatggaaggcttcacgaatttgggtgtcattcttgcgctggggccatgctaatcttctctgtatccttccaattttagtatatgtgttgctgaagcaagcatccattttttttttaactgaagctatgtcacaatttttaaagtaatttacagcatttgaaaggaaatttaagcttggcaacttaaaaacgagttttatattttgccattctgggtaagaagttatgttagcttattataattaacatgtagtaatctagaggtaataaattccctttaaggctgttatgggcataaagaaaacatggaaatgggagtgacagtggcagacaggtggccttttacctttcctggtaataccaattaaccctttgcatgaacgaaagttgagaataatactgatagggcaaatactgatattagtatcactgcatctaagacagtggcagcattaagattatgccataaaatttgctcgtatcctttgtaaaatagataaaacaaaaatgcaggcagcaggcaatcatgatggtaattatggaatgtattcaaatatatttcttttttttttttaaaaaaaacttttacccctcttctgaaagccatttctaataatgtactttcaaagtttccattaacgtactttcaaagtttctggtttactcctttacatatatctgagaaatagacctggtgatctccggttttcaggggaagtggagactgcccagagccatttagcacattagcaagtggcttgtgattgcatttcacgacctaaatcttagacctgtgactatagtgcacggccaattgctgtccacggtggggggtgggcggcagggaggtggggcactttcatgttaatgtctacttgtgttgttacttctggtgtgttttgagtataactctatttggccaacttttagaaaatcttttaattcccctaaaaaagataccagtagtatctgggaaactctaaattggagaagaaaccagggatgaaactctccttgatatgatgctggtaaaagctttgcatgaagttattggccaactatatgactgctcccgggtattcttgaattcacggagacaggctagctggagaagtaaatcaaatctatagggtccagcatactatgcaaacctcaaatttcttggcccagaaaagtcagtataagtacactgcaattttttttctcaaggaccatttcatttataataaaacagatacatacttgttgatgacagggacaaaataccttaatgtatgtatgtaatatatatatatgtcacttatatttttccacttatgttcttgtactgtttctagccttcatcacggcggcttggattgtcctgtgccaactgtcacaccacaactaccaccttatggcgcagaaacgccgagggtgaacccgtgtgcaatgcttgtggactctacatgaaactccatggggtatgccatgtattctgctcacttgtatatacatttagtatctggtttgtatgtgatatcagttacaaagaatcagcaaatgaaagatactcaagtgaaaaatttgaatgcatataatttattactgaatatgtttaatatattcagtgtacatactgaatatatttattgaattgaaggtgcttttaattataatatgaaatattaccttatgcaccagtaggaaacaaaaaatgctaccagttgaactattgcaaacgttcatttaagacacattccagttttagaaatgtgaaaatgtgaaaagtgtgtattttagaattggtaatatggtagtaactgtttttaaaaatgcacaattaaggaaatcaataaaaaatgcacaatcactagtctatatctcttaaaaattttgaatgtaatcagacatttgtgcaaaagagtaatgcatttaatagttatagtttgaaatatttcatagttcattttaaaggattgcacaaaatataataaacaactcaatcttaaaaagaaaaataaccttgcatctgtaggaggaaggaaatacatgatctctttgaaataatacttcttcaatgaatagctactcatttcaaacaataaacgttaagttgaaggaattaaattctccttggcaaatcatctcattctttctgaaggaatctctgcatttgatgaggaaagtgtagtctttgtgcacttgggatcttgagtgtgtataaaaattggattgaaatttatgccaagttctttttttttttttttttcttgttttgagatggagtctaactcttgttgcccaggctggagtgcagtggtgctatctcggctcactgcaacctccacctcctgggttcaagcgattctcctgccttagcctcccaagtagctgggattacaggcatgcgccaacaagtctggctaatttttgtatatttagtagagacggggtttcgtcatgttggccaggctggtttcgaactcctgacctcaggtgatctgcctgcctcggcctctgaaagtgctgggattagaggcgtgagccactgcactcggccgccaaattcttttaaatgagagcttttagtgccaatgttgggtctttggtttttcttcaatataatattaaatttatggcctatgtgaaaattttttaggtgcccagaccacttgctatgaaaaaagagggaattcaaaccaggaaacgaaaacctaagaacataaataaatcaaagacttgctctggtaaatatactaaaatgacgtttgactgtaaagtatttgccaaccttaacagtagagcatatgtatatttataaggtttattttgactgttgcaggtaatagcaataattccattcccatgactccaacttccacctcttctaactcagatgattgcagcaaaaatacttcccccacaacacaacctacagcctcaggggtaagtattaaaacagcatagactcctaaattactgggctgctctctagtaaattatctcaaattttatcttatctggtagtacaataatctaaaccaacagttcagtttagttagttgatacctaagaatagtttttagaggaaattacatttaaatgtcaacaaaatgacaaacttaagtactttacaaacctcttaattaagatcggtatcatttttttatggttaaattaacccaagtaaaagcaagaagttttggtttaaagtgttttaaattgttttatttccaggtttttatcagagttgctatatatattatatgtgtatatttatgtatttccgatgtagatcataagaactatgaggccagtggtttcatagattacagtgcccataacagttaagtagcttttgtttatcctatcaattccagcctttttttctttttttatcatccacccaaagcaaagctcatcataaagtgttatatgctgctgtattcactatttcctttgcccaattgtgttcttgctgggagagcttgccttcttctaatgtaccttaattgtactggcgtttatttcagctatgacaaaacctaggagtgatttgtgccactgtggacaggagatgcctgggtcttcgtgaggatcacagacttagtttcttataaagctgtgaccaaaactcagtttgcctctagtagagagcattttcccaccctaatgtttcccaaatttacctggaatgcccttctaaaaaatactgggccttccctcagacgtcagtgagctccaaggcagggcctgcggcaagcaggactttaaaatgtgtccttgtgacccttgggactacactgagacaagattaggactaaacaccagcatttaaatgcctatttacttagtaattgttttctacatttagttttctcctgaaattatttggggtactttaaaatactacagattcctgggccccaccctggattttccaagtcagagtctctgggtgtgggacttggatatctatctgttgttgaacaagtgccccaggtgaaattggaactactgccccggaggtgtttgggaaccacagacctggtttctttccactgtatttttactggctttaacaaacaaaaattaaatatttaaaacaaaatgtttaaactgtgcttaaaattatatttgatatttttctttgtcctcctacccaaattcttttgagccttttctgtaaggaaacaaaacgtctttttagagtttcacaagggaagaagccttttagttgtttttttttttgcagactcatggtaaagaatgtttctaggctttataaaggtggactccatgctatggtgttgtgttttacaggcaggttagatgtaactgaggattgaaagtggtaaatagaacatgtttcttgggaaatgaaaagattatttaataataattattttttttttgaggctgagtcttgctgtcaccgaggctggagtgtgcagtggcgcaatctcggctcactgcaacctccacttcccggattcaagcaatcctcccacttcagcctcccgagaagctagaattacaggcatacaccaactcacctggctaatttttttttgtatagttagtagagacggggtttcaccatgttggccagggtggtctcgaactcctgtcctcaagtgatccacctacctcagcctcccaaagtgctaggattacaggcatgagtcaccgcgcctggcctaaaaatatcctttattatgccgtagtcctcaggagcaattatgtagctagaggcaaaacaatttggttttctaaagcagggagggagccgcctctctcctagctgaaatgaggactgctgccagctccaagtcacttttgttggtggtacagtccagcttaaatgtggcaaaaagactaatttgaatgataaattgcactgaggtcgatatatacccaacaatgggcttcggggacttggaaccattgtgggtggagtcttgtgattttgtgacgtaaaatttcaaaatttgctattagcaagtcctatcggttgctgtccagcgaaaggagtgaaaagccagtgaaaagggccatggtctggctagaagaagggccttgggagttccatctctggtcctaggcttattgtcccaggaactctcaccagggacagagcagatggaggtggcttgctggtcaatgcccttcagaggaaagatcagttccccaccagaggccaggaggcaaagcaacaaggatgttaaggatggggttggagagtactagtttcacaccaggtcttcagctgcaagcttccatccctgcggtagtctaggcagcctccacggggactgagaagctgggagtggctggtgtgagctgcagccagggggcatctctccgagctctccagcctctgggctgcgcagcagaaacactgactgccattaccagggcagggggtagggttgctggcctgcctaccaacctccccagttccccagggactgactcttggccttgttccgagggcacacacggctggtgcctgggcttgcagggttttatttcatggatgtctccaaaagcctctacctgctgtggccattgtggggaaacagctactcgtctgctggctgcctttggaagctgtccccctgtaagaatacctgtagtaggcttgagtggtgtccccaggttgttttcatggcgtgcctgcgtataactgtggatcccttcgcactttttgatgtcctctctgggtgggctgagccttcatgtgtatggcatggcccatgtggctgccgagtagctgtgaagagtctgctggaggagccatctgtgagcagctggtagaagcatttctaaaaggtgcctgtgttgacaaaggtgtgtcattttcccattttggtcacagtgcataatgttagagggcagctggctttgtgactgattgcctgtaggattttgtgaaatgctgtgggtgaagaaaatatcagatccacatagcaaggttgtatctggtgtttacaaagtatatgtattacatacacagcaccgaggttggcttggagtttaagcctcctaaggtaatgcgtccaccccacggatctccagtgctccctgtgactgactggtagaaattagtagtgcagggtgaccctcgtttgatggggccacggaactacaaagcaaagggcgatcttaggcaccctcccagcagaaggtggaactgggggccacatatccctccatttagagatgtaagtagcagtatcactgcctttctttaatgactgtgagttatagcaaggaagtaaaaaactgttccagaggcccacatgaaacatgctgtttactttaattccccactgaaaaatcagttgtaggagatcaccggtaggcattcccagcaggcttattgtaagtcctgggacatgacaggaacagggttctgacctgcctttcacgtggccatttaagtgatggcaccaggaccttagcatgacacagagtcctgagctctcttggccaggacgaaaggagccacaggagctgagtattgtggaaggggtctatcgtggttgtctgcttctgggagagggggctccagggctcccctcccctagcaggaatgaaggtgtgggcataattcctagtgcacggcattcttccaggataagttgtcctaatgccacgaaaatttttgtgctgctctgaagcctcatgtcttagctttatatacttgttaatctgtgccttcatgagacctgtgtctgggcaaaaaggagacattccttcagataagagtcagcaagtcgatgaccttgccaccttatgactcagtttctcttggttataggctgtgcatgtgctggaggcacagggagggcagtgtgtttctgtctgaaatcaggaggactcacggtcatacagccctgcttaaaatattgcctatttttttcttttgaaattatttttgtttattaaaaatgtatgttaaacttaaatttttgataaatggttgctttctgtggcaaaaatagtctttctttctggctaagaattttcttatccatgcagatttactaaaaaatgtatatttagttgatctaaatagatatcagtttttctttgggctgggtgcggtggctcacccctttaatcccagcactttgggaggctgaggtgggttgatcacctgaggtcaggagtttgagaccagcctgaccaacatggagaaaccccgtctctactaaaaatacaaacttagccaggcacggtggcgcatgcctgtaatcccagctactctggaggctgaggcaagagaatctcttgaacctgggagttgcaggttgcagtgagctgagattgcaccattgcaccccagcctgggcaacaagagcaaaactctgtctcagaaaaaaaaaaaaattttttttctttggcttttattctctatggattgtaagaatactaaaatcttttttttcttgaattccgtttattgactgaattgtattttatagttttttttggttgttatttaggagagaaacatggtaatgttctgtttctgcaataagatttaataagtagtccacaaatggtcctactcctcctatttctcctcctataactcaaaatttgtaaaactggaggatactttatagctcaatccccaaattttatagataaaaagtttttttcttaatttcttttgtaataggagggattaacttggagatgaaattagcaataatatctgaaaatggcagctacagaaaaaaagaaaaaaaaattagcaataagacaatgtctgagaacaaggagtcactgaacatattttgcctgcctaaaaatagtttctataaataattactttaaaaattaggccaggtgcagtggctcacgcctgtaatcccagttctttgggagactgaggctggaggatcacttgagactaggagtttgagatcagcctgggcaacatagcaagatttctgtctctatttctagtttaaaaaaaaaatgaaaaaaaagtaaaccctatttaagttaatattaaaactaccaatataatattgaaatcatcattaaacataaagtgttgaagttaaatggagagagaaatatatatgaccagcccttgctttactggtctttgttccatttgagtaaaacaaagtgccacatctggaattgtttaaaacatggaggtggtaggggtgggtagagagagacaggtatagatgtagatcttactactggtcagatttggacgtgctttaaaggagtgataactagagttggagatggctccgcagagtagaggaaattaaaattagttaggatttttgcaggggaaaaattgggatagaggtatccaggaaagaagaaggcataggaatctttggagctgaagggaaatagttagttcattgtgactggagtgtagggggtaagaagccaaaggcaggaagtgaggctggtagaacgggtggaaagtagatacttgaaaatatttcaaatcaacgatggactttatttaaatcctgcttcggtgacaaatgtgttttctgtctgtacactggagtccaacaattaggaccttcttactggagcgttctgtattttgataattgatgtaaacaaatgtagcatgctcctgcttgtcaagtttacaagcagagtttcctcctcacaattagggaggaaaaacatctgccagctgattctatgcgctgaccttctttaggcctgtactgtaatttctctgcctccagggatcctgggggcaggatggttggagtggctgcctggctacctcttctaatggaaacatattagacatggtgtattagggataggaaatgtgtttcctcacctttgtggggcattgctggtgatatataacttccacaaagagaggtggacaataggctgagagatagagacttaggttcctcgccagctgcatctgggcctggatgggtgggccttaaccactcttttggtctgtttcttgctagtaaataggcgtcatcgttcccgtcccctgtgtgcttctgggacactgtgtgcttagctagacctatttccctactgtagtcactcctgagctgcgtggtcgtttgaaggagttaagcacccataagtgcttgtggccaacagcagtgatctagagactgactcaagttaagattatttgatgtgctctataaggcctctgaagaaagcttaggcaggtaaatattttaaattgttttcatggattttatttcatatataatatttgcatcctgtggtggaaatagaaaaacaccttagtaggtcctgtagcttactatgcattttccagtgcaggggggttctttattagcagatttacactccactgtctttttcttcaagtaatggaatttttttttgatttactgtgcactatggttggtcacaaaattatagttcctgtgaaagagctgaaaggaacatttgtgaaggacttatgctgtgcttatactgttaagttgctcagaggaaagtatgaaggcgagctctgatgcaagagcctgctggggctggagcagaaaattagtgcttcatttttaacttgaatatgccacagagcttctagaggactcgagagccaaacagtggtggattggtcttcgattttctcatagtgatcttgctttgaggaagtttttccctttcctaatactcactcacttataagatagtgaacatagggaggcaggaaattagtttctatcaggtaccttttatgtgccaggtgttttagatacattttattttttactcctccttctaagtgagatgcagaaggtaaagaacagttccaaggtcacgtgtcaaattgagacgcgtggtttcacgttggccgcaggtctggctgatgcggtcagtgttgttgccactacagcgtgttagattaatatgcgatattagttcatttctttgaaatcttcagagagaagaaagaatgttttcttaaagaaattggactagtttgattaataattttagcatcacatatcctcccactgaaacaggtgggaaaactgtgagaagttatttgctcttgaccaagaatgtatttaagacagttaatgcaaattttcttatcaatgttatacttagaaatcaaatgtgtaatggtactaagaatatggcagttgggtaacattaagttaaaaaaaaagtagtaaaaattacttttgttgacatacctaatgtggttataacaaggttcttttaagagaaacacaagattgccatactgaaatccttctaatgctgcgatttaaatccatacacaaacaaatgctgttttggaacttttcagaatgttaaaattgtcttcaatgaatgtttatgaagaaattactgaaaaagcatttcttaatagtgaagtgcctgttttttttttcagtctatcgtccaaaacactcttttctaaatgagtagcaaaggggttaaaaaatcattaatctcccaaagggtctgtgagagagttatgtggttaggtattattattgcctcatttataaaccaagatccggagtgactccttaaggtcacaaaacaagccagtattgaagccgggactggaaccgacgtctcctgcctcccagtccagggctgttaccactcccagggagttgaccaatcatcacagttattaatatcccacttgccacatgctacaagccatgaacataaatattttgttggcattttatcttcatgctccctatgtgccaggctccctttctttctatgttcacagccccttctaataactcacgttcttgtctgaccacattggcctttgcgtgaaagtcacacgtcaccccggcagggaatgttcaagcatgcggatttgcatactttcattctgatctcaaggctttttctagacttcctttttttttttttttaaatctcgtgtgtgtgtgtgtgtgtgtgtgtgtgtgtgtgtgtgtgtgacagggaggatggtaagaagtagtttaaaaatgcattgtgtgctacatcaatatccaatggctttgtacattaggaaacagtaaagctttaaatagtttgtaacatatgtccacataatttatcacagaattgtggtttatttaataagtgactcattatcactatctgatagccagaatactggataaagaataagtgtgggcagaagttattcaccatttcttatagcctcatcccagaatacagctcttctttgcaaattacagattctttgcagttttctcccacccgcccccccaacgcctctataagaatatacaaaattgtcagaaaacatgaaataatgttacgggaaaacatggccaaatttaagaaatctggcttagattgctctgaaaggttattgctaaatgaatcttcgaagaaaacgaattcctttactggaacaaaagtaatttattatgcatttcatgggtgtctgccagaagagttactagcagtatgaagatccagtggatatgaattaagtacaatctgttagttctgttcatgtttagacctacctgttaattttctctgaaattttaataatttaaaaaagcatctccatagacaggtgttggcaatgtgacaattcaccactcagctacccatcacatcaggcttttttaaaggcccagtactcagaatttgtgagactgagcacaaagacattattttattgacctcatattttaagaatgatttggacaaatacataactaggcattgattctaatgtcctgttggggtcttacgagtaaacggttccaagtcaacatctgacgatgcttaaatcatgatccgacttgatggtgtgctgcctgttttggttgttggcctggcacggtttcaccagagctgggccacatgctgcagaaccatatttttattttattaaacacaagtattttacatttaaagctctcattaaatttagttgcttgattcgtggtgaagcctgaatatggtcaaaagtttattctgggggttcacggattagcagctgggaggaaacagattccagcagccaggcgctagctccagctctgtctgtgtgagtatagcaagctgccaaggttctgtaaagcctctgttttcctccttctactaaaggggaaaagtaattcctaccatctggtccttaggagtattgtgtagagtgagtgggagatgcctggagacctctttgaagtttaagaagaatagcactacttaaatacgggtcttggaagttaatagtaatcagctttatttgcgtggcattttttttcatcccaagatattagaataagatcctcactttcttaatggggaaatttagagacgtagagttattgtgttaagaaagtaaccacattttagagatttgtatttcactgatagcaaattttttattccttctgatacttagtactttcctaatgctttttgtggtttaagtgcattgtaaatgcttcttggtatgttttctgtaattaagatggagagattaagatgctcatccatctcctgaaaagtcagttttgttataaaaattaagatcataattcaccaggttttaaatcttgcctcaggattctgtcccacttaatttgaagattagaatagtgtaattcattctgattcatttagaagataagctttttctttagggtcctcattgacttcaagttgtgggacaaaccctctcccttgcaatttatatttgtacatgagtattttggtgataatcccagagtacttataaagtttggcgcctttcttcaccacaacatgcttgctgttgagtgtgcacagatacataaagcaatttgctcttttgtccagaatagattatgtgcatagaattgctttcgtcttcttgaaaagggcagcatcccttggtgtggctataaccttgcctactcaggcctagaaggggcgagaggggtatgggttggggcagagtgggggagcagccggtgaaatttccagtaaggaatttgtttgccgaattaaatatacaaaactattctgctgaatagttaggtcatcagttgaggtgacggtgactctctctctagagaaaaggtgtccatgttcctttgttttattaagctgttaagaattcgagagtttcattgtgattggttttcacatgtcctggtggagacagaatttgtgtgtgttcatgtgtctttcatgtgtcaccttctaaactattactgtcactttgtatctggtcctctgttacctccagccaaactgaaatgatcgtagtttatatagtggaagttacgatttgcaggaaagcatttcccctttgttggaatttatacaaagtttttaattcctctttggaggaaggcagctataaagcaccacaggagtctaacctagaggttacaaaagcagagaagagctttggcagtgagggacggctggcttcccctcacacaagaaaaagccgtaagcacagtctcactcagatgtgtaggaaggacggatcagaggctgggggagccgacagtctgccttgcagtgaaggaggcatgtgatcaccatcaaagtcttctgctctgggaaggatcacacagtcgtccttcagcctgcctggggcgcagtgttttctttcctcagaccgaaactgcatgaagagagattccagcaaggaagatagagcatgccccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcagatatgtgtccaaaaatgagtgaaggctcctcacaggaaaaaaaaaaaaaaattctaggtgatctaaagatgaactgtggctacttctcaggctagcggatattttccatgtcccaatctgtagcagcccaagctctccctgaagtcatttactcctttaagagggagttttccagcccagctgctctgcctgtctcccacctaacccggccagctttcagtgctaagcccaggctgggtctggccctgataacacattctttcaacaggaagtgcctccattttcagttgtctgtgggagggtggagggcagataagccttgaatggaaacacagagccgatttctgctccaccctccttgcactttgatcagggagagagcagggacctccgcctggcctgtgctgcctgccgaaaggagggaggatggttgagctgtgggcattccggagctctccctcccttttgttcaggaacgtttgtttaggttggtctaggttagtgaagtgcctgcttttgcagggttgtgatgtctgcgatctgaactaaagtcctttgaagggttgaattatttgtgggaaaatatatcaaccaattgaaatttatacgtgtgtttgtatgtgtgtgtattaggtccaggatcatagtatatttttctctgatttcccccctccgcccccccctcccaacacacacacatcgtgttgattctcagtaggcatctcttgactatcatcagtgagggaaagggacttaaaagatgaacaataacaggacaaagccaggcttcttaagaagagtagctgtgccaactctgaacgccttctacttttagaatattggtttagaggccaggcacggtggctcatgcctgtaatcccagtactttgggaggtcgaggcaggcggatcacttgaggtcaggagttcgagatcagcctggccaatatggtgaaaccctaactctactaaaaatacaaaaattagccgagtgtagtggtgggcgcctgtaatcccagctactctggagactgaggcaggagactcacttgaactcgggaggcggaggttgtagtgagccgagataccaccactgcactccagcctgggcgacagagtgagagaatatcggttttgagagctgaagttacgctgatgcatggagctgacgtgttgattgttttaacttgtatagaactgtgagattcacatgtgcgtggctggccaggccctggcctgtgccaggtggcagggagatgatttcaggggcggatgggggcccttctgacccgccctcctgttagtgcctcgactctggttccctcctattttttcaagccactttctgatcccatgaaggttggcttgtccctcaagtgccttgtgtttctggtactcatgtcttctattcatccccaaagttattaggttggtgcaaaagtaattgtgggttttgtcattactttcaatgccaaaaactgcaattactttggcaacaacctaaatagatttactatgcaattcaatttaagtattcaaagaaaaatattcaaagaaaggtatagatggctaatagacttggccctctcagctagtcccctgtttctcccctcctcccaggggacctttgtaatacttacacatgtgcatggataaattgcagttatgacgtgtaattcatatcttgctgtttttcacttaacatggtattacaggattttttccattttgctccatgatcttattatttttaataattgcataatagttcattgagcggatgtgccctgcttttctaaaccgttcccatattattagacattagattgtttctatagtttctactattagaagtaaccttgcaacggttggcttcctttgcggagcctttcccttcttttgaattatttccttataatacatttccagaagtgaaattatagggcgaagtagggtctaaacttctggatggctcttgacattgcagctaactgccttctgtaaggtgggtgtaccagaatttagctccgccagccatgagtgaggggactggtgttaccatgtaagtaacatcagcctttctttgcagtatttcatgtttaaatattattatatgtacacataaaataaggctaccaagcattgggcacaaatacttgccccattttttttctgacaggctcagctattgcttttaattgcaaatgagcagatttatttctaggagtgcatcactcatggaatttgaggtctgtctgccctttgatagcaggactcttggcctgccaaatagcttaacattttgtctgaaaaaaagacaggttattttcgccaattgcttttgggattgttattcaggtgtaagaataacattcagggtgttaacgtttctttaatgtgggttgttgaaaaagagtcagtgagtcaccaggtgtggtagctcgtgcctgtgatcccagcactttgggaggctgaggcaggtggatcccttgagctcaggagtttgagaacagcctaggcaacatggtgaaaccccatctttacaaaaaatacaaaaattagctgggcatggtggcacatgcttgtggtcccagttattcgagaggctgagatgggaggatctcttcagcccaggaggtggaggttgcagtgagccaagatcacacccagtgcactccagcctggatgacagagcaagaccctgtctcaaaaataaaaaataaaataaaaaagagaaagagtcatgagacttttgaatggctacagaacactttgatttatttttgcgaagaactgtcagtgacagtttgaatagggtcattctggaggtggttctctttgagctccaactgtgttccgactgcttctgcccctgcctggtgatggggtaacttgcttgggctgaaggatagaatgaggagaataaattagatccaagcctcttaaccttaacaataataattagataacaagagtagcttatactgacataatctttactgttctcagacactgttacaagggctttacatatattagccaattctttttttttttttttttgagatggagtttcacttttgttgcccagactggagtgcaatggtgcaatctcggctcactgcaacctgcctcagccttctgagtagctgggattacaagcatgctccaccttgctcggctaatttttttgtgtcagtagagatgaggtttcaccatgttggtcaggctggtctcaaactcctgacctaaggtgatccacctgcctcggcctctctaaagtgctgggattgcaggcgtgggccaccgcgcctggcctagccaatttaattcttgcaataatcttatggcataggtgcctctttttatcccactttataggtgtggaaactgaggcacacaaagctgtatgtcaggcttctggtttacctctcccacatggtctgttcactcttttgcttcatccttctgtttttcagctggcttttcttctgaacaggccaggtgaccacctctcttcatccgccctgcctcccattttgaacatccttctctcgccaataacaatagcttccctttacggaatgtttaacatggcaaggcaccttgccttcgcttttacaaacgttagctcatttaattgtcgcaaccatccctgaggtgggaaatgtgaggacccaggcacagaggaggctcaggggggactgcactcagcaggggactgaatcaggacaggacttgagagtccaagctgcttcccctccttctcatactcctgtgtgggctgcctttggttccttgcccaggagtccttgccctctgctattccttttctgactcttggtctaccttcctgtctcagccactcatttgttgttcatgataagcagccaacagtcgactttctaatgtgtatggatcctggctccccacaaagcctgggagctcctggggcagttgactatctttcaggctcctgatctagtgtctggctgtcagttgttgctttgccaatgtttctttttttcttctctttctttctttttttttttttaatttttactttttagagacagggtcttgctctgtcccttaggctggagtgcagtgatgcaatcgtagctcactgcagccttcatcacctagactcaagcaatccttccatctcggctccccaaatagctgggactacatgcccagctaacttttgtattttttgtagagacggggtctcccaatgttgcccaggctggtctcaaattcctgggcttaagtaatcctccctcctcggcttcccaaagtgttgggattaaaggcacgagccaccgtgcccagcctgcttatgcttcttgttgctggctgtggtggtggtgacagatccctctgctgtcttggcacttccctgccatttgagatgggctatttcctgggccagttcaggaaccctctccatttcagaaaataacacttgttgcggtgaagtcagatttagtcagaggcatatgctgatgtgcctgttttcgaataagaaaatcaatgcaaagttggacgtgagatgtatcattataaggaagctcactctaatagttcctttctaaataaataattcttttgtaattgaatatcatccttttgcttatttctttgagggttaaatctggatccacactggatttgcttctggtggagtctctggaattaagggctaaagttaatcactatgtttataagtataaccaagtttatggcattcagtttgttggacaggattattttagctttttcagaattgccacaagaatccatctgaagctttagacatctcactgatttttgtgaaatttgctttttaatgcacctaaaaccctcagtttaagtctttacatttgtgttatataaacaaaagtttgggtgtggggccagtgttgttgctggattttcataaaacctcatttctgctgggaaagggaaggagtggttacctgtggaggggtcgggtttggtctgtctggttgggaggaaggaagtttgggtgcttagactcagagggcttgctcgcctgaagtcctgcctcccagcctcatgcccttatggtgagggttgagagcaaaccagatcttgttggaaaacgagtagagttggacctcattcacttgcaggccgtggaggctcggcacacttcctttctgttccgcctgtgtctggtgccagagaaatgctgttttaaggatttaatgggattatgtatgtaaaaaagaaattctgtgaaaagtacacaatgtcctacctctgtcaaataacaagtatctggtaatttatagaatggagccctgaaagcttggaaggaataagagctcctgaacttttagaaggaaaaaggtgattttaaaaagtacatgattatggcgaaatttttcaaaaagcttctcaaaagcaactttattcaaactgttgtctaaacagattttagttattttggtttgattttactaaattatatgatgtttcctatttggcctttttcatgtgaatgggaggaatgggtggaacagggcaaaggtgaacttgtgcttcaagaaatcattgtggccaggcacagtggctcacgcctgtaatcccagcactctgggaggcccaggcaagcagatcacctgaggtcaggagttcgagaccagcctggccaacatggtgaaaccccgtctctactaaaaatacaaaaattagccaggtgtggtggtgcatgcctgtaatcccagctactcgggaggctgaggcaggagaatcacttgaactcaggagatggaggttgcactgagctgagatcgtgccactgtactccagcctgggagacagtgagactctgtttcaaaaaaaaaaaaaaaaaaaaaaagaaagaaatcattgccatgatcatggcagatagaggatgttagcattttctttataacgtggtctgcttcagacatggactgttcttgtaaagaattaaggtaaatgaggtagattttaaagcctgtatatgcataggtttattttccatgaagtcaatgttcaaaaatttcactgatcagggaatgttgaactgtgcagcttttctaaaaagtctaaaaagactttgccatcactggataagccttgttagagtgtgtgtgtgtgtgtgtgtgtgtgcgcgcgcacgcatgcgtgcgctctgcattttctctttggaaatgatcaggttgtgtgtgcatcattaatgcctattcacccacacagtgaggtttgtttcacagtcagagatcttagagcttggcactttttacaaataggatttcttcagttccccttccttttgtccagctttgcatcttgccagtggctcctgccctgagttctaaagtttcgaaggcttaagtggccagggtcaggtcagtggcactgtgtgcaatgcagggaaaggcccccacttgctgggggcaggggatagtaacgccggcttcatttctcctgccctgggtctgcccaggagcagctctggccctggctgcacagacccgttcattagctcccatgtatttcactaccaggattgtaaccgcttctcaccttctcgtctctcctctgtgtccccctcttctgccaggcgggtgccccggtgatgactggtgcgggagagagcaccaatcccgagaacagcgagctcaagtattcgggtcaagatgggctctacataggcgtcagtctcgcctcgccggccgaagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactccagccagcccgcctccggggcggaccctgctccacttccagaagccaggactaggacctgggccttgcctgctatggaatattgagagagattttttaaaaaagattttgcattttgtccaaaatcatgtgcttcttctgatcaattttggttgttccagaatttcttcataccttttccacatccagatttcatgtgcgttcatggagaagatcacttgaggccatttggtacacatctctggaggctgagtcggttcatgaggtctcttatcaaaaatattactcagtttgcaagactgcattgtaactttaacatacactgtgactgacgtttctcaaagttcatattgtgtggctgatctgaagtcagtcggaatttgtaaacagggtagcaaacaagatatttttcttccatgtatacaataatttttttaaaaagtgcaatttgcgttgcagcaatcagtgttaaatcatttgcataagatttaacagcattttttataatgaatgtaaacattttaacttaatggtacttaaaataatttaaaagaaaaatgttaacttagacattcttatgcttcttttacaactacatcccattttatatttccaattgttaaagaaaaatatttcaagaacaaatcttctctcaggaaaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttttaaaaataaaaagggtattgttttgtcttctgtacagtgagttccttcccttttcaaagctttctttttatgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggggacagtttttataagtgggaaggactcagtattattatatttgagatgataagcattttgtttgggaacaatgcttaaaaatattccagaaagttcagattttttttctttgtgaatgaaatatattctggcccacgaacagggcgatttcctttcagttttttccttttgcaacgtgccttgaagtctcaaagctcacctgaggttgcagacgttacccccaacagaagataggtagaaatgattccagtggcctctttgtattttcttcattgttgagtagatttcaggaaatcaggaggtgtttcacaatacagaatgatggcctttaactgtggctccctgagtgtacagtatttttttacttcttttcatgcacttattacagtcattctatggggttcagtctgaatctttcaagagaaggaatgtcttccttagtcctggtgaatgctactctatagagggacagtgtccatagccagtgtgtgtgtgtgtgtgtgtttctgggtaattcagtaaggcccacgtgcaccctgatatcataaggtgggccagaacaatggttaagagtgttgggtatgcaggcagatcactaggcttcaattccctgcttggccgtggataagctctgtgaccttgggcaagttatccagctctcatctttctaatataaaataaaggcaaatagtatataaatcacaggattaagtgagatagtccatgccaagtgcttagcacaatacctggcacatattaagtactaacttgactttgaaagagagtggcatgatttgcaacatagatcctttgaataatgtctgactacctggaatatcagaagtttatggtctgtaagagtgatgtcctgtgggtcacctgtgcttcttcaacaaggccaagaagagtgaaatgaaagactccctctaatccagggggttgcagaaatggagggaggatgcatgagagctgattgttttataatagaacaaggctgttctgacaacagaagaaaattattatccccacgaactgatgtctgttttcctccctccttttatggttctcattactttgagtgctttttggtgggttgggagttgttaaagttaatatggtttgattggaaaatgaatttttctttttggggcttccaaatgaccctttttctgggataatctcaaatattgctccttccaattctaaaaagaattctagtttttatgaaacaaattacagtgggcagaagacagagggggcttcttgtagcctgtcctaacacaatgaactccactatctgtttttaaatgattactttcttacctatgattgcataaagaagtttgttaaatttgctccaaatacacaatttcagcactcctctcccaaagtatgacatgtgcaactgaacatgacccaatcatttctcaaaagggaatgcattcaaatagatgctgcacctcagcttaaagaatccccagaccgtatatcgtggactggagaatttatgtcttctgtcacacatggctgatttgaggccatcttaaataagtgaaggctctgtctggggtctcttttcagggtcacttaatgttgtttcctggtgcttatgggagggtcaggaaagcaaagggaaccattcatttcccagtgcaaataaattaacttcttgctcatgggaaatgtttttcacagtccttggaaatttgatgtaatttcagatcacagataaattggctgctttgctgggagggcaacccagcgagtcttcaatgctgtgccagattcca

SEQ ID NO: 12476 - DNA, 17032 bp, Human
tggtcttgaactcctgacctcgtgatccacccacctcagcctcccaaagtgctaggattaaaggcgtgagccactgtgcctggccagaattaggtttttataaatgtgaagtattagattcttatcaatcggcaaaagtagaactgaggaactatatcatatgcttataaactgatttcttcttagtttttactcctatgatgtttctgttgagaccagttgacagagtaggagtgtcagtatggaaaaagcatggatcattttgaaacatggattattcatcaattacatgtgttttagaatggagtcagtgatatactcttggagatgatctcccccaccccccatctcctctccttttcctttccccacatctgtagccacttcctgtcagcgaaacccagaagaaaaacttgacagaagcaaagggcatccagagaattatgatccccaggttgtagttccagttctgtcatgtcctaagcggtcatctcctctctgggtctcaggtttcttatgtataagataagtaggagattggggccacaacacctgagactaaaggaattctaagttttcattactctacggattccacctttgctagcttgggacctggcaggtctcagcagctggtcatgtagctaattctcaaagcagataaatgcctgcaggataactgtgaattgactctaatcacagcagagtccagctgcttcaatagatgctggtgcctttggctgcttcccggagccaccagccaacccagagttgaagctggctggaaaagcagatatgttggagaggccagcatcatctctaaacacagcatctgggaaatacccatgtccccagaaagaggtcattgaaatccttcacttggtggtgcagtgcagagactcaggaaaaccaggctttgagtcctgaccctgccacttataccagcggtgtgaccttgggcaaattctctggccctatgttatcttcctcctccatacaatgagggtagaaatagagccaccttgcagaagtatagtaaggattaaggtcccaggaggcctaacagtacctactaagcagaggtcctcagaggtacttaataaatggtagtagtagttattatcctgtgccctttgttcacaggagtctcttacaggggtgttggtctcagtgctcctccccatggccaggctgtattggctcatgcccaaggcgtagccttgccagggagcctggtacagagatgctgctgattgggatgctgattaaattccctgattgaggagcctcagcattctggcccagagcaggagggccagcaatatttagcacaatctgcttggatcctcaattaaattgtttttccaaactgcccttttcaaggtcttgtcctctttcctcacctctttctggccccttctctctgggtccttgccagagaagggaaacaaagccttgtggggctccatctgcttccccctatccagaagaaggtgacaaggctgtcttcgttgcagaagatgtggttaaaacaagccttggctattcaaggtggctgcagtctcatcctggaggctaaagtctctgcgcattccaggttgatctctgttttcttggcaaaactgagttctcaactcaaacctgcctctcccttccatcctttatcccgacagctcgcaagtgctttgctgggaaggaggattaagtgtcacttagtgtatttttccattttcctgtgttcatctggtaaaaagaaaataaaacaaaataaaggaggcccaggattgaactgtcattattttttaaatggagagagaaggggtcacatgactgcgagtaactgatttagccaagtggctgcaactccgagtttgctgcagagccgccccctcccggcgggggcgctgacgtcacggaaaagccccgcggcgggtcggctgggctggttataaaccgcccggccgcggcggctgcaggcggcgggcaaggacggcgggcacagcgcagcactccccgctcgttggcccgggtatcccagcgcggacccacgcgatacgctgacgccccgacgccgatccggccgagccaagtaagggggacggcccgagacggagaagggagagagtgggagtttcccagcccgcagaactttcgaagttgagaagagaacccctggaacgtgcgctcagcactgggattttctggtaggggtcagagcttcaagtgcaaaggatgtcgcttctcatcagcaggttccttagttcaattcggtagaagggtcacctccctctacagatcgagtggtcagagagggcagcccttaatgatgctttatgtatttgttgtttgaatgtaagtctgccaactgaggtgctgcttttgagactaaaaaaccggctggtcgtcctggttagtggcgagatgttggggtacggagtgtgggggtgagggtgggagaggagtgtttgtgcatcttgctgattgcaacgtaagtacttatactttgtcaccagtagccggaaaaacagacctcccggctaggggaggcagtctgcaaagggaaagttgtagagaagttgttgaatatcatttaggggagtcttcagccttctgatttgcttcaagaaggggatctgagaatggtggctcaggcctgtgatctcagcactttcggaagccgaggccggaggatcacttgaccccaggagttcgagaccagcctgggcaacctagtgagaccactgtctctaccaaaaaataaaaataaaaataaaaaaactagtggacgtggtagtgcaggtctgtagtcccagctacttgggaggctgaagtggaggatctcttgagcctggcagttggaggctagctacagtgagctatgatcgtgccactgcactccagcctgggtgacagagcaagaccctgactcaaaaaaggaatctgagttgaattaaagaactcttgagaatggatgtggttttttaagaatgaggcactttctctgcaaatttcataggtctgaacatgagcaggtcatttctctgccagggtgtctaggtttggagccgggatgttttaaaagtggtatctgtgggtaagagggcacagctgaggcataaactttaaacagaaaatttcccccctacccccaataatggcaggtggatgctctccaggcagctggagagcatcaaggcaactttactaaacatggaagttccaataagtgcctgtccagtccagccagggttgcagtgggcaggggaggggagggtgatgtcattgccacgtgtttcccactgaggcacaaaacctgctggacactggtgcaattaagagccaagtttagacaagagcagctaacctgaccagctggtccccagcaacattaacttgttgcttttcaagccatctttggagtctgctggttctttccagctgcctttgtgccagctctgagtgcagctcttctttcatccaagtctgctttgaggaagggggaagcccatgggcagtgggtgatgttaaccgtatttgttttcccatgcaaatgatagtctgcctgaggagctggttactgacagtgtgggcagcatgtgtgtgtccagttgaaagcctgtcttgttggggtttgggggactgtttaattggtggtctttatgttagggatacttgcttctcatctcatctaataaaatattactgatgactgaccatgtatttgagcggagctctcactcatgcttactaatgctgccatcttggctgctttgctccccaggactcaacgatgactctgaataatgtcaccatgcgccagggcactgtgggcatgcagccacagcagcagcgctggagcatcccagctgatggcaggcatctgatggtccagaaagagccccaccagtacagccaccgcaaccgccattctgctacccctgaggaccactgccgccgaagctggtcctctgactccacagactcagtcatctcctctgagtcagggaacacctactaccgagtggtgctcataggggagcagggggtgggcaagtccactctggccaacatctttgcaggtgtgcatgacagcatggacagcgactgcgaggtgctgggaggtaggtgtcccagccccagtgggcttctttccaccaggggtggcccaggaagaaagagtgagggtgggtgacttatttacccacagagttgggagctgaagttaggcattttggacaattgatgggggagctgagtctctagaaaagcccaagcacaggctttcgggcaagaaaatgaaaatgcttgtagacaggaccaaaatctgttgatcctgggccagaaagggaattcttcagattccaattctaaatgggttggggaaggctgattagagagggcagagccagagggtcagcgccccacttgacttctgctgactctgacttgaacattcttcccggaactcagtatagacacagcctttttccatggttatacctaaaacaagccagttggaaaagctgttaggatggcttgatcagtttgcttccaccaatattagaaagttttgtgggtgttaaatagttcaaaatctgtatttgaaatagcataataattttttaaaatgtgaagtataacaatgaaactttctatagagtctgacagcttttcaagacaattttccctgtacaatttcatctatttattgattggagcctggcctatttccaaaactgttttgaggtgacattatctcaaaatgcatgtattcttcagctaggggtaaagcacagccctatgttctgctaagtaatatgaggatcctgatagccaatgccatccataaagtgtctttcagccacagcttcagtctgagcgtatgcgaccagggtagttatatgtccctatttgcagctacagaaataaaggaagcactgctcagtgtttccccaagtcacatggtctgtgttctgtcgcgactcacaactgaatcacagagtagggaggtgtcttagcgatgactcagttctcccctgcattgatgcatattaatgttattcctcactacccacagcccatctcatctggaggttttattcttcttgattgtctcagtgtcaaggagttcactgcctcatgaggcagctcaggaactgggctataaataatgactcattgttgtaacattgatttctctcctcactcctggaatctcagaagagtaaagggagaaatagggccagtgttgtacaattgattccctctttctttgtaaaggctgccaggtgacttgctaggaaagagaaacgggaggaaggggctaacatttagagtgaatgtttgcaacgggagaggcactttgttaggtgccttatatttgctgctgtttattttggtcttcacaaagttcttgtactcatgagtaaactaagtctcagggagatcaaaagccttatccagaatcacccaataaggaaggtggatttagaatttgggattttatcatcttagttcagttcattttaccatttctggggaacttgctatgtgccaggcactgtgttaaatacttcccacacatatttttgataatacttgaatcaatctggcattaatatacctatttgacaggtgaagaaatggaggcttacaaagtcaagtgactttcccagggtgaaaaaactagtacatggtatgaccaggattcaaatctagttgtgattgaacccaaatcctgtgtcttttcatagccccctgcagccccaggatttagcttccaaatactaagtatgacagcacattgggcatcagccacacacctggctctggcctaagctctgggatacaaggcgatggatgaggtataccatgccccctagtaatgagctaagtgttagttgctatgttgcagagcagggtcacattaactaatattttaagcagtaacgatacagtgctttgggcgttgacataaggaagagatggactgggagttgttttttgtttttaagagggaagaattgaaaaaagttagtggatagtagactttcaaaaatgtttgtccattagaatggagttgtatgtatccagagggtaatattcccataggcataaaatgttaagaagactgactcatacctggaatttggaaaggtagccttcccagatattttgggaacttctttgttgagagagagagagagagatgcccaatatgacagcacattgggcatcaggcatatggctgatcctggggccgcaggggaccatgaaaagacacaggatttgggttcaatcatgagagaaagggaatcctttccctagcttcttacacagagaatctgtaggacctgctggaatcactagttggttttgtttcccaagaggaaggttttctaaggcacacccctacatttttttttttttaaatcagcattcactgtaagaaaaaaaatcgacataatattctcataatgatttctcctaataaagatggatattgttacagttacactacagtaatcttatgactctctgtatacactgaatgccattaattcattcattcattcctaagaagttactgaatgtatagcacagagcttggtgaggcactctggggacatgcaaagagtcatggggcttcttctgcggagatgctcacagtatgcaatggagcataatgtatacaccaagtagaaattgagataggatgtggtaaatgtcttgaaagtggtgtaaggagagtgctgtgggaattccgaggcgaaaagattacctctgactgtggatttaagagcttcatggttggcccggcatggtggctcatgcctgtaatcccaacactttgggaggccgaggcaggtggatcacctgaggtcaggagtccaagaccagcctggccaacatggtaaaaccccatctctactaaaaatacaaaaaattagccgggcgtggtggcatgtgcctgtaatcccagctactgaggaggctgaggcaggcgagtcatttgaatctgggaggtggagattgcagtgagtcgagatctcaccattgcactccagcctgggcaacaaaagtgaaactccatctcaaaaatgaaataaaataaaataaaaataaaaataaaataaaataaataaaataaataaaagcttcatggaagagatggtctctgaactggaccctagggacaactaggatttggaagccctgagctaggtgggaaggcacaccacacatatatagcaaagtacggaagtctcattgggcttggggtttgatgatgggtttagacgcagctctgacactgacttggctgggtgctcttggacaagccacttagcctcctcaagctgcctcattagtgtaattggggtaatacctccttcatagggtgttacgaggattaaaggatataacatgttgagcatggagcatggtgcctggcacatagtaagtacgaaatgagcattagttagagctgattctgaatctaccatttccttttgatgtgcttatctttcaaaagtggtggtttccttgcttgtggcccctgtccactttggtcactgttggctggggcccgtggagctgtccagaggggaccggggccagtagagtagaggacagtatttgtagagcaggcatttcttctgaggttccttgggatcccctgagctatgaaagctggaagcagttgaaagttttcagggagagggatgctggagtctcagaactttagaggtgctgcaggagtcagttctggcagtgagagaacacttgggcgggtttcacacacacacagcacttgagccagtcttgggcagaaggggcctcacttccaagcacaaggagtgttaacgaaaaaattattaacatggtaaggaagactttattcagggccattgcagtaggcatcccaatagtggggagagatggggctcaattccaagtacaagaagaacaagtgggcacttagccaaggagcaggtgggagggggtcagaggatagaaaattactaagaggagacgtcaaggttagggggattcttgctgaagtcaggccaaggagcaggtgggagggggtcagaggatggaaaattactaagaggagacgtcaaggttagggggattcttgctgaagtcaggccaaggacttagactatcagaggtggtgggtgaggaatttgatcagatattgaaggtgggggattctcactaaactgacttagcaggattcttgctaaagctgaattctgccaggatggaaacggaagcccagggagaggccgggtagagaagaggattcagaggagcctgactaaagtttggtcagggagagagtctgtcagggggatcaaatgaggaaagacaaactggtctagagaaagtggctactgaccaccatcaccccttatagaacgtctgtctgtccccatcagcatgagttcttttgctacatagagtgtgcacagacaccccagctttcttccagtgcactggagaagtaggggtgtctccagacccagattacggaaaagcctcacagagactaatcagtatccaaacctttctccacacctttactggaagcagatttcaaagagctctcctagagtctggtattcttttccttcccttcttctcacctgattagcacttgaaaaggataaaagatgagctgagcaacttagatgaagagaaacctggagctctggttactcccaggcttgcacctggttaggggagagccttcagtcgggatgccatgtgtgctggaagggtcctggtgcacacagccagaggccgtatctaaactcatgtactggggtggggggtaaagtggggagcacacgtgctgagcagggaggagatggattgttttagcctcccaggcctccaacaccgtaattttcaggcaaaggtaagatcagacagaatgatcctgtcaggaagcttctagaacgggaaagcatgtttttactttcatggctgtgatccttagtccactttttctctagacttgttctgatatctcttaagccaggagaaagttgggttttccttttccgtcagcgattggaacacagtatgtttctatttgaatgactgggcactcaagcgagtcccctgtacctgagtggtgggctgagaaagttcctccatcattgaaggagttgtctgagtgcagggaggggttttagagaagagctaagaaccctgtggtgggaagcagcagtcaggccatccccgttctgtgctgctcaggctctgacagtctcccttgcattgtctaatttacaggttgaggttgtgaggttctacccctggtaatccaaatagtcccactgtgatctcattccttctgcatattgtgagcaggcacacgatgggcgagacagagttttaattccccaagggcaaacacttactgattagaagaatgacgctgtgggaggtggggaaactcacagaaagacagggccatgcctggttaactctcttcttatttgtccaagttttccttctctaaggaagggaaacctctcctgattccaattcttagatgatgaagcattaaaccaggagcagtgtttttcgtaaactgctcgctattgtaaaacaagaagtgccctggttccaacgtagctctcttaagctaggatttatctgtagtgaggaagtgctgagtatggcaagaaccagcttccttcacctgaagaagtgataatggctaacactgactgagtttctactttgtgcccaggcttaatacaggtaattgtcacatagccctaaggtgtgagtactattatcaatcccattgcacagatgaagaaaactgaggctcagagagcctaagttgcgtagacccccagagttcataagggatggcacctggatttgaattcaggtttgcttgttttcacagccacaatgctatatttatcattcgttcactgtacaaactttattgtgcaccagcaatgtaccaatgtgctgggggacacagtaaacagcatagatgcaaatgtctgccctaacattacgagaggggcaggagggacagaaaataatagaataagtaagttaaatgtgttgtatgttaggtggcaataagtgagatggagaaacataaagcagagaaggaatattgtgggatagaagtgttgcaattttaaatggatggccaggaagcacctcccccagagggaggtaaggaaacaggccttgtgggtatttgagggaaaagattctagacaaaaagaacagaagaaaaatgataaatcattatgaaagtcataattttcaaaagatgaaattcaaaacaggaaacctcattgtgaaaatagagtggggatgggctcaatggtattgggatgagggaaatcccacttgcaaaaatcccactgtaccccttttctacgcctgccccccatggattttccaggctggaactgctttggcccattgtactgtactgtgttcacccttcacctacacaagatctgggctcaagtgcagggaggaaagtttccattaccaagtagagctggaggctgcatttctattatactcaagatggaaaaacaagcccacttattcctagggaacagcatttttttttaaaaaaggaagaaacagccaaaacagggagagtctcaagattcattcttgcacttgtccgaagaggagcaatgtctctgagcccaaagctcctgaaattgctagtgagtattcagtaactacccactgaaaggtacaatggacttatgaaaatgtggcttacagtttcactgggtggttaatgtttcctcatagcattaaccattgaatctgagtcaaaagctcttgagtaagtttatcctcacaaatgattttgccatacaaaaggtccaggaatgatgcaaacaaatgccttttactccatgtggtttagtgacacatgttcgagagagacgttctgctggataaggactggaggaattatatgtagaatgttgttgaaggtgacaaaaaatagtaatttgcctttgaaaatatctgtatacttacataattaattgcatatttagtaagtttatgttctagcacaattttctacctgaccctcttatggagaagtgttgcatattcgcctgactccaatatctttgttctttcttctctagaagatacatatgaacgaaccctgatggttgatggggaaagtgcaacgattatactcctggatatgtgggaaaataaggtatgcagagcctgtagctctctaaattcctttagggctttcctttcaacaagttgtttggtgcaagggtgaccttgtcctatatagtaggtgttccagatgaggtgggctcattttcttgattaaaagcatactgctgaagaatgagactgttctaaggaacaggtcgttcacagatgagttctgaataacaagcaagttgtagtgacttgcctttagttctattaaaaaacacacccaaaaagtttatttgttttagggaaaatacaaacaggcattgactgttattttaaataacatacatccatctcatatgaagttgagattctcaataccagtcttcaacattggctttttaaagattttaaaaagcttcagaacctatgtgctagacttctgttaattgaaaaccctcctagtcccacaaaagtgttcttaatctcatcacttggaaaaggcaaaagggagtttttgggaagtcagaaaaggctcatttttggtagattaaatagaaattggaaatgctgtttggcagagaagttgtgtaatttatcaaatcaagctgtagaagatactgaaaagtgaaaactttttggcataaatactggacaggctagcaatctttacagccaccagacatcttataggcatagaagaccaatgcttttagggagttggaagcgattttcttcctttttcctatttttcctatcagcaagtgtactttaggatacacatattgtttctttgcaaactgatgctttattccccaggcctaactgaactcacagaagatcttattgtttcattagggggaaaatgaatggctccatgaccactgcatgcaggtcggggacgcatacctgattgtctactcaatcacagaccgagcgagcttcgagaaggcatctgagctgcgaatccagctccgcagggcccggcagacagaggacattcccataattttggttggcaacaaaagtgacttagtgcggtgccgagaagtgtctgtatcaggtaagaggagcagagccaatactgtagaaacaatcgctggatcacatgtgttttccttcagacacgggttcttccctccttccacgaggctggatctaggaactcattaagatgctatatgaaattttaggtgtgtttctcagactcctacagtcccagtgggtctcctccacactagttgttctcccttgtccatctggtctacctgcaggatactaatcctcccgcttttaaggagtttcctggaattcccaagagtacagggaaatgaaagtagcatcttcatgcaaggaggatagggaactctgatttaggggaactgtgagaaagagtttcattgaggaaaaagaattctactctggctgactctggttcctgtgagccctagaaacactgtcctactctcctactccccatccctggcttctgaaatttcatttgaggcatcagtctgatggggtcacatattcttcttcatacttagctcagggaaaatctctatctgctgagtgggcagccaagtgcttttatagcccttgagattttactggcctaattcagatttgatccctggtacaattataaaactaaaatactacattgccaggccctgctcaggaggaaagacacctgataaagacaatgtacacactagtttgggaatgtcttcctactaggacacaactgtctacagtaatcattttttttccaaaccaaaacttgatgcatggtcattgaatgcaatgaaatacttgaaattgagactgtcccagaaaagcttgtataatttaactgtattacacatttgtaaaattctcaattttttcccaagatatctcattattgctttatttttatttttattttaaaagagaggaaagctaagcagtagaattcttatttccaattctggaaactgggtcaggagaaagagttgagtatgggcttgagaactgagcagacctggcttcactgccacttacaggctgtgtgaacttcacctgcagaggagactcccctcggtttcttcatgtatttgacagggataataatgtattttccaagattgttgtggacattgaaaacagtgtttataaagaacttagccttgttcttggcacattgtaagtcagcagtaaattaagggtatggcttttactgttataactaatatcactatatttgatgaaatgggaccttcagacagtgaatttatgggggatcagatctaaagcccatctcccttacttccagggaccctccagtgagacattttctattcatgccctgggaggcccgtgccgcagcagcatcctctatccactgcatatacagctgacttagtgttacctcgaagaaccatccagcttgactgtgtgctatgtgggactgtgctctgcagtccctctgacctctttctttccttcccagaagggagagcctgtgcagtggtgtttgactgcaagttcatcgagacctctgcagctgtccagcacaacgtgaaggagctgtttgagggcattgtgcgacaggtgcgccttcggcgggacagcaaggagaagaatgaacggcggctggcctaccagaaaaggaaggagagcatgcccaggaaagccaggcgcttctggggcaagatcgtggccaaaaacaacaagaatatggccttcaagctcaagtccaaatcctgccatgacctctctgtactctaggaacccagggtcacccagatgtccctttgatggccgttgttgaaggccattgggaccaataatctatattagattgaatacttaagttagatgtggtttcccccattgtagcagggagctagcgtattagccttgtgggcaacatgatgcatgggaaatgaaagatttttgtaaaaagtcagtatttatttccaggaaaagcctgaccttgctatttgaacacccaagactctttagaggatgtgtttggtgttcacatgtgtttcttctattttggatagtagggaagtaaagcttacaaagaatgcctagaacaagaacttttcatcattaaaaatttttcccagtgttctgatatgtgactttgaggccaatgagtcataaacaaatataagaaagctgtcaatgagtttcttcaaaggagggaaaactttctacgaatctaagatccatggagctagaattgtagaactaggctcatcagaatcgtgactattattgctccatcaaactgtgaaaagaaatgatgtggaccttgctggaaacaaaggcttagcaaacaatttttgttcaatgcccaccgagacatatagaattgggaactgatacatgtgtcccttataggctcaaaaattatatcttacaatttcttatttagggggaaattatttgaatcagattctatttagtcaaaccaccttttatgttttattatttttgaattcatggagccatcataaaaatatttttaaaatcagaattattgataccctgtagtgcaaaatgtcaatttttaatgtataatcagaagtctgaattttcataaaacatatagcataaaaacctccagtactttggttgacccttgtatgtcacagctctgctctatttattattattttgcaaaataaccattttaacatttgataaagcatatttatgaacatatttcttaataagaaaaatatccattttattaccattttctatctttttcaaaatatgcaagtttttacctatatgtcttataataaaagaaataaaatatttgaaaaaaggcattcttgattgattttcctccccaaacaagatgattaggattatttttatacagcctttagagcaagcacattccaaagagacatatgcctattgttttctttctttttctcactagcaatagcccagtcattatccgttttaaaggatatccctgacatctctgctttgaaatcacgattcacggtaatgcaaagttgtttttggctgataccgttgggaagtatttggggtcatctcaatgctgttataggaaaagccagattgaccttttactttggtctggcaaatgcctgactgaacagatgggcttcactttgctccctggaggctgatggtcttaagcttgactaaggcattagaggaagttataaaggattagggggaaataaaataaaggaagctagtgatttccagcctgagatctagccaggcaaagctttcaccaaattctcctctctgacattaatatggcttgacattaatcacttggcatctatccagcggccgtatgcagcccttttgctggaatggaacttctggtgttctcccttcacatcttctctggccctatatgcaccctatttcactctcttctccctagctttttgagtttgtagtgagacacacactgatggtgacaatcatgggacttcagacattccctaaagctacacagttgttgttttcttgagacggagtcactgtgtcacccaggctggagtgcagtggcgtgatctcggctcactgcaacctccgccttctgggttcaagcgattctcctgccacagcctcccaagtagctgggactacagcgtgcaccaccacgtcaggctaatttttgtatttttagtagagacagggttttaccatattggccagactggtcttaaactcttgacctcaggtgatccgcctgcctcggcctcccaaagtgctgggattacagccacaagctatcacgcctggccttaaagccacgcagttttaaagggtgtctgctctgttttcattgccctttctcccctttttccaagttgagcacaaaggttcccatctctctgcactttgcatcttagaattgctcaaggcaatagcatggggagatgatacaagtaaagattcaggttacatagatctggggtgaattttggctgtggaatttagcaacatggctttggagtaaaggttaaaggtttctagctatcagttttctcatctaccaaatgggattgctaataatacccacttggtaaggttaacatctttgtgagattaccatcttttaacctgccatacagtaaagagctcaagagatcttccttttcatggttgcacattttctattctgtatcatttagagttagttttacatgtctgtttcccctaatttgaatggaaactcctttgaatcagggaccaccactctgttcctccttacccttctactcatcagtgcagcgcactgcatatactgggattttacgaactttcttcttgagcttcatagatcctcccaacacctatgtgaggtcaataggccatctcacagcaaaccagttcaggtggataaatgacttgtccaagtttgttcagatgctaagtgtctgagctaggactgaggtccacctgtgactcctggtcatttgtatattcttatctccaaaactttcctataaacacagcctgtttcatccccaggtatcatcctatacacagaatacacagacacacacacacacacacacacaaaatgcatatatattctttacactatttttctcacaatctcaagcttcctcatcacttcttttagaccttcccaaccaaatggccaacagatgccaaggctccaggtttaagggtatgttcaaggttgtcatgatcacattcccttggcttgaagcagggcaggataatgccagctgcaatccaatccaagaggatttttggttaagagctttagctccagggttagacaaacctgggtttc

SEQ ID NO: 12477 - DNA, 7328 bp, Human
caaggtgacattctgccttcccctttcagctctaatgctataaacatgttctattggaggtctacttggtgccatgtttttctcatttcttgctttttgctggggatttgctgtttgaaatggccccgagtacagtgctgaagtgccatctagtgtttctaagcacacgaaggctacgatgagccttatggaaaaaatatgtgtgttagacaagcttcattcagtcatgagttatagtggtgttggctatgagtccaatattaatgagtcaacaatatatattaaacaaggtgtcttcagaaacacacataaaacagacttctgtattgatcagttgataaccacattgtaaacagaagcttgcaggaacctaacctcatatgtcctctaggaagaatgcttcaatattcactaacttggtgctcatggtgactcatagactataactaccttgaataatgagaatcaaatgtaccaatctgaccatgtctcttcctttttcctgcctcagcacaatacaaaatgtaaaaatagaaaaaagaaaagaattccctcatgcctccctctgcacccaagataaattcaaactccttagcatgacattccaggtccttcatggtctggaaggtctttgctgaccttccaggctccttgccatgtggtgtccccaccactacccagcccactctccaatgctcttccattatttttcacaaaggtcctctgcacgctatgtgcccactgcctcaaaggcccctcctcagcatctcttcttggtaaactcctatacatccttcaagacccagcttaaatgttaccttctccggctctccctctggcagaacttaaaactcccttctctctctgtgtcttttctaggacttctcacaatgttgtaactgatctctttatatgcctcctctctcctgtacttggcaacagctttttggaaagagcatggagtatagaaatgtgtgactctctgcagggtgtgtgcatttcacacatcattcattcaataaatataaattgaagcctaactggacaagacaccaggcaccatactaggcacaagggatagagcagtgaataaaataaagccactgctgcatgtgtgtgcaacactgtgcccataattgtggcctgtgtgtaagagtatgctcatgtgaagctacattgtgtttgcttgtggacatgaggtgtttgtggctcctggatgctttgtctgttgaatcctgaccccaagtgacctgctgatacagggcaccttggaagtcaattaggccaaaagaccgtgtctgtgcactaatgagaagctttccccaggtgcccctgcccaccttctccacctctcctgtggttcctgcctggcttgggtttggcctttttaacccaaagacaacatgcatccaaatgagattttctctagtgcatacgtctctctctccctcccttctcctctgccttccctgtatctcagaaagaaaaggcctaggaataaggaaaaggaggaggaagaaacatttttttgaggacataccatgcggcaggcctgtgctgggcagtatacacgcattataggcaattgtagacagggcttcccttgtgtcaggcactgttctaagcacttcacccctaaggctgggttaatccacgtatccaccctatgaggtaggtgttgttcttttcccactttcacagagaaggcaagaaatcacacagtgagaaagtggcagagctgggattcaggcctcagcttctcccacacaagcccacagatgggaggatgaacaaggagtcagagtggacctgtggctctcccctgagaggataccaggattcgaggctcagcgccctgggaggagtgaacccctcagtttcctgagcctcatcagaagcagtctggggaggctggggcccagccaatggcagtgcaggtcccagctcctcctcctcccaggctgggccagcacacccggcaggctctgtcctggaaacaggcttcaacgggcttccccgaaaaccttccccgcttctggatatgaaattcaagctgcttgctgagtcctattgccggctgctgggagccaggagagccctgaggagtagtcactcaggtaagggcatctgtgtccgcatgtgccctgccccttggcatacgtggcaggaggacacttctctgctggggagtggtgggatgtggcctggacacatctgccaccctgggtcctgatggtggaggaataaggggctctgggttctttcaggtctccccagccgggcaaaggtaggagcaggggccaggccggaagctcagcaggcagggtagctctgcctgggcctgcaaagccctgccccactcctccccaagtagggatgggctgggtgagagcccctggggctaagggcggggccttcctgggtgttccctgagaagctgcaggagtcctaccttagacaggactgagcatgcaagatggtgattcaaaacagagctccccccaaccccggcccccacctccacccatcccccgtccaagtggcgcaggtggtgtggagacagggtggtgggcaaaggttcccccagccaccctcatccaggatccacacacaaggggaaggacagaatccgtctgcacacaaacaggcaggcagctcattgaaacttgaggaaagggtctgaggcctaaggctgggcagttcccggagggtgggctctagagccagcctgcctgggttcaaatcctagctctgccacttattagctgtgtgacgttgagcaagttaattaatccctctgtgttcctctttcctcatctgtaaattgggaataaaaaatatgccctttcctaaggttgctgtgaaggaataatgtactgattcatacaaagaacttagagcggtgcctggcacggcatgaatgcttcatggatattggctgttatcactactctgctttgcagttgatcatgcagaggctccagagagcctggtgagcttcagcctggaccagcatgggaaggccatcatgagccctttagtggctaggcagacaggttccttggggtcccagggtgcacagttggttgaaaccacagtgcatgggtcttaatggacacacccccatctccaggaatcaggcagaggactcgcgggtgaggaagtggggaccccttactctgcctagcagtcacagtccttacgcggaggtgaatctgattctgtgagttcatcaggccaaattcaccagcagaactgacaggagcagcatttcccacttgatgtcttgacaaggctgttccacaagatgataaatgttatgtcaggaggaaaagggcttctgtgggcaaatgagtttgggcaatgccacatatttcatacctcttttggtgaatttattagtgagtttattagcacggttgagcaaaagaaccctatttaactttactaaacccaatgtttgccaacttttcttgacacagaatcctcttctctcacttctcctattgccaacctatgggacagggttccagggaacactgtttgggaaacactggaataccaggttactctaggaaacctactgtatgaagagaatttattgctgcctgctttagctttcagctggattgcattgagtggcacttgagcaggactctgcctggctaattacagagtgttagaccagatgggggcttggggacaaggttccagcctcctttccagtcccatccctgagccaagaaaaggacaaagagcaggttcccctggggaaggggctgtctgagaagaggcagcagtgctcagaaaggagagaaccatctcaaggctcagcccccctgaggaggagggccagggttgaaacagagggagcaggcagaatgtcccagctccaccagtcttcactctgcagaacctcaagaccagagcctcaggcccggggaggaatgagtggctccctggacctgcccttatccactggtattggtaagagctgggttctggacttaattacctatgctcaaatcccagccctgcacctaatagttgtgtaaccttgtatataatgccactaaacctcagctccctccctctacaaaatggggacagtagtagaacccagctcctctagtgatggtaaggatgaaatgtgatgacatatttctacaaagtgctcagagcaagtctgtgataaatgtaggaaatgattgttcttgtttccctgcagtagcagctgacgcgtgggtccaccatgaactggagtatctttgagggactcctgagtggggtcaacaagtactccacagcctttgggcgcatctggctgtctctggtcttcatcttccgcgtgctggtgtacctggtgacggccgagcgtgtgtggagtgatgaccacaaggacttcgactgcaatactcgccagcccggctgctccaacgtctgctttgatgagttcttccctgtgtcccatgtgcgcctctgggccctgcagcttatcctggtgacatgcccctcactgctcgtggtcatgcacgtggcctaccgggaggttcaggagaagaggcaccgagaagcccatggggagaacagtgggcgcctctacctgaaccccggcaagaagcggggtgggctctggtggacatatgtctgcagcctagtgttcaaggcgagcgtggacatcgcctttctctatgtgttccactcattctaccccaaatatatcctccctcctgtggtcaagtgccacgcagatccatgtcccaatatagtggactgcttcatctccaagccctcagagaagaacattttcaccctcttcatggtggccacagctgccatctgcatcctgctcaacctcgtggagctcatctacctggtgagcaagagatgccacgagtgcctggcagcaaggaaagctcaagccatgtgcacaggtcatcacccccacggtaccacctcttcctgcaaacaagacgacctcctttcgggtgacctcatctttctgggctcagacagtcatcctcctctcttaccagaccgcccccgagaccatgtgaagaaaaccatcttgtgaggggctgcctggactggtctggcaggttgggcctggatggggaggctctagcatctctcataggtgcaacctgagagtgggggagctaagccatgaggtaggggcaggcaagagagaggattcagacgctctgggagccagttcctagtcctcaactccagccacctgccccagctcgacggcactgggccagttccccctctgctctgcagctcggtttccttttctagaatggaaatagtgagggccaatgcccagggttggagggaggagggcgttcatagaagaacacacatgcgggcaccttcatcgtgtgtggcccactgtcagaacttaataaaagtcaactcatttgctggttccaggtgccctctggttgtgcggccttcgtgaccctcacacgttcatggtgtcaatctctctgcccccgtgaagagctgcacttgatccagcctgtgaggggcatcctctcttccagaaagggggcccccagtactccaggggacgtgctacttgctcatgctcccatctagcctttatcccccatggcaagtttagtcctgtgggttgtctgcagagagaatggagcttagtccatgttgcagtgggaagttcatgaacttagaatgcctgtgtcgaatccaagttccaccgggactctgggaaagtaacttaagcttctctccaaaatgggttaataatacctagcctgtggggttgtgctgaggactgatgagctcatggctgtggacagggctagccagctgtaaaaggacacataaatgttaatcattggtattaggaagtgcttgataatgcctgtgagaaacgaggcagaaggcccctccctagctgcacattaaccttcatcatcccagccagaacacaggtcccaggccccccaccagcatatgtgaggtcacactccagcctccctggaggccttccccaggacccacagaggatggacagcgatgctgtgcctggccctgtgctaactggggcatttcatgctgctgacctgcattccttgcctccaccaaggctatgggtgccctggtctagaaaagtcatagttgacccctcccatttcctacacaatccaagagcttccagactccagtcccagaaatatcccaccaccagaatgggatgcgttcctgcactaaattaaggttgcccctttccgtagatgtcagctgctgagacctcagtatcaggcttcccaggaaaagggcaggagagagggcaaggaggcagggtaaggaggcaatgggaaggggacagggtcaatcccactggtgctgtcctaggcctaggcataatgatatcaggctcctgaaccccacacagcagtctcacccacatacctgcctgcctgggagccaggctcagccatacccagccaggctagagaggaggcgtgggccaggagagaagagccgcaggtgtttgctctgagtatgtgcccggggaagtccgccctcctgcctgcccacccaatcactctcgcttggctcattggcccagaaagccccacccagcaagggagagaggaacaaaagctgcctccgggaggtcctgaggcaaacagacaagcccaaggacaaggaagcagctactggacccaagaagggtgaggaccgaatagggcaggaggctggccaggaagcaagcaaccagctgagctgaggatatccaagggacctcaggctgtgggctgggcttcagggagggagccagagggtcagtgtccctagaggatccccagggaagtgccaaggaggagaaggaatgtcctggctgacctaagggacgacagaagattggggaagagggggtatcaggaagaaatgggtttcagttcagtttaacaaacatctattgtgtgttcactgggccaggccagtgctaggtgctagggagacagaggtgaagagcctgccctctagcagctgacagcctggcaaaaaaataagacaggtaaatagaccatttgggtacaggcgatgcctcttgctctgaaagtgtcccaggcacacgatgtctgaagaggctgagagcagagtcagggattggggatggggaaggaggagggtaggaggaggggagggttggacatggggcctgatggggactccagacaagggggtgtggaggtcagagtccacaggagaggggcctgagaggaaataatggaaatgcggctagcaaacagccactaaatggacagaggagggggtgcccccagaga

SEQ ID NO: 12478 - DNA, 13361 bp, Human
  misc_feature (1)...(13361): n = A,T,C or G
cttctacttaagtctaaatacaacttgcagggtctggtctttgaccgctactcctgcccatctggacaaacaggatggatggctctcaaacctggtttgcagaacagccacctgagggcttgtcaataccacaccttcctgggtcttagccccagagactgagattcagttgctggagaggagcccaagaatctattttccacacaaggttagggaggtctagaggccacatttgcagaagcacagcttcctctctccacaccttccacacctgtccaggttcacccacgtggcctctgcttcctcccttctcctccaaccccactctctgtctccgcatgctgcatctcctcctgcccagagctctggcattgatttcctcactggggaaagtggcctccttccccaattcccatccaccgattccaacccccttcccatgtcagccagcttctcctctgctcagctgtcacctccactgagaagtctttcctgactccctatgtgagtcattttcccagcatagttgtctcctgtcatttcttatttgtgtgattctttggttaacatcaatcttcctgattggctgtgtgaggatgggcggggtctgtttttgttgtttacgcctgtatccccagcacaaaacatggggctggcatatggtaggtactaaacagatagttgaataaatgaatgagtgaattgtctactctgcctttgcacaagctgctccatcaccaaagagaccttgcctcctcccccacttctttgctgggcccactcataccggttttcctaggaaaactctggagaaaattgaggcaggagccactcattcgtgccccttccagggtggacctcttatcaccctaaggattgtttgttttcctgtcacccacatcaagctgggtggtggccgcagcctttgatctccacctcctaacccctctcccaagtaccctgtgtttgcccagcactgaatgagacagctaaagtgatccctgagagaactaaagtgttccctcaggccgggcgtggtggcttatgcctgtaatcctaacactttgggaggccgaggtgggcagatcacctgaggtcaggagttcaagaccaacttggttaacatggagaaaccccatctttactaaaaatacaaaaattagctgggtgtggtggcaggcgcctgtaatcccagctactccggaggctgaggtaggagaattgcttgaacctgggaggcagagtttgcagtgcgccaagatggcatcactacactccagcctgggtgacagagcgggactctggctcaaaaaaaaataaaataaagtgatccctctaagaggaatccccaggggcccaggccagagctttctccaggtcaccatggctcctcccactgtgccaccctgcctaaccccctcgattttaaaggagaagccaagactctggactttgctcagaaggtggggggcgggggagggagggcttaccctgggtacctctgaggggccagggcgcagccaccacggtaagggtgactgcagatcgaggggcaggccatgttgctggacaccaccctggctggcgtccctctcggcagggtgctctttgccccatggggtgggatccagagctgcagacaggcccccaggcttggccaatgaacagaccaggttcggggagggtgttggaaaagagtggatggggtggttccccttaccttgcagcccccaggccctcccccctccctcccaggtggtcgggactcttgatcttcgctcgtggtactgtctgttcggctgtcttccccgcctctccccaggcacctgcatcctcccttggcacctgctgccaggctaggaagggcaaaaacaatcccagttggcgtagtcagggagtctccgccctcctcccaggtttcctcctcccaggcgcctcccctggacccgcccccatctgcccaagataattttagtttccttgggcctggaatctggacacacagggctcccccccgcctctgacttctctgtccgaagtcgggacaccctcctaccacctgtagagaagcgggagtggatctgaaataaaatccaggaatctgggggttcctagacggagccagacttcggaacgggtgtcctgctactcctgctggggctcctccaggtaaggggaccgagatcggtctcagacgacagcctgccaggcaacccccagccgcaccagggccccaggctgtgccagtctccggctgaactggccggcggcccaggtgggaggattggagccacctggctctccccctcccccgctcggtgatgtcaggccaggggcgggggctggagggggacaggtagttaagggcctggcgtctccctccctgaagacgtggtcccagccgggtgtcctgacgctcggggttcaggtaagaacccaagcgggcatttatcctttgggggcaggcacggccggtctggaggccggtagggaaaggctgggtctcctgatgggttgcttggcctcccacttttctcttttctgtccatttcccaccctgccccctcctccccacccgccctcttttcgtccccatcctggtttccagcgctccttgttccctccctgtacacctccctgcaggcagcagctgagaatgggaaggaagacctgattctctcctccgacttggctttcccgctgaaactagcccctccccgcacacccggggagagccgccctcactctctggctcgcccagtttaccccagtttgggtttccccaagtctctaagacagacgtctctgcgggctgcggggagatgtggggagggccccctccactttggagggcagtgaaggagagggatcctctaaattgtcgaggcttcatctctccagattgtatgcccttctcagcaacaccgcctccggccctccgatgggaaagtggaggccgggtgagacggggtccctcctggcttcagcatgaaatgggcaggaaggctggaggggtgtatgaggggctctgcagtgcggtggggcctggggagagtggggtgggggatagcagatggtttcttctgcttgatgaggctagggagagacccaggttcccggtctgggtctccctggcagattgaggacagagaatgaatgcatctgccggcaaggtggaacgccccccaccccgccccccaactagccgcaccgccccccaggaatgccctcttttggtccgccggtcttggactctgctctcccctctcctgatatcctactgtatgcttggtggggggacctcatggaggcgggcagcctgtaatgattaactgcagagacactccagcattcttcccgaattaaactttaaaagagctgccccgccttctcccattgggtatttttcctgagtgagagtgggcggggcctcagagtcctgggtcctcccttatactaggagtcatccaggggtttctcaccttctcacctgggccctgcaccctaaaaaattataagcctctcccgtgggggcggggcgtggagtactgggcggacgggggctctcccgccacatccaggcccctggcccaggcctcagtcccgcaagcccttccccctgctctgggaagcagagttgttttctgttggccctgaacaccgggccccgccacctgcccttagggccagccaggtggggcgtgattcaggaagtaaacaaggaggttgggaggacgggaacgcgggtggggctggaaccactgggggaggaggcagctgggaagccacggacggagttacctcgttgaggggacaaactgattttgggggtcggtgtttccaaccgaagctttaccggggcctcagtttgaaaactccagatctctaagctgccaggcccacagccaggaccccttcctcctccctgctcaccccattggtcttgacgattccacccgcctccagccttagaagcttaagggcacggctggggggctctgaaggcaaaccccagccttggactggccctctctgatctctgaggccaggctctaatgtgatttgaatctacttctaaccccttccaagcactgccctcccgaattctctgctcctctccccaccccactgttggtctgtgatttcgaggcaggcgtggccccctgcagcctggaatgaagtcactggggctgtttggagaccggggctgtttggaggttagactggggtgggagtgggggattgtgttctggtattgaggtgctggtgtctcttgctagcgggtgatgggtgtgtcgtgcccctcctggcaggaccctgagccccctccctggcctttcatcctgtctgtcttcttgagtgttttccctttccactcctgctcctgtggtacccctctggccgggacacccaggagaatgtgtcaggaggaacttcatccacacagggcaggggctctgagcgatgctttgggtggggaggggcaccgccgggatgctggcttctctccaaatgggcctctgaatccaggccgggcattgcctctctccttcccaggcgagggactccctggcgaggaggtggtttgggactgggggtgagagcagatcgtaggtcccacctggcctggagctaggccgagggtgggggannnnnnnnnnnnnnnnnnnnnnnnnnnnnnnnnnnnnnnnnnnnnnnnnnnnnnnnnnnnnnnnnnnnnnnnnnnnnnnncccccatcctgttcccagccccgtgcctcccccattccgctctggctagcagtgggttggggagttgggggaagggtggaggcagggctgtttttgtttctcctaagccaggaagttgtgtggatgagtcaaggttgaatggagagccctaggcagtgttgtcccgcccgccctgactcacctgtcccccaaatcccctgatgccctcactgaagggtcaggtgcctgctccctcctgaggggtcaatcccaggtgccccaggtggcctcatagtactggcccagtgtttggagaacaggctgggggctgggattgcaggttctcccaggtctcagcccggccaaaggggtctgctgggttcctgcggagaaggtgccagccccacctccacctctagtgctcgtctttgcctgctgtcctgtctttacttgtcttgagtgtctgtgcagcccctataagtgataagacatgggtgagattggccttgcctgggggtaccaggtgccctcagacaaatgggtggataggacaggtgcacagtaatggatgatgcggcccccgcacagtgctgagagagagtcattcagtctgaatgtggaaggccaggaaggcttctcagaggaggtggctctagcactggggcttcaggaaagagttgggcaggaggatggcctggggagggtacgcaaggtttgggggctgctggggccaggacccctaccccaggccctgctctcccccttgcactgcagcggagcccgctctcctgcctttctgactcccatccttccccacctccttctcccctctgcatcactcatcacttgggcaggccaaacctcgccaagtatgaacaggctctggcaactgggtctggcaacaaagtgctggaaaaacccggggcacagcccagcgcagtgagtgccccacacgtggaggcaaaggagtgggcctttgccctgaccctgagggctgagcctgagagtctgtgggttgtgaaatctgttgtgaccaccaggcttgtggtgggtggaccctcagctcttcctgtgagcaactttgtgctaaagaaagagcactggagccgggcgtggtggcttacgcctgtaatcccagcactttgggaggccaaggcgggcggatcaggagttcaagaccagcctggccaacatggtgaaaccctgtctctactaaaaatacaaaaattagacgggcgtggtggtgggcacctgtaatcccagttactcgggaggttaaggcacgagaattacttgaacccaggaggtggaggttgcagtgagtggagatgacgccgctgcaaaaaaaaaaaaaaaaaaaggagaaaaaaaacagaaagagcactggacttggagtctaaacacaggttctactcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttccgttaagcccctctctcgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggtacgatggggcgtggggcttgggggaggtcagtgctggataatacacagaggcttgcaggccactgctcccttccccacacctctctccctttttcttcttgccacaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgggtaagtcaggtgcatggaactatccgggctgggagatgatgccttgcatcttgggctaggcatgtggctcatccaggagatctggttgatctccaataacccctgctttttgcccttgtccccagagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctccaaaaaaaaaaaaaaaaaaaaaaaaaggccaggaatggtggcatgagcctgtagtcccaggtgcttgggaggctgaggtgggaggatcacttgagctcgggaggtcgaggttgcagtgagctgtgatcgtgccaccgcactagcatgagaccctgtctcaaaaagaaaaagaaaaagagaaacatcctggtggtagaggggaagggaggaggtcagacctgtcactctcctctgctctcctctggctcagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttgctgtgtgaccctgggtattcccctgcccctctctggtcctgaaatctccccacctggcttgtggggggaggtaatagtgggcgggatctacctgtaccaagtcctgctcactcatgctgcttaggatccgaggcacctgcagtacgtggcagatgtgaacgagtccaacgtgtacgtggtgacgcagggccgcaagctctacgggatgcccactgacttcggtttctgtgtcaaggtgaagacctggccaggcctggcccctggcctggggaagcaggaactgctcaggcccctggatcctgcccggggcttctgagccccaattcagacacctagactcctctccctgcaccctggcctgctggaaactcctggattcagctctgctatgtggagcaggggcagacatgtggtcctaaaggcagatatgggaccagtcaatttcctctctctgcagcccaacaagcttcgaaatggccacaaggggcttcggatcttctgcagtgaagatgagcagagccgcacctgctggctggctgccttccgcctcttcaaggtgagaccctgggagtggcatggggggctggcctggccagagggatccccagctctgccctcaggaagtctcaggaatgaggagggcatcacagccttgctctctgataacccccagtccaagcctgaagttataggaagtgcccatcgaaggcagaaacacagccctggtctgggcaagtcctggtctgaggggggcgtcacagccacgcccccaggacctctcgacctcaagctctctttctctccccacccccagtacggggtgcagctgtacaagaattaccagcaggcacagtctcgccatctgcatccatcttgtttgggctccccacccttggtgagtgtgcccaaggggatgggagggtgggtatgcaggccctgtcttacgggtacctgggccctgttctgacctctctcctctccttccatctccagagaagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgggatccctgaaataggagggaggaagagagggcggggggaggcccctggctgggaagaagtgctctaccttcctgaggtgctgggtaatgcccccaagcacgccccgactctcccgtatctcccactgctccacagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacagacccagggataagagagactggggtccaggtggcagccatggtccttgggtagtaatgctgccccatctcctgtcttctggcagcctgttcctggtccgggagagtcagcggaacccccagggctttgtcctctctttgtgccacctgcagaaagtgaagcattatctcatcctgccggtgagcttccctgcgtccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatgagttctgtctggcaaggcctggctggctgaatcaagaagggaaccagagctggacgtggtggctcatgcctgtaatcccagcactttgggaggccaaggtaggagaattgcttgagtccaggagtttgagaccagcctgggcaacatggcaagaccctgtccctacaaaaaataaaaaaatgagccgggcatggtggtgtgcacctgtagtcccagcttctcaggaggctgaggtgggaggatcccttgttccttgagcctgggatgtcaaggttgcagtgaactgagattgtgccgctgcactcagcctgagtgacagagtgagaccctgtctggaaaaaaaaagaggggagacctggagaggtgggcacctgtggaggccttggtggaagtgtcaaatggatcgaggccatgtctcagcctgcctggatgttcctcaagggcaggagtggttatctgagagtctccagtgcccaccatgcagcttgacacatagtaggcgcccagtcattgctaattaagtaagtgaatagacaagagaccatcatcccagagagattttctgacagtctaagtctagagaggtaattaacagggcctgggagttggagatgagtccgacagcatgcttgtcctccgctagtcctggactagctgacggatagttggccccagcatgcacacagttatgcatccagccccaccaccaagacacagaatggcctcatcacccccaacaagtccctgtgccccctactatcagccatgctccctcctacccaaactgaaacctcctttctgtcctagttctgccccttccagaaagccatataaatggagcctgctagcattcagccctctgcatctggcttccatctccaacacatccttcagcacccagagtgatcttttctcaaatataaattcaccactcccggcagggcactgtggctcacacctgtaatcccagcactttgggaggccgaggcgggcggatcacgaggtcaggagtttgagaccagcctggccaacatggcaaaaccccatctctactaaaaatacaaaaattagctgggcatggtggcgggcacctgtaatcccagctactagggaggctgaggcaggagaatagcttgaaccggggaggcagaggttgcagtgagccaagatcatgccattgcactccagcctgggcaacaagagcaagactcagtcttaaaaaaaaagacagatgtctggcctctgcccactgctcatgccagtctatctttttgtcttagaggttttnnnnnnnnnnnnnnnnnnnngtttttttgttttgttttttaagatggagtctcactctgttgcgcaagctggaatgcagtggcacgatctcagctcactacaacctccttctcctgggttcaagggagtgtcttgcctcatcctcccaagtaactgggattacaggcgcttgccaccacgcctggctaattttttgtatttgtggtagagacggggtttcaccatgttggccagcctggccttgaactcctgacctcaagtgatccactcaccttggcctcccaaagtgctgggattacacacccaagccactgcgcctggccttgtctaagagttttttagtttgagctcttacctgatgggagctctttaataaatatgtcagatcgactgcatctgaacttgctgcttaactcaggagacagaccctcctgcagacctgtgaaccccaactagtcattgtttttgtcaaaacaccaaacctgaatctgattccttggattcaacaactagtttacgggaaatacaagggaaacaatgacaaaaatccagattgggaaattctacagaacagataacccagtttcttcttcaacagcaacaaaattaccagaaaagatgggcaatctctagatttcaagaaatttagacatatatcaaccaaatgatgtgttgacctttgattcaaatgcaaactaactgtaaa

SEQ ID NO: 12479 - DNA, 32176 bp, Human
  misc_feature (1)...(32176): n = A,T,C or G
aaacaacaaatgtgtttttctataataaagaaaaccagttttagtaaatgtgcttcttgcttgaactattagcacagcacagttaaatgctagtaggcaataataggtattcccgcattacgtgtcatattcatgaaagtttagagctggaaggttaagtgtccccctggggcctcacagctagacacttggcaccccacaatttccactctacctctaaatcagtttaatccacgttatatgtcagagtacagaagttaggtgatatatttaaaattatagtttagcatttgaaaactaccaaaaaactgaatcaggaagctcgagtctgattaagtgggatgaaattgtgatctgaaatttaagccagtctctccaagagttgaaccacctaaggcggagttcaaacaaaggctgaagcaggaaggtttgctgggggaaatcagtggggtcccctgagcagcgtgaagtcatcaggccaaggtaatgcttcccagaggtgtaaccgctgtgtgtgtgtgtggcgtggcgggggggggcggggggaagggggcggaaacgcgcagtactttgcaggtcagcccctggggactgggatggctgactacctggtattgcactaaaatgcttgacccctaatcacatcccccaacactacaccttgtgcgacgtgatgaaagcatcatttccagtttattcgacttttctgtttagacttattcattatagcccatatatgtgataaggactaagaacccagtcttcaaggtcctgtcgagttccaaagaagtccacccctcagaagatccttggaaggggaagaaggaaaaaagaaagaaagaaaaatctgttttaccctataacaatttcagcgcaatctcccaagaccaagttggttaatttgtaaagtcactctcattttttcctcaacagtgccacctactgtccattttcagtcatcagcaggcttgttggcaaggtccaagagaaagaaaggaggcggagtggtggggggaggagtaaccaaaaaacgaactctacccagccttggggcattgtgaaaacgacgaggaaaggccatctccaagcaagacatatttgtcctcgtcaactttgcagaaggcttgcaaaaagcaaaagccagttaagccatttccttcaagatggctaaatataagtcctccagaaaacaatttttattattttatttttaatgcgcgctgtttgagtatgtttacgttaggggaccagattgagcaaaaatatacatataattacttttctatgttttccgcccacccacggcagaaacctctttatgagaaaggctttgacacttgacgtcagctcagaaacttttgagttggcgggaagaaagggttaacaagtggtggaccagcgcgatctttttagagtcccagccggctgtcgaaggctccaggtacacacacacacgcacacacttacacacacacacacacacgtgcacacacccctcccaactgttcctccttgggtcggttacttagctgaagggcaccatttggctttaaaacaaattacttcagcgccacagggagtttatcgcttggagggaacttgtaacgcgggagttcagggaaatccaagaggcgagggctcccacctccgccgccagaggaaagtaaggaatcaggtggtggccccctatgtgtcttgcatttctctgcacacgttagcaatcaagttaattgaattcattggagtttagaaccggcctgtagctcagagaaggctttgaatggccaatttctctctctccctctccccctccccgcctcccgctcgcccgcccgcccgcgctcccagttccctcccctcagggttccccagtccacacctccctctccacttccctcacccccccactccctccgccgccctattaaaacacccaccagctcacttgttaagacccccttaagttggaggaggcagaagggcaacaacggcggggaaggagaagtcaagacgtctggaaagaattacccagtcctggcttcgagcagcccattgaaccagagacttgaaacagccccagccaaagacttttctcccaattctgcgcttcctgggttctgctgagtcttccacaggcttttttttttttttttttttttttaagacgaaaaagagattttctgttatcgggggcagaaagactgaagcccaaaaaaaaaaaaaaaaaaaaagaaaagaaaagaaaaaagaaaagttaatttatttttaaagcataatttttttaagaattagactgaagtgcaacggaaacataaagagaatattagtgaaattattttttaaagtggggaagaatcaaacatttaagactcccctatcctttttaaatgttgtttttaaatttcttattttttttggccggtcgtctcaaattcatctgatctcttattacctcaattttggaaactgcccgccaccgaccctccgggaccacacagacaggctgaggacgactttatgaccaagagctgaacaaggtacgttacactggcgcgttttggtgaaggatgaaggtcctccaacaggccagggagaaggaagacatccttataattgttttaaaatttttaagccagtttcgatagaaaagttggaagtttaaaaatttccaacagactgaagatcagggaatatttcaggtcactgtcaggcttagcaacatagccctcttttcccatttctgcggctctcgccagaaatccgctgcctttctggggacacaggtagcctctctgcctgggaaaggctgcacgtcctcagatgtacttttccattttgcatcttccggagcagcagaggggctccagagttaggaaacaagaattcccaatgtaaggaaaatgcattctgcacagccgccccaccccttcccttctttttttcccacacacacacacacacacacacactgtggggagaaaaactggaatagcccagcgcgttttacttctaagtgaaaaagtcgcttcttgctgggaatgcaaagggttaagcaatctgggcttccagctccgacaagctgggaccctggagaaggagggtccttctctacctcctcgcagctaccatcccctctcggccactcccccctttcccgggcctcccctcctttgcacttcccgcaccccattaaagtgtcaggctcgtcagtctgggcttactcgggccaggggtccctgacgcaggcggtggcacccgcagataggagcgggaggagggcgcgcatccctcctctcctcgccgggccagcccgccggccgcccggaggcagggcgtgcgtggggaccgcgcgctgcgcttcggcagctgcggcgtccccagagccaattccgacgtggcaccgcgcacgccggcgcttctctcctcagctgcagctggggacactgcccggtgggagatctgggggcgccgtctcgagcgcccagccgatgaacggggcgaggggcctgtgggagctggggtggaggtgggagggaagccagaggctgggttgggatggataatcaacaccttggggggaattcgtcacggcagttcccgcccagcgtgagccagggctccgaaatgggtccctgtgaacaggagggcgggtctgaaaggagggtctgtatgagggtgagaaccgggaggcgaaagagcctttttcctctgaccacggaaacgcagccgcgggggaacggcgctgaaaggataattaaagctgcaaagaggcgctgggagcacaggggcggtgcctggggaggaggacttgcaagacctgtgtcctattacacagtcttaggtgccagttcccctagcgcctctccctccgtcccccaaacgtccgcgctgaatacttggactcaaggacaccgcgcgcctctggggcgaacgagctgcagcagcccagctacgggagggaacgtgtagaagccccatcagcctctccctgcccactccctcacccttgggaccgttgctgcctgttgggtctcaggagcaattgcccagaaacgcgacgctgctccaacccacgtgtctgggctgggattgcctttgacgtcacacacgggggaggtgtgacgcaatagatagggaagccccgattggccaccaagggcttcccccaactggaggcctgagtatatatagaccatcagctcagtgttagaataaagagaaggaagttggtagatgggctttgctgaaggagtgaggccgcttgttaagagggagacaacttcactgctcattgtacattccaaggctttggctcagatttctcactgcggttaaggcatatgataagtacttctggcggtattaaaccaggttattatttttaaaaaaggttattttaaaaaggtcaacacatatttacatacacgatgccaggtttaaaattaaaatatgtatttccatagatccaagtccatcaacctctttgtagatacaatttttttatagttctatgacttgaattgaaaagaacttttaaattccaaatttttatttccttccaatgtgtgcaagttgactcattcattaaattagttttcaccacatttttctagagcttaataaggttacagtacagctgaggtactgtattttgagtacccatcatactccaccaaaagttttcccaatagtttggcgattcttttacattttcaatgacaatttaacactttaagttacctgttgcgtttatatattatgttttgtatgtgtttccaattctgggacagataattctgatttttaagtggacatttctagaacaaaatattgtaactaaagtatcatcccccctatttgttttttcttagatatcacctgagtcgggtaaatagaaaaatatattgtggacgtgctgacaaatgcatattacctgagttgcttgtactgtacccggagtcgaatccctttatcaaagaaagttatgcagtttataaaaattcaaggacttaacaaatcagtgactagcattaaactctaaggtcactttccataaagcaaagatatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccgcctcccgggttcatgccattctcctgcctcaacctcccaagtacccgggactacaggcgcccgctaccacgcctggctaatttttttttgtatttttagtagagatggggtttcaccgtattagccaggatggtcttgacctcctgacctcgtgatccacccgcctcggcctcccaaagtgctgggattacaggcgtgagccactgcgcccagccggatgtcttgattatataattgctttattcctgtctcttactgaacatgcgtattaccactcacgtggccaccagtctatgagacaaaggaaaacataaaacagtatcccctgatgtctgcattagggacttcctaggtagaaaatatataacaaatatgaacatcttctaagctggaagattatcggaggaaatgtcactattgatttaatatcacagcattctacatatccagaattctttggggaaaaatgtaaggctttattattcctaacagtagagttgactgtgattattactggattctgtatttgcaaatttgtctactcagtaaaacgtacttgtaaccctaaaatcaataattgcagtcagtaggtggtcatttgctgacaagcacacagtggcaaaaaatttgagtcatccaatgtgcatgttccagctgaggtcagacaaggtgatgctttggcttcttgtttcagcttttatactgtaaacaattatcctcttcatggtctctttagtgccacatttttcccttttttgtgcttttccttggtgatgtagctctttaacatggccttgaactgtaatgctgaaatgctatctaagcacaagaagactgtgatacacctcatggagatgaatttcctttaggcatgagatatcgtgctgttggacatgagttcaatattaatgaaccaactatatgtatattaaataaggtacatataaacagaagcacagataaaacaagattatatgttgtcaaaatgttgtggccagaggttcggaggaacccagccctgtgtttctgctagaagcacattttcagtattttccagttcagtgttcctggcaactttatgtaatacaactaccataaataatgataatcaactgtgtatgacatttgactggttcctgttttgttctgtatagaaagcctgagcaactgaaatattctgagggccagtattgagaatagtaagtttatttttatctttcattttggaggttaagactaagagctcactgaaataagaatgaggaaatctgaattctatacccaactttgttgtttacctgctatggtcctggccttaatgaatcatcaactgaggtagtagaccagatgatctctaagatgtctttcagctcaagattcttaagtcagtattggtgtaattcttctgacatcttaattatatctagcaaatactgaagctctgctagagcaagatcaaaagaaaaagggatatcagaattttcatttgttggttactatcgtgtgtctcactctcacttttaatctgccttttccccccagattgcttcttgaatataaatcttgatttaagggcaccattatgagcttccctgattcccttctttagaatgagaattccaaacatttggaataagggtccttcatggtttaagccttagaggtgacagcatttggtttctcacttttccagctggctcgtcacctttgttttgcaccttttataactttcactcattttcaactttgctaaaaaggaaaagagaataaccaaatgactcctttttttcactttaataattggaagagattggctgtctgaaggcaggaattattttataataatttggataattcattctactaaggaaggcttgtatattcctaattccttttaagaagaattacaaagaagtaccaaactgcacaggtgtctataatgtaaaggctttctgttggctagatttgagatcctgtaccataaaccaaattactacaagggaagaacctcctccccatcccccgttcctttcgcaaaagaaagatgatgttttcattgaggactattttttttttttctggaatggttttactcattaatttcaaaaagcttttgtagctctaaaatgtttagattttatgattttgtatttgttgcttaatttgaggctgcttaacttagctatatgtttatatgtaaattctattcatctagaattcacataaatagaaaatcaagattaaaaaataaagttatacaatcttgataaagtcttagaagtttgttgtaatattattaatgaacatgcactagagctttggattgatttttttttttttttggttgtatgagaaattttaaattgtatgtaatattccatctttataaagtcaacttctgtcctcactgttttgtttcccccaaatcttgcatgtattgtggcccactttttagtatatatgagttccatttattgagcatttactgtgagctagccattactaacagctttacatacattatcttattaacactagttaattacaacaaacttatgaggtagatgtgattatccatatttttcacctacagaatggaagcttaggaggtaaggagtctgtagtgaagaaacgagtccgagtttacataggtggttaatggtggattgggatccagatgaatttgattccaaggccttatatagtactttttttgtttgtttgtttcagtagtgtgtttgctctgaggttgtactggtaggagttcagggggaatggtagcatcttgtatttactaagtaagtatttgtggaattttttgttcctgccattacccctttttactagagaaattgggatgggggggtgatgcagaatttctatttacttttgggttaagttgtgggaggaagcaagaacaaatgctacacattctagagatagtctcattgggtgaaggttaagatgaagagtcaaggttaagatgaagggtgaaggttaagatgaagggttaagccttacaagcaggaaaaaggtgaagcctttttcaaaagagttttgatttattttcaacctgtttcctcattggaggcagccagagtaattaagatttctctcttgctgtgttagctgtcaatgccctttgaagtggtatgggaggaagtgaggagatccatcagtctgaaaaaaaaagacattaaaagtaaaacatggagatttggcattttagacttggatcaaggcatctggtagaatagataacagtatttctacaggagatttttatttagattgttgtgagataaattaactttaagattagtgagataaattagaacagacaggaatgctgtagatgcttccagataaatttgagtttgttcatgtggtaagagattctgtatatgtaatcaattcctatgttcctattagtgattgttgctactgagccatctatttgtgataattgacataatcctttaggtgtgggtttacttagaaagtataaaatattgaagactattaccttatactaatggaaatacttctctacagtcctttgtaattcacaaggtacttttatttgcagtgtctcacaaatgtcccatgatgatggcaaatggctcattcaaggttatagaagtagtaagttacaggacttcagactttaaggcttcttgatttcatgggtacttgctcttgtaataggcaaaatcttggctgaagaaaatctaattttttaatatcctacacttcaggctcttcctaacacagggagatggagacagcttttgcaaaatctactaaattaaaattgggcttcaaacatatttaatctcaacttcactgttatttttaagaaagcagaaccttccccgtgtaaccagttattttgaacccagggttggcaaactttgcttataaaaggctaaatagtaaatattaggctttgcaggctatatggtctctgttgtaactagtcaattttgctgttgcagggtgaaaagcagccataaatagtaagtaaatgagcaggcaagggtggatgcatgcctttctgagctttcctttctgatacagcatgcatccaataaaaccttatttatgaacactaaaattttaattttatataattcccatgtgtcacaaaatattctttttttgattttttttcaactattgaataatgtgtaaccattcttggcccatgacccatatcaagacaggtggcaggctggacttgaccagtaggccttggtttgccaatccctgttttagataggggggaaatggagggaattaactcttggctggagtagtgaggcaggaagagtgatggtcttatgcaatttagtggatgattctgtggttaagactgaggtggctggttcttctaaataatgtcttcttgacatgtttcatttactcaaaagttggtgacttgcttcatttccatatctcctggtgagaaatcttataactagtgatcatgtggtttcaacgaattacgctgatacacttagtgtggccaaaaagatgtttcagtttgttctctttcctgtgtgcaaatgctgtcctgtactttttccttatgtgaggttcagttctccttgaactggggcatgtctcccacagattgtaatccagggctaaatagttgacattcgtgaaattgcatacttgttaccgatgagtgaggagatggctagaaagcctgttcttgctgtatggattttaagaagggctaaaattatgctctttacaccctactgagtaaattcccttgtgtccatgaatacacatgctttcacaaactgtcaaagaccatggctttctagctggcattctatcaccaaacagcatccagtagttgaaaaattttaaagctgttaaatcccatggtaataaaccctttcccaggagatttctgagctttcctttctgatacagctaaattcaccatgtgaacaatctctctcagagaacttctggcactttgctattggaaattgggaggggcagggaccaattgaaatatgcagaacatcataaatttggttccagtgtagtcatttcaaagagccagttctcctggcttgcttgtgctcacaagcagacggagttatttgaacattaactctggattgccctcttcctgttgtttttagtcttattttagcctggttttaccttttccagcttgagtcaacagaggtgggtgtggtaataaactcaggatgctggaggctaaagatgagttagaatttctgccttcatgtttttctagcctcatcacagacctcctgcccacctggtagccacatacaaaccagggatagacagggcatgggagaggcaaaacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttattttttattttattttactatttttttgagatggggtcttgttgtgttgcccaggctggtctcaaactcctgggctcaaacaatccccccgccttagcttcccactgctcttcctaacacaggtgttagccactgcacccagcctagatgcttttaaaaatgttgggattccttagttactaatgtgaaggactcatgctacatgtatctaacgtctcctttaattctgagactttatgcttctactaattggttaatttcctttttttttttaaattcaaaactggtatatcaaacactattttctgtgagacagggtctcactttgttgcccaggctgaaatactatgtttatagagtggtttgcaggactgttaaataatttattttgatattaaaaaaaattggctaaatcttgattcagtccaaccagtacagtctgacttgatggcagaataatgggaatagcagataataaatactcagtctctgccaatcatgccattcattgtctgaatggggatatcaagctgattaatcacatgacaattctgatcaatttatatttgttaggactttgctgcatttagcagaaaataatatgtccaattagtaaatgttggagggatagggagatggggacttttttttcctactttttttctatttctgattttctctgatcatatggaggaagctccattggcaggtataacccatcagccttttccagctgttttcattcctttcctaagagaaaaggagtgacttaatcttattagtgagtgtggaaggaataaggggaagcccagctctttctgcccggcttttgggagtgggcacccccccaggaacaggtatcagctgtaccttttgaagggacatacactgtatctgcaggaggctagtcccactgagaccctctctgggactgagtagttctgggaattactcagaattatgaagcccacttttccacatataaagccctattctccatatcagctttgtaagcatacaggtaatagtttggttttccatttgctttattatttttctgtttaacttttcagttgatttggaaatcagtctgaaaagaaaagcacagtttatagccctgtgcccttgagactccaatagaaatatctattaggaatacacagttataaactaattccaaaaattttcttgaagttgtggttggtctagtttcggacttgctttttttttttttggctcatagaaagattgtgtttaaaaacaacaatgggcatttctagaatagcttaaagtgatttatatccacttttaaattcagagggccagatgaacacttaatactttagaataaaaaggtgttgaaggtcctgcaaatccccttcctgatacaatgtcatttgctaagcccgggtcatatggactttagaactatacaatctttagaactacactattgctttagaattatacaatcctatgtaggagaattgctctcctgtcatttatttgccatattaaaatgaaaggtaaaatcattactaaatatgtctcccttaagaaaatgtcatagaattttcttatcattcagacctgaaagacaaaaaggcctaaaagccttattgaaggtaacaagaaaacatttttttttttcttaaacagacctctagggggaccaaccattacagtttgccaggactgggggttacctgggatgtgagactttcattgacaaaattgggagcatctatggcaaactgggacaagttgatcacgctacaagtcatacttagcacatcacttcagctgttctacccagcaatgtcattaacttaaatattgagtttgctgaaaaataggctctttgtattggccatgatataacaaggcctctgttatcatcatgatacttgcttactgaggccttgtgacagtaagatgaggacacagtatgtatgtgaaattttgactacagggaatgtatttatagttcttccttttctttaactcatttttcatttgcttctttgcaggtttgtgattcagacactatgcttgacccagcctcatctgtggagatggtaaaagttttagaagaagatcccatggttggaggtgttgggggagatgtccaggtacatggcttcactttttgtttgtttgttttgcatgaaatacttttaagagcacttttactcattgactcattgaacatacatttattaaacactaactctgtgccaggtgttgttgttggtgcttgagacacattaaaatgtgccttggatctgcttcactgcctcttttcctatgtaaattgaaatataatttagaactttcttgcttagtcctggggtataacccatttctgtagtagctgataagttatatgcaacttaaaataaatgtgtaatgatttccaccatatacctttgggccataacttaatatttcatgttctgctaaaaattatttcattacaaggattaagaaatagaagtatgagccgggcgcagtggtttatgcctgtaatcccagcactttgggaggccgaggcaggtggatcacctgaggtcaggagttcgagaccagcctgatcaatatggtgaaaccccatccctactaaaaatacaaaaattagctgggcgtggtggtgtgcgactgtagtcccagctacttgggaggctgagacaagagaattcttggacctgggaggtggaggttgcaatgagccgagatcatgccactgcacttcagcctgggtgatagggtaagacccagtctcaaaaaaaaaaaagaaaaagaaaaagaaaaaagaaatagaagtatggtaagaaattggtatatatcttatacctatatacctaaaggatgatcaatatgtggttgatttaaaaaaaaatctgagtcaaaaaggaataattaaaaaaaaacagagactcaagtttatactagtgagaaaggcaaagaatggataagtggttttccaatattgtccatcatttgttattgatgaagaaacaattaatgaaacaaatatcaatggaggtaatttgacatttgtgggatggaaaaatgtatatgtgaaaatatgtgaggattaataagattcccttgcaaataaatatgaggttagattttagcaaaaggtaagaaagcacatggaaaatagactttaaaatttagatattatcatgctatataacccattttatatatgtagtttgatagcaaaagcaaagaaattacattagaagggacaaagaaatagcctggtgatttttaaaaaaaggagctggcaaaattgagacagaggagagaatgtagaaatctagccaaaaaaagctgataattttcaatagcctttatataaagcattatttcacgattcaaatttgcaggaaggccatgggaaactctcctattgctgctattgcaaaaaaagtgtggataaaggagaggaaaagtaatagccaaggataggatcagtttgaaattaaccagcacaggaggaactggaacctaaaaacattcaaatcttacgtgttatgaaagagtgcctgggaaaagagtttagggattgagatctaaagcctaaaaaaaaaaaatctcaatttggccaggcgcagtgggtcacgcctgtaatcccagcactttgggaggccgaggaagtcagatcatctgaggtcaggagcaagaccagcctggccaaaatggcgaaaccccgtctctactaaaaatacaaaaattagccaggcctggtggcgcgcacctgtagtcccaggtgaggcaggagaatcatttgaaccaggaaggcggaggttgcagtgagcccaaatcgcgccactgcactccagtctgggtgacagagcgagactccatctctaaataaataaataagtaaatatctcaatatgataacacaacaaacagaataagaatagcagaaagagggtagaggatgaaatagaaaaaaatattcaccatcaaagaatcgcaacacatgcatacagcataacaaatagtaacagaatcagagaatcagagaaaacataaaataaccacgccaaaaagaggaacgaagccaaaatgggaggataaaataacaaatattactccaggtagtaacctcaggatggaacaggttttgctggaatttttagctaaagcttacctattacttatgtttttcttcttgcagattttaaacaagtacgattcctggatctcattcctcagcagtgtaagatattggatggcttttaatatagaaagggcctgtcagtcttattttgggtgtgttcagtgcattagtggacctctgggaatgtacagaaactccttgttgcatgagtttgtggaagattggtacaatcaagaatttatgggcaaccaatgtagctttggtgatgacaggcatctcacgaaccgggtgctgagcctgggctatgcaacaaaatacacagctcgatctaagtgccttactgaaacacctatagaatatctcagatggctaaaccagcagacccgttggagcaagtcctacttccgagaatggctgtacaatgcaatgtggtttcacaaacatcacttgtggatgacctacgaagcgattatcactggattctttcctttctttctcattgccacagtaatccagctcttctaccggggtaaaatttggaacattctcctcttcttgttaactgtccagctagtaggtctcataaaatcatcttttgccagctgccttagaggaaatatcgtcatggtcttcatgtctctctactcagtgttatacatgtcgagtttacttcccgccaagatgtttgcaattgcaacaataaacaaagctgggtggggcacatcaggaaggaaaaccattgttgttaatttcataggactcattccagtatcagtttggtttacaatcctcctgggtggtgtgattttcaccatttataaggagtctaaaaggccattttcagaatccaaacagacagttctaattgttggaacgttgctctatgcatgctattgggtcatgcttttgacgctgtatgtagttctcatcaataagtgtggcaggcggaagaagggacaacaatatgacatggtgcttgatgtatgatcttccatgttttgacgtttgcagtcacacacaacaccttagttcctctaggggctgtacagtattgtggcatcagataatgccaccaaaggagacatatcactgctgctgggacttgaacaaagacatttatatgggtttattttcattctgccaaagtaaaacaatacatcaacaagaagaaactcagatttaacctgttatttctatgaaaatgggatgaattctttgtttatgcactttttccttactgtgcatccgcctgaaagtgttttgccctatatacctcactagccatgctttatgtgggttatcatggaagaaaaggattttggaaactcaaggaaaagttctttcaacctatacaacctaacttatggactgttttgatagatgataattttttttttttaggaaggattttctttttaactttaccaaatgaaatgccaaaggaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaataattttaacttttttgttttttattttcttttagaaaaaggcccaatatacctattaacaactttgggaagtaaaaaattacacaacttttcgtggtgtaccctaaaaaaaaaaaattcgttgaaaaaatcaaagggcccaagaggtagtggccaattttttttcaattaaagaatttaaaaaaaaaaggggaaatgattagtccttttggaaaaaaaaaaccagtaaggccttcccaagcacttgggaccaaaaccatggggttttcaaagaatggaaataaatcttttgggaaaaattcttgggcagttgttttttccccaagaaacaaaggtccagggggggaaaggtgggagaaaaatttatcccgggataaattttggggggacaccttccaaatgggcaggttttattcaaaaannnnnnnnnnnnnnnnnnnngaagttttaaaggccgttggctgtgctgtattttgatataattgtactgtgtttttaaattttgtatgccaatcttaaagacaaattttgcatattctctattttacttttctgccaaaataaacctgttcttccttttttaaaataaaataagttcttaaaaaatttatacttaaaaaatcctgcccaaaatgtgaagcttggttgactgatgttcatgatagaaagaataaaatgtttctctctctctaccttttaaaattgaatagtttatttctgtgaaagaagtatttaaactttcaatattttaactttttgtttttatttcttttagaaaaggccaatatacctatcacactttggaagtaaaaatacacactttcgtgtgtacctaaaaaaaaaatcgttgaaaatcaaggccaaaggtagtgcaattttttcattaagatttaaaaaaaagggaatgatagtctttgaaagaaaacagtaggcatccagcactggacaaaacatgggtatcaaagatgaataatctttggagattctggcagtgttttcccagaacaagtcaagtggaaagtggagaaattatctgtataattttggacacatacaatgcagtttatcaaaggttttgttctgtggcctgaatttactgggtcctacctacacattgaacatgttttgcctgtcttttttttttttttcaacttgccagttcactttacatgttagtataatgtttacacgggtgagttggataaattataaaacatataaattcaaaattggcagatagaatcaccaagtatctatcctcttttactttcaaatgaggaattttgtttttctgaattacacagatcatcacttcctatttcctgttctggacctgtataaaaatgtctacacagtagaagtgacatcaaggtttaataagtatatcaatgattggcacatataaaaattgttgaaccacatactctgaacttggctaatttagttactgcaaggcctccattatccagttttattttttacacgattgaccttgccttgtagctggtgctgtgtagacctgtgttgaaaacacaatcggaatatatgaataattgaataaacagcattatggtgaggcagagacacatggagaagtgttaaaaaaaaaatgggcttcctgcctttctgcctcttttttatgcagtcatctatgttacatctatcctgcctaagaaaaagctgcacatcctaccttcagagtacaaaaaggtacatctgagactcaagactctcactgattggagagcttgtggaaaacaaaacacaccatgccaataaatgagatgaaaacttgagtttgcctttttaactatttatgttctaagttaagctttgataacattcaaatgtcaaattctctcattcttataaaaagttgaattaattgcctgtatttattttagcaattattcaatgtatttccagtataggatgtatagtataattaattttttgtaaataaaatatttttgataagattattgcctttttttctaagggaagggggaactttgttttcctgattataatggtatgaatttaggaagggggggttttaaaaaaaatgatggttggtaaaaaagaatatgtcatttaatgttacttattattaggtagaaatccctaaaactggtgtggtttgaaaatctggaaaaccacagagagaggagagagactgcttaattatcattacccttgtctataatctttttcttctgcttcccttgaaagcagcacaaatttagacaattttttaaattatagtaacttatagcaggaaaaaaaatcaaagatatgcagaaatatgataagcaagcttgtttatttcagcattattcagaaataataaaaccttaacctaaaatcaaatgatgagggcaataattaaataaatcatggcatttctaaaaaatgggacatcattagctattgaacacaatgttctcagagaacacgtggattttggagaaatgtcacattaaaaaaataaccattttgtacagtaacatcccaattttataaaagtgaagatgtttaaacatgattatctctaatactgggaatgactgatttatattctgtatatgtttttgtattttccaaatactataaatatgtttttataatcaggaaaaaaaagacaataaatatcatctttttaaaaagtgggttgggacatctaacagcattttctgattagaggaactttgatagtaattatctcattttacctcttatccctcaaattcatcttatttcccagttcttttgtgttatctgttttctaagaatcctt

SEQ ID NO: 12480 - DNA, 21170 bp, Human
gggctgttgtctctgtctctgttttacgctgtgacctcaggtgtcgcttgccctcctgggctctgcccctttacctaccgagagcagttggcccaggcagccttaggtctcgttatgcgtttaccctggtagcttgcatggagctccctccagggattggtcaggacggctctccagtgcgcaaggctgttggccttggcagctcttgcttttctggggtggtttttgcactgggaatgagaaagaggcagagggccaggatccgagcttgcacatgcgggcggcacaggtgttgtccctctgctttagggaaatggcaggggagctctagtgctcggcatgtccgaggcccagtgactcagctgaatggctgcagaggctgtcagcctgctcgaagcctacccgcagagtgggtgctggagagcggggtgggggtgctctcgcctcaggaggagcggtggtggtacagttgtgctgtgtggggttttctgttttttttgtttgtttgtttgttttgaggttaggtcttgctctgttgcccaggccgggatgcagtggtgcggtctcagctcactgcagcctcaaactctgagggtcaggcagtcctcccgcctcagcctcctgagtagctaggaccacaagtgtatgccaccacactgagccagtgttttaaaattatttgtagagacggggtctccctgtgctacccaggctgggagttgtgctttggataagggctagccttgcacacggttccgcattgagccctgggggtgacagtgtgagactgggtgggaccagagtgcagtggggcatgcattcccaaccatggtcagccgcctggccctgggtgcacacctgaatatggaaaaaaaacactgtttttcctcttctatggtctcacaacacttttggccaccaaactgaatagtctgtattatatcacaatatcacagcatccctgtgtggaagccttcccaccccacaggaatccccccatgccctgtcacgtcctgggggacccatcttgcgtcttgagtcatgtggaggggcctcagttccttctgccgtctgcttgctgagatctcacccaggccagctcagaggcacagagtcggggttgcacctggcccccagtttggggtttctggaaagagtgtggtgaatcctctgagggacccctcataggaggaggttttcggggaagccctggcctgccaggtgtgaggggagtcgagtttgaggacatgagggaggggcctggtcccagctgaaggctggctgtgccatcctgtggaagcaaagcagtgcctaaggtctgatttccctctttcttggtggtcgcctcaccctcatgagcttttgagaagcttctgtcacagctctgctgagactgctgcctctggcttgcaagaatgttctggagtaccataggtgtggcagcaggggcagggagggatgctggtggaccatcacctaggagaccagaggaagtccgggaggtcagagcagaggccgggtctcatccccatggctcttcgtagcctgcagcggtcactgttttggccacttgaaagtgctgctctgggctctggctgtcctgaccctgtgatgaagggacaaaaatgtgggctccagggaggaggagcacaggcccaccaagagggtattttggggagaaattcatgtctgatcactgagtgctagggaaggaaggcagtggctagattcccagtagctgatgagggatcttgcacagtaacttcccgctcattaagatgaccttggcgagaagcagggtggtcacaggctcttttgcactggcctgaagtcgaggggtttggaagatggcccaggtagcgcagctggagttgctagagcgcccgcagggatggtgctggctcagcccctctcaccaagcttgacggctggcacatttggggaatgagaggaatgggggctcccgggtgttctgacttctgcctccttctgttccccagcaaccaaccagtggttcatcccagccgtgaggggggacattccccctgggtgtgcagcctatggcttcgtgtgtgacgggactcgcctcctggtgtttggtgggatggtggagtatgggaaatacagcaatgacctctacgaactccaggtaaagcagccccaggttctcactctgcctccttggccccatgtgacctgacggtagtggcttcagggttgaggcaagcgggaggtggaagggacgcttgagagtctgccaaggctgctctgaacttggcccacctcagaagaaggcagcaaggaccaacacccaggaccttcttgctccagcaaggcacctcgctcacccccggccatttcctcctccaccacaagttgccccgggtccctagtggtggccttctcatcccacggttcagtctccaggtcttgattttgcaggcgagccggtgggagtggaagagactcaaagcaaagacgcccaaaaacgggccccctccgtgtcctcgactcgggcacagcttctcccttgtgggcaacaaatgctacctgtttgggggtctggccaatgatagcgaggacccaaagaacaacattccaaggtgaggcttggtccttttctctggaaccccccgggtgggtgtgctctcacatgcacagggctccatggtgtcctaaagaatgtgcgcagcagagccccgtggccgggtccctttctcgtgctgggttgtaaatgagagagcggcaccggatgccctctcaggagctttcgggctccaaaatcgctactgaccctgagcaggcctcgtgggaggagggccaagctggaggtggaagccactttgccttgggctggcccagctctcggagtcggcttagagctgctcgcgttccttctcagcctccgctgcctacaagtttcctgatgggtattttccaaggcccgtggccaaggactctctgtctggaggtagtcccaagccagcgccccctcttgctctgcggagccctcatataatacccagctttgtgtgcatggcgggggcctgctgctgggtctggactcggggctgctgtgcagcctcacccaccctgtgtcccctgttccagttggactcatcctagggagcttctggcagccccttcctcaagagctagggtagaagaacttcagagctcccacagccctagcccctttgtgttctggggaggctgccactcactgatagccatccagcgaagcctctggcgtgaggagtcgagacttgccgtaactgatctttcctcgtcaggtacctgaatgacttatatatcctggaattacggccaggctctggagtggtagcctgggacattcccatcacttacggggtcctaccaccaccccgggagtcacatactgccgtggtctacaccgaaaaagacaataagaagtccaagctggtgatctacggcgggatgagtggctgcaggctgggggacctgtggaccctagatattggtgagcagggtggtagcaccccagcagccatgggacaaagcgggtctgcctcttggctggccccgtgggtggcgctgttgtatggtgaggtggggctcttagggagctggagcataccacttcgtgctttcctcttgtcatggtgggccagggtggggaaccctggatcgtccctaggtttggggctgttatctctgccctgtgctggctgagtgggctgaattggtctgcgggcttataagagaataagtcattaaggctttctagaatggaattctctggatccgggtagcattagtccctcttgactcgtcagtggtcagactgtgtggagtgctgcatcctggtctgactgctgtggtaccattggatgccggtaaaccgtgaggccttcggggactgcttgggccggtcaccaggtggtggtatcaggagtggctgggaaagattactaactgtggatctccggaggcctcttcagctgggagagaggagatggcgatgttgtcctatagatcagagtcggcactccaaagaagcagtttcccgtgagagaattttccaacagtttgccaaaatgtctgtagcctaaggtggttatggcggtgaacgtatttcatggagagttcggggtgtgcccaccactcctcccccagcacagagtgcagtcctggctcagggcaggtgctcaggatgtacctgaaggagcgctattgctagcctggtcgaaaccgcctgggtaacacaggaatctagctaccatgacaacagtcagagggcctgccgtaggctatagggaagccagggatggaattctctcactgagacagatcctaccttcctgagctagcttgaatccagggaacgacctgtgtgcagtctaccttgtgtaaccctttcccctccgtctctctgcagacaccctgacgtggaataagcccagtctcagcggggtggcgcctcttcctcgcagtctccactcggcaaccaccatcggaaataagtaagtggctgctcacctgcgtctctcttctctagactggcgtggcccctcccccgaagggctctcactcagttttgtcctgtcagaccctaaggcctgaggatgcctctttctggctgggctggcatttggcagccctgtttttccattacgaccctgggggaccaaggaaagacagattcaggggggagagggccacacacaagctgagtctgagaccctccccgggcctgtgaggctccgccctatcaggtacagagtgttctaggtcctctgtgcaagcacctgggtgtctttgtggatgtccaggtcctaaagggaacctagaaactgtggacatgaaggtgagctttagatgagctgaacggcacttttatgtggtagaggtgacacagttctcctgagggctgagccaccaggcaggagagggccacgtcaggaggcttcacgcatccttggggactctcctggggagagccagaggactgagctctagaactggggtagcagaggtggcctctagcttggcaccaactctacaatcctttcccactcttccctcctcactcccagaatgtacgtgtttggtggctgggtgcctctcgtcatggatgacgtcaaagtggccacacacgagaaggagtggaagtgtaccaacacgctggcttgtctcaacctgggtatggcctcctcgggctccgagtggcctgtgggaggctgcaggaggctggcccttctcagcctaagagctgtgtggggtgtgcggggagcaagctgggcccccggctccctttggaatccactggaaggatccagtgggcagagctctctgaagcaatgttccgcctctgagttttttgaatgagctctccatccaaatggcccaacatccaaaagtgcaaaagcctctacggtgcagggcctccttccctcctcccggttctccggttctgcttctcagaggcagccatgtgggtggtttcctgtccaccctgcaggggctcttcatatctgagcattagccataggtccctttaaaaacaaacagtggcagcctggcgcacgcagtgccacacctggcctttctcatccgccgtatcttggagatcactccacgtccctgccccgcagcagcctccttcgagttgcggttgtgctgctgtaacttgtacaggcgccgctccgtgagtatccttgcaccatctccacccgtgtgcaagtgtatcctaggggtgaaaacctagaagtagggttgctgtccgatgcggctgaactgccctgcacagaggctgtgcccacgtaggcgcctccagtggtgccctcacggaatggtcaggccactctttgccaagcctgatgggtggccgaagctccccctccggctcaccttgagccccagctgctgcgggcctgaaaataaaaatgccaggcgccgatggttgaagtttagatttcttttgcgtgagagtgtgtgttttttcttaagatctttctatcacgttttccctaaaccactttcccattgccgtctctttctgtgagttgtagtgttctttaacgggcaaggaggtaaacctctgactgtgtttctcatggttttcttagttggccgttggtggtttgtaattttattttttgtgttgctttttgccacaaagggtttctttgttttgttgtttttaatgtaataatccaataacttcttgattttaattcccatccttgacaacaaaagaaccaagggcaaccaggggtggcgggtttcctccatcctccttgctgacctcccttgtctgccctcccccagataccatggcctgggagaccatcctgatggatacactggaggacaacatcccccgtgctcgggctggccactgcgcagtcgccatcaacacccgcctgtacatttggagtgggcgtgacggctaccgcaaggcctggaacaaccaggtctgctgcaaggacctctggtacctagagacaggtaggcccggcccagccgactcccctcctcccatagcctcccgccccttctcaccaactgcgttctcccacagaaaagccaccacccccagcccgagtacaactggtacgcgccaacaccaactccctggaggtgagctggggggcagtggcaacagccgacagctaccttctccagctccagaaatatgacattcctgccacggctgctactgccacctcccctacacccaatccggtcccatctgtgcctgccaaccctcccaagagccctgccccagcagcagccgcacctgctgtgcagccgctgacccaagtaggcatcacgctcctgccccaggctgcccccgcacccccgaccaccaccaccatccaggtcttgccaacggtgcctggcagctccatttctgtgcccaccgcagccaggactcaaggtgagccaggggaccagggacgtttgaaagtagggggctagcctccggggagaggcagcggccaagtaggggctgcgagacggcagcctagacagcaggccagcagccgggagctttgggcttgtctccaagggttgtagggggatgctaaagcctggccccacctgtggaaatggtcactctcagggcacagagaagagccagactcccacacaagcaggccaacagaagtggctcagggctgcctgcaaaggggctggggacatcgtgcagaaggtgatggctgacggctggccccttctctcatcaggtgtccctgctgttctcaaagtgaccggtcctcaggctacaacaggaactccattggtcaccatgcgacctgccagccaggctgggaaagcccctgtcaccgtgacctcccttcccgccggagtgcggatggttgtgccaacacagagtgcccagggaacggtgaggagtggtcactggggcgggtgggatttcctgttgatccagtggattaagttgcaagtgtactgaggggttcacatccctctcgggctctggtaccacgcaccccacacctttccctcctgggacgtgcagatggggaaacgctcctgcgaggtcatggtgggaattaataggttaatgcctagaaggcctaacctgctgcctgatcctaagagcatttgccacgtggactttcttgtcctgcagcctgagaggaggatctagccagctgggcttgccacaggcccatgagaatcaacgggacctgactctggtctttagaaaggatccagagctcccagctgcctcttgccacgggggttgccgtgcatggtgggtggtgggagccctctgtgtctggggccaggagagcggggtctggcagtagagaaagctgagccatgctggcgggatgaggctcccaagagcagggcagcccctgggcaggttccggtgaggtccaccaagcagggaggtgggtggcacctgtgacctggcctcacatgcccgtgcctgctgcaggtgattggcagtagcccacagatgagtgggatggccgcactggccgctgcggccgctgccacccagaagatccccccttcctcggcacccacggtgctgagtgtcccagcgggtaccaccatcgtgaagaccatggctgtgacacctggcactaccaccctcccagccactgtgaaggtggcctcctcgccagtcatggtgagcgtcttccggggcttgtcactgtggtcaaacaagcatagtcattccctccgggctttagagttagccgttggaccgtgggctgcagaataagctgtctccattaggggcgtcatggcctcaggtgagagctgcaggctcagcctcctcccttgcctgttaaaggaagggggaaccaagctgttcttgggcttgggagcaggaggaggaggaaggtgagtgttgaggcaggagctatgggcccaccgtggacatcttgggtggtttccccatcgctttctttgcctggcctgtcactcgtctctgcctcctccaggtgagcaaccctgccactcgcatgctgaagactgcagccgcccaggtggggacatcggtttcctccgccaccaacacgtctacccgccctatcatcacagtgcacaagtcaggcactgtgacagtggcccagcaagcccaggtggtgaccacagttgtgggcggggtcaccaagaccatcaccctggtgaagagccccatctctgtcccaggaggcagtgctctggtgagtgatgggtgctgccaggctacggccactgccagtggtgaatggccgccctgggccagctccaggagagtctcagccaggccatgcccttgtttggtttccagatcactccttgctccatcccttcctttttagatttccaatctgggcaaagtgatgtcggtggtccagaccaaaccagttcagacttcagcagtcacaggccaggcgtccacgggtcctgtgactcagatcatccaggtgagctctcagtctttgcacatacgcaagagtgggggcctgggtgccaggccacaggaagaactcatgtccctgcccatggaagatcccatgagcacacatggctcagcaagttctgctgctcactcccctcgcccacagcctccagaacattccctgagccgccaaggctgccggcggagagtagccagaccacacttcccttcctggcagtgatgccggctcatgcacctgcttccccctttcagaccaaagggcccctgccagcgggaacaatcctgaagctggtgacctcagcagatggcaagcccaccaccatcatcactaccacgcaggccagtggggcggggaccaagcccaccatcctgggcatcagcagcgtctcccccagtaccaccaagcccggcacgaccaccatcatcaaaaccatccccatgtcggccatcatcacccaggcgggcgccacgggtaggggcctcccccgacatatgagtgtctgcaagtcctcactggaggggaaatggagtccgggttataaggcgtgctgtgtttctgtttagtttacccttttctatcttctccttgctgccttttgtgtctaagggtagtgaggagatgggcagggctatggctgtgacttgtggatgttcattatagtctaggggcagcaggggcagccctcacagagcctgtctcccctgggccccactctcccatccaggtgtgaccagcagtcctggcatcaagtcccccatcaccatcatcaccaccaaggtgatgacttcaggaactggagcacctgcgaaaatcatcactgctgtccccaaaattgccactggccacgggcagcagggagtgacccaggtgaggcactcccagccgtctctcagcccagtgtcctagtgcagtccaccccagcacgccacgcaggtcctcccgacaggcctgggaggggcagcatcggtggcatctaccagcctggtggtgacgttggtggcactttcctctggtgttccaggtggtgcttaagggggccccgggacagccaggcaccatcctccgcactgtgcccatggggggtgttcgcctggtcacacccgtcaccgtctccgccgtcaagccagccgtcaccacgttggttgtgaaaggcaccacaggtgtgtacccataggccaggtcccctgccacccctagattataacgaagcagggctggccttcaatccccatggcacagctgggtggcacagcagctcctctctcccgagccttctatgcaagcagctccagagtgccccagcctgtgcaggaggagctgctgggaaggagacagcagcagccttggcccaactcttgcctcctttccttcaggtgtcacgaccctaggcacagtgacaggcaccgtctccaccagccttgccggggcggggggccacagcactagtgcttccctggccacgcccatcaccaccttgggcaccattgccaccctctcaagccaggtgatcaaccccactgccatcactgtgtcggccgcacagaccacgctgacagcggcaggcgggctcacaaccccaaccatcaccatgcaggtagggcagggcctgaggccacgtgtgggcgagggaccccacacaagtggaagcacgtgaggctcacgccgtccgtccacaggcctttccttcctggtgttgcgctgctgccgggtgcagccatggcaggcctttcctcacctggggcattttccctggtgtcacatggtccctgtgtcatagtccgtggtttggctgtcatggtttggccatgcctggtgtttgaacaccgggttcttcctctcgcagtgttctacaggacgccgcagctcgtctgcatgtgtgtgcagtgttctgttcatacatattaaggaaaacggtgaaacgtttgttgttggcctttgagcattgagggggatttccattctctgacaaaggacttgacttcagccagcctcctgccttccccttgccctgtcctcacagcctcttcctcatcccagttgcctttgaggcaaagtggtgcctcttccctggcctctgagcaagtcagtgtcttgggggcaggggtgagtgggtcttacgtctgccagggccgttgagaagtggtcagtggtcccagcctgtgtggtgacagtgcaggacagtgggagggacaggcagacagccagctgcagcactaactctcctcctcgtgtgtctccccagcccgtgtcccagcccacccaggtaactctgatcacggcacctagtggggtggaggcccagcctgtgcatgacctccctgtgtccattctggcctccccgactacagaacagcccaccgccacagttaccatcgccgactcaggccagggtgatgtgcagcctggcactgtcaccttggtgtgctccaacccaccctgtgagacccacgagactggcaccaccaacacggccaccactactgttgtggctaaccttgggggacacccccagcccacccaagtgcagttcgtctgtgacagacaggaggcagctgcttctcttgtgacctcgactgtgggccagcagaatggtagcgtggtccgagtctgttcgaacccgccctgcgagacccacgagacgggcaccaccaacaccgccaccaccgccacctccaacatggccgggcagcatggctgctcaaacccaccctgcgagacccacgagacgggcaccaccaacactgccactacagccatgtcgagcgtcggcgccaaccaccagcgagatgcccgtcgggcctgtgcagctggcacccctgccgtgatccggatcagtgtggccactggggcgctggaggcagcccagggctctaagtcccagtgccaaacccgccagaccagcgcgaccagcaccaccatgactgtgatggccaccggggccccgtgctcggccggcccactccttgggccgagcatggcacgggagcccgggggccgcagccctgcttttgtgcagttggcccctctgagcagcaaagtcaggctgagcagcccaagcattaaggaccttcctgcggggcgccacagccatgcggtcagcaccgctgccatgacccgttccagcgtgggtgctggggagccccgcatggcacctgtgtgcgagagcctccagggtggctcgcccagcaccacagtgactgtgacagccctggaggcactgctgtgcccctcggccaccgtgacccaagtctgctccaacccaccatgtgagacccacgagacaggcaccaccaacaccgccactacctcgaatgcaggcagcgcccagagggtgtgctccaacccgccatgcgagacccacgagacgggcaccacccacacggccaccaccgctacttcaaacgggggcacgggccagcccgagggtgggcagcagccccctgctggtcgcccctgtgagacacaccagaccacttccactggcaccaccatgtcggtcagcgtgggtgccctgcttcccgacgccacttcttcccacaggaccgtggagtctggcctagaggtggcggcggcacccagcgtcaccccccaggctggcaccgcgctgctggctcctttcccaacacagagggtgtgctccaaccccccctgtgagacccacgagacgggcaccactcacacggccaccactgtcacttccaacatgagttcaaaccaaggtaagtgaaggtggccagcctggctttcatggtctcccagccccccaggctgaaaggccaagacaacgatggcgggggtccgtccagagtccaccagtcaggctccttggcacccaatttaccagtggggagagctggggcgtcctggctgtacctgaagcagacagaggtctccaggagcctgtcctgccttatctggccctccccttggtggtagaggaagcctgtggtggtcaagccaagtacaggccgggggggctcctgctgagcagccgcctgcctgtcgcccccacagaccccccacctgctgccagcgatcagggagaggtggagagcacccagggcgacagcgtgaacatcaccagctccagtgccatcacgacaaccgtgtcctccacactgacgcgggctgtgaccaccgtgacgcagtccacaccggtcccgggcccctctgtgccggtaagagcccagggggccgtgttcttccccgccttcccggcctacgcccgtgcagttccacactcagacgccagatgtcgctcttgtaccaggcatggggccgctcctggtcccttttccggaccataaaagggcagcctcggtgcctgctgcggcaggaggcaggagcctcaccgtcccccgcatctctggggcgcttttatttctgggactggttctcatcgcgtgtcacttcaccgcagcctgtataagacatggcgggggtctgagtgcccatttgtccaggccagggtgactgaggacgggttaaacctgaccgggggtctcaagggcctttctcctcatgctggtcagagaaccactgtcccctccctatttaacatgggctggagctggcccatcaagaatgaaaacttaggcccacaaggaaaggtgagggctggcttgcttctcagccctgctgcctggctctggcccctctcctcccctctgacaggggcttctctccctttctagaagatctcatcaatgactgagactgccccaagggctctgactactgaagtccccatcccggccaaaataacagtgaccatagccaacacagaaacttctgacatgcccttctctgctgttgacatcctgcagcccccagaggaactccaggtgtcgccaggtcctcgccagcagctgccgccacggcagcttctgcagtcggcttccacagccctgatgggggagtccgccgaggtcctgtcagcctcccagacccctgagctcccggccgccgtggatctgagcagcacaggggagccatcttcgggccaggagtctgccggctctgcggtggtggccactgtggtggtccagccacccccacccacacagtccgaagtagaccagttatcacttccccaagagctaatggccgaggcccaagctggcaccaccaccctcatggtaacggggctcacccccgaggagctggcagtgacggctgctgcagaagcagctgcccaggccgcagccacggaggaagcccaggccctggccatccaggcggtgctccaggccgcgcagcaggccgtcatgggtgagtgccggtgcaaccctggggaagccgggccgctcgggggagcaataggccgcggagacagcctgggaagaggagcccatttccctcgagggtggcatgagccagatgtgatggggaggacgagcacaggggaccccaggcaggccaagtagtagagactgccgtgtagaacaggctggctggggttagcgcctgggaaacaggcagggcccctcggccagggcttagcctacagtggagcacggtaggaggtggacggggtctctaggacaggctttgggggcctccgcccgggctgcccgcttctggccagccttcctagtaagtagtgtttctctcgaccctggagcaggcaccggcgagcccatggacacctccgaggcagcagcaaccgtgactcaggcggagctggggcacctgtcggccgagggtcaggagggccaggccaccaccatacccattgtgctgacacagcaggagctggctgccctggtgcagcagcagcagctgcaggaggcccaggcccagcagcagcatcaccacctccccactgaggccctggcccctgccgacagtctcaacgacccagccattgagagcaattgcctcaatgagctggccggcacggtccccagcactgtggcgctgctgccctcaacggccactgagagtaagcgactgagggcgaattggtgctggggtggtgggggcacccagggaggtgagggcaggacgggaggctcggtctcacttgggagccaggtttcccgagtctttcccgctgacaccttctttcttcctaggcctggctccatccaacacatttgtggccccccagccggttgtggtggccagcccagccaagctgcaggctgcagctaccctgaccgaagtggccaatggcatcgagtccctgggtgtggtgagtcgggtgtgttggggctcctgagtccgtggcctggggggcagcactgcctctaggtgctgagggcctgatctcgtcgcaccgattctgtcttgcagaagccagacctgccgcccccacccagcaaagcccccatgaagaaggaaaaccagtggtttgatgtgggagtcattaagggcaccaatgtaatggtgacacactatttcctgccaccagatgatgctgtcccatcagacgtaagtgtccccaggtgctgatgtcctcaggtgggtgggtcttggctccaccaccctgagcggggcttacaggaaactcctccatctttgggccaagctgagtagccaggaagcctgaggaaggtgggcagagaccatcccccctgaagcagtagaaaaggagagctttggttccttcccgccagtaccgggccacagtcagcctcgccacgtccctccttgccgtgaggggccagccaccgctgacctcttttccctctggcccatagttaccatggacctgcagtgttcctggggtggcccagagctgccttctccacagtggcgttcatgccactcctcttttcctaggatgatttgggcaccgtccctgactataaccagctgaagaagcaggagctgcagccaggcacagcctataagtttcgtgttgccggaatcaatgcctgtggccgggggcccttcagcgaaatctcagcctttaagacgtgcctgcctggtttcccaggggccccttgtgccattaaaatcagcaaagtgagtcttgctgtggggtggccgtctgtccctggttggtttctgcctgcctcagcacatgaggtggccgggggggggcataggagagctaggttttgagtcccagtttgtcttagtccttccacttgggggaagatctctttgaagctccttgaactaccacatggaatatctctactgtgttagaaaatggcttatgggaaccatgattagtcagttctggaagcctctagcctgttctgttgaccttctgaccccctggcttctagagtccggatggtgctcacctcacctgggagccaccctctgtgacctccggcaagattatcgagtactccgtgtacctggccatccagagctcacaggctgggggcgagctcaagagctccaccccggcccagctggccttcatgcgggtgtactgtgggcccagcccctcctgcctggtgcagtcctccagcctttccaacgcccacatcgactacaccaccaagcccgccatcatcttccgcatcgccgcccgcaatgagaagggctatggcccggccacacaagtgaggtggctgcagggtgagtgtccttcgtggagctcttcaggcacagggaaggcccaggaagccgggtgcagcaggaggaactgtcaccatctgagattttttcccatgtgcggcgtctccctgcttcctttggcgcgcacacagccccccacgggggtggccatcaagtagagcaggggacccagctccgggcctgggggtgcaggggacgccaccccaggatgtttgaggggacaagcagtgagagggctggcgggaaagtgtaggtttccaggcccgaaaacagcacgtcccaggtccctggagtgcagcaggtgagggatggaggccagcctgcctcctgtcaggtcatgctcctgctccagctcccctggggctctgggacctgggagggcagtgagaggtgggagctgagctgagtgggtttctaacctacgtccagaggggagtgagtggtgtcgtgttctggtcccaaggagtggcgtaaaaggtgaccacccatagggcaggcgccccacccttgccagctgcgggtcatgccatgtggcaccaagagactctgcaggcgggcagggcgcatgtgttccttgctctcgttctgtcacaatgctgctcacgcatctctcccgttccttccagaaaccagtaaagacagctctggcaccaagccagccaacaagcggcccatgtcctctccagaaatgtaagcaggaagcccctctcgggaaccttctgagactaggggtggaaatagctgggttcagcctcttgtcaaatgactgggggcccctaaccggccctgcaccagcagggcctccagtggtgcagggcccacactaactttctctttcctttttctgccttccaaggaaatctgctccaaagaaatctaaggccgatggtcagtgagaggaagctgactagcccctggattcttctccagacccccctgcttcaggaacacccgccagggcccacccctcccaccccgtcccagcattcgcacttcaccctcgcgagccgctgttcactcctctcccctttctctttctctctgtttttaaaataatctaaagaaagcacattttaccattgctgttgggaggaagcagaggcagatgggaaagcagagagaggagcgcgcttcctttcctccccgctgccgcccaccctggggagagacttttgcggggagggaaggcggagctgaggacagccagctccgccctcccaaggctgtgcgttcctgagggccaggtcgggggcaggcatggaggggaggaaaggcgtccctcttggccctccccagagtggctttcctggcaccctggcctgggtgtctggttctgttttcttttcttccccttgtgtttccagtcacctaacttcccttcctcaggctcccccggcccaccctgctcagtgaccccacaggaagcttacacattttctcagaggcctttgtgctcccacctcttctaccctccccctcttctttcccattttaaaaaagaaaagaaggaaaaagaaaaaaggggcaaggagccccgcggcggcctgggcagcgcctgtgcagacctccctgcaggccgcactgccaactgctgcatttgttgtgttttttaggttgcaattggtgaagttcacactttcattgtaattttagcgtgtggggttttgtcccttttttgttgttgttagctgtgtacagaatgtgtaatcttttttcttttctcttttttttgttttgttttgttttgtttttgtttttttacttttttcttcttggctaattcttggcagggatctttctggaggaaaagctggggccagccagggcaggagaggtgtgaaatctgccacgaggggcctgctgtttgccacccagcccaacttcctgttgctggcccctgccctctgcccttttgcctgtcctcaggccgctggaacaaaggaaggacagctcattcctcatgggcgatcactccgcatctatagggtcgagcctaggggagcttgagggagggctggggcctccttgtcctggatttccagctctccccatgccccctccctgagcaccaccggcaccgcctcccaaacagggctgctggtttccgcagccactgctccacctcccccaaatcgtcatggaaagggtggagaatggaggggaaccaggcgtccttggaggcagcttgggagggtgactgtgtagtgtcacccacaagggaggctagggcaatggagcaggccaccagcagcagctgtgcagcatggaactcaggccaggctccgaggctgggggatctgcttggagttttctgccccccaccccaaacttctgtcgaggagcaaggcttgccagcaagtcagaaggatttgaaccgagcagccaatctttccagccctcccctaccgacctctgcctggagacgcagcagcctgtgtcctccagggcctctggtttgttgtattatagtatatttcgctgtggaaaatgtcacgtttagtcaccttggagcccactcacctggtcctgttgttttaccccatcccttctctcgcgcgcctattgatttgtttctgaggagagtacaccgttcactattgtagagtaacccctgtgactcaatattaccatagtgcgatgtcgttttgtgctattttgaacaattaaaagactttttttgaaataaccactaggtgtctcactgtgtcccggcatcctctcaggaagcctgagcgggaaggctgagacctgcccgaggctcacgggagccccctggagggagacctgagctctggtgaaagcgtagaaggccccagagtgaggcctctgctgtggcctccggtctttggaccaagtcggaccagggtccagcaggttgcttggtagctgccttgcagggcaagggccaaagagccccttgggcagctgctgctgacttcctgtgtctggggcccagatctccctccctcccctcctgcactagaggataggatggggcaagggcctggcaggtcaccagcggcagcctccttgggtgggttggggggaggtgggctgagtcaagtacaccacgggtactgcagaggtggatcccttcctctggcttcctcttaaatgtgagccatgcccccaagggaagaagcaagagcttgtgatccagactgaccacctagcagctgggtcggtaggacagctgggatcccgtgggctgaatttgtaccaggaggcccagaaagctccggggcaaggtggccggagcagcacaggcctaggcgggtctgaggggagtgacaccctgcttctggggcctggtgctcctggcgcacctgcattccccgccccctccaagcccctgccgcctgcctttgtttcccctacacacctctactgcccagccttcctctcagagcacccaggcactccgctaccagaagctcctggagtaaccaaagcctccgtgtctccacctgtggcatgggtgtgtgtgcaaggccctgtcgaatgcgacctcttctgggaagcctctgtcctgtggggtctgctgtgtcatgtgggggtggggggaagcagactggccagggcttgacaccaggagccatggctctgtcttacccaccgcaccaactgtgacctgccttggagcctagcctcgcagaggcccaaggagaggggtgggaaagtgtccttcagagcagagcggtaggagtcatggctggggctggtggaggccaggggccacatggggctggccccagaaccgaggggccttgcggatttgccatacctttggcaaatggcgttgtgggcgcttcgcctggtgggggtggtacaaggcttcttcctaccccacttctgtagctggcacctgtggggctacccaccctccgcattccttcagctcacttgtctcaccgcggctgcatcacactccacaaggcaagggccacatcagtcatgcctctggtgtttatctgaaaataccgcgtttccgtctgagggcaccactcagtctggggaggcaggagggaggctggacatgaatgtgaacatgacaggcctgtgagcagggcaggtagatacagcccggctgggcacaaagctcatcccctgagcatgagccgaggccgagggtgggtgggagcacacagaggatgcctccccagctgccaggggcatcagcctcattaccaagcaccccaaaggggaactgtttggggttgggtgggtcagcctgcagcagggactgagacagccactgtggcatcaaagaccagcagtgcagtaccacgcccagaggctggaaccattttgtgcactgttggcctggaaggtaggaaccacctcagcccagctgccttgtagcatcatcgggtcagtcatagagctacagacagatctgggcagctggaaaacaggcccagagaaggggggtgtgggctgttacctgcagttactgtctggccttagagctgtgtcacttgtgtaaagaagtcagtgccaaggccgagcgcggtggctcacacctgtaataccaacactttgggaggccgaggcaggtggatcacgaggtcaagaatttgagaccagcctggccaacatggtgaaaaaccgtctactaaaaaaaaaaaaaaaaaaaaaaaaaaaattagctaggcatggtggcaggcacctgtaatcccagctact

SEQ ID NO: 12481 - DNA, 29913 bp, Human
aatctgggagacagtggttgcagtgagccaagattgcaccactgcactccagcctgggcaactgaacgagactccatctcaaaaaaaaattaaatgtgaaggccaggcatggtggctcatgcctgtaatcctagcactttgggaggccgaggtgggtggatcacatgacgtcaggagttccagaccagcctggccaaaatggtgaaaccctgtctctactaaaatacaaaaattagccagccatggtggcaggcacctgtaatcccagctacttgggaggctgaggcaggagaatcacttgaacccgggaggcagaggttgcagtgagttgagatcctgccactgcactccagcctgggcaatagagcaagactccgtctccaaaaaaaaaagaaatgttaaaaatggttttaacactagcctctcccctttatttgcaccctaggacaccaaaggcaccacagaaagccaaacaagcattccagagcctgccagcaatttctcaaacaatgtcagctaagaagctttgctctgcctttgtaggagctctgagcgcccactcttccaattaaacattctcagccaagaagacagtgagcacacctaccagacactcttcttctcccacctcactctcccactgtacccacccctaaatcattccagtgctctcaaaaagcatgtttttcaagatcattttgtttgttgctctctctagtgtcttcttctctcgtcagtcttagcctgtgccctccccttacccaggcttaggcttaattacctgaaagattccaggaaactgtagcttcctagctagtgtcatttaaccttaaatgcaatcaggaaagtagcaaacagaagtcaataaatatttttaaatgtcacagatcaaaattgtttccttcaaatggggtctgccaattcacaaccagatgacccattttaccctattcactgcagactgaatccagattctacacatacttatccccaccaagaccctcactctgtctccattggcctacttgttcatctttcactcattcgacaaatctttctgaggtaagagcgaggtgggacaaaaaaaaaaaagcataccaatgaaccagacacggtcttattaaagataatataggtttaaaaaaaaaacttggcacagtttcttagcacttaggcagcctttggtatttatgactactatcatcaccattaccaccatcattatcagtcattgtcatcagtggtcactgtcttctgtgagtttccaatctagtacaggatcatagttcagggctagagagatggcatggagtatctcaaatgccattcagaagggcctcaagctataaaagtgggaaggcatgacattagtttttaacatgagagttaaatgatcagaatgacaatataaggaaattaaactagcaacctggctgggcgtggtggctcacacctgtaaacccagcactttgggaggcccgggggcggggggtgggggtggatcacttaaggtcaggagtttgagaccagcctggccaacatggcaaaaccccatctctactaaaaatataaaaattagccgggcgtggcagtgcacgcctgtagtcccagctacttgggaggctgaggcaggagagtcgcttgaacccaggaggtggaggcttcagtgagccaaaatggtaccactgcactccagcctgggcaacagagaaagacttgtctcaataagtaaataaataaataatctggcaaccatttgtaggaatgaacaaagagggaaataattattacaacaactacagagactgccccctgaatgacgctttcctcagacattagaaggaaagagaaaaaaggaacactcatccagcatctggcttctgtcatcccagatgacacggaggcctaaattgggatgcttgccttatgagaagaaacattttaacggagtggtgggtggggtggggccctatttatgacacaagagagcaagcccctcccttcttgtaagagagtgctaggcacatagcctcctcctattcctaatcctcccaccaaagaaagaggcacagagttcattacttagtgggggccagctgtgatcggccaactgccagctgccttaaaaaggaagaccagtgatgctaggatggagtgaaacccaagaggaagtgccatcatgaggaatcaatgagagatctgtgaagagagagggctgggtgggagcccagaaggatagaacctggaagatcaatatctcccgtgagggaaataacaatggagccaggttctaagtcagtgtctaggtcagactggcaacctgaaccacaccagaggcctataaccccgctagagcctgggccagaaaagacacccatagcccagccagaatcgaagactctgcagggatccaatacccaacagaagcctgcttcaaaccaaagacccctcacccagcaggagacccctgcacaacatgatgctgaatcccagaaggaacctagagcccaacaaaaatctgcttcacaagaggaatttcttgccccacagaagcccgcaccacagcaatcaccttacatccaaagggtgctgctcactcaacaggaagctgcctcccagcagggacctgggctaggaaaagaatctataactcaacaggagccagcattgagacaaagacatgtagcccagccagggcctgggccaggagagccacctccagctcaacaagaagctgaatcaacacctgcggcccaggctaaacctggagccaaaagggagccatctgccccgactgaatctacgtcccaagagacacctgaacagtcagacaagcaaacaacgccagtccagggagccaaatccaagcagggatctttgacagagctgggatttctaacaaaacttcaggaactatccatacagcgatcagccctagagtggaaggcactttctgagtgggtcacagattctgagtcagaatcagatgtgggatcatcttcagacacagattctccagccacgatgggtggaatggtggcccagggagtgaagctaggcttcaaaggaaaatctggttataaagtgatgtcaggatacagtgggacgtcgccacatgagaaaaccagtgctcggaatcacagacactaccaggatacaggtgagtgtgaatctggaggaattgaagcctctcagggacagtcattcatttacttaaaaaatactaaaaacttacggtgtatcaggttagctctggtcatccttcaacaatcctgagataaagatcaacatccccattattaaaaaaaaaaaaaaaaaaaaaaaaggctgggcgcagtggctcacacctgtaatcccagcactttgggaggccgaggcagatggattgcttgaggccaggagttcaagaccagcctagccaagatggtgaaacaccgtctctactaaaaatacaaaaattagccaggcgtggtggcaggtgcctgtaatcccagctactcgggaggctgaggcagagaaacacttgaacccgggaggcaaaggttgcaatgagctgagatcgtgccactgcactccagcctgggtgacagagtaagactccatctcaaaaaaagaaaaaaacaaagtctcactctgtcgcccaggctggggtgcactggtatgatcatggctcactgcagcctcaaactcctgggctcaagcgatcctcatacctcagcctccggagtaggtgggactacaagtgcaccaccatgccccgctaatttttacattttccgtagagacgtggcctcgctatgttgcccaggctggtctcgaactcctggccccaagcaagcctcccacctcagcttcccaaagtgctgagattacaggcatgagccaccgagcacctggccaacatcctcattttagaaatgaggacatcaggtagaaaataaagaagtaagggttcttgcacagggccatgcagttaggaagtggcaaagtcaggatttgaagccggggtctttctcccctggaccaggctgcctccctatagaggatttggggaaaatcaaatcccagagtgggaaggcactctgagctagggaccaggagaccaggaaagcggccctcttgccagtgttcattcatccatccacagaaactgactgagcaccagctctggggtagacacgggcgtaagtcccagcaatacaatacaaagacggtaccttacccttctggagtttccaggcaggctaggcagaacattggggcatcaacagtctctcagtttaccaggtctgtcctcttctgccaggaagatacctgctccctgccaggctgcctccataggggactcagtccagccaggcggaagggccttgcgggttgtgttctcagcaaggaggagccgggagagaggtgcgggagccgccaaggtctcaggcaaggtcagggactgacggcaggaaagttgggggagcagcatcagaggataacgggcccaaggctctgggctcaccgcaggcactccctcgccttctccgcctcttcccggggcccagtgctgccccctgcctgcttcacaggagccccaggaagctccgatcttccttctctaggctcaaaacccctgccatggagaaggggggaatacaagttttatctatggaactggaggttacttgttgaagtcccctgatgtggggggaaaaaccaacgcagccctaatcctgaagctgagggtatctgtgaggccctggtccagagggcaggcaatggcggcccctccgcccagaggccagtctgtcttgtctctcccacagctgataagagagtaacgcgtttctcagcgccggggctgctgggtatgctttgagagggaaggaagaggggcggcaggcaaaggcagggattgaggcctgctctccccagtgctgaggatagaaagctgtttctccaggcctccagagcacagtctcaagggatgcccgccccacaccaccgcggcgggcgaggttgcctttcaggcggtccagaagcagttggctgtgtgcgtgtgagcaaggcggtccagaagcagttggctgtgtgcgtgtgagcaagcctcgagcctcctctgtttcccgccatttctcaagcatgcgtcgttccctctacctccgctcttgggccggcccgcggcctgaagctagtgcgcaggcgccgagcgttctcctaccaccatcccccaccctcattatcgggagcatggattagggggcggagacagagggagaaagatcccccaggaaaagcgcaataggagaactaggagacaggagagggaaagcggggctccctcctccaacggctctcaggcacagccacgcctccagcgctggcgccccgcctcgtctttgagttggcagaggacctggcccgcccccaccccaggcagaggctcagaggcgccccactttcccccttcaaaaggcgggccgggccgcgtgctagggcatccctccctgggaaggtgagtgggatggcgagactgagccagcacatgggaggcttcccagcacgtgggaagatcgggacttccctgctggggtgctccccgcggggctccgcactagtcctgcccgaaggacgcttttcgccacccccggggttgcctttttgttggccgcgagccctttaatgcgcggtagggggcggagccagatcttaaattctggcggttgggggcggagcacggcagcggagggagaccagaattggttagggagctggacccagagaagagcaagctcgggattgggtaataggggggcccgacagtagtgtgtagcgaggattggccctccgggcagggcctcgcggctggaattggcccccgcgggaggaccgcggggaattgatggagttggccgggggaacggagcccgccgaggccgctatggccccggcctcgaagaatgccaaagagggctcaaggagccacggtcgccggcggtggcgaaaagacaaggccaaaggtgagcgcgcggagaccggcagcagcccggaaggaacctcgtacatcctacggggcagtggggacagcgtggactggcccactgccacagggagttgggggggtccgcggactggcccattgccgcttgcggggacaacgggatgatccattgtgagaagggggtgatgtgacagccgagaggcccaccctggcacagggactagctgacgcccggatcggcttgggagcagagtccggaatgcgagcttcgtggaccagggttcccgctcggattccgtattcgctgtgtgaccaagggcaacggatgccctcagtgtttcccacctggggaatgcttcaagcgccgatgttcagggctccagcgctcttgagaggataagggggaaggaggttagcaggtgttactcaaagaggaagtctagcggtgagtcaaggagaggtaggaggaaggggtgcccatagtggagagtgcagcggggccagtaaagttcatcgcagtcccggcctcccacccggcaagtcagtccatccatccatccattcattgtcagtcaacccgcttcagccggctccactggggcctagccctgacccctaccctttccaggacaacgggccctggcttggcttcagacctccacacctgcctcagcaaaagggaaggcctcatttctctagggtgtcacattattttcaggtctcaaaaggcggaacaaaggctgacagaccaacagaaatgctgcaagcctcaggcaggggcaggtcctcagttacaagcatttatcaatcagcatggggacccgtgggaggttcccatgcaggaaggaaactaacaccacccctcagccccagggaccccaaactcattgcttcccctgccgtagaacacatcattagcccagaatagacctggagttggcttcagacacacgcaggctcagacaggctcagagggcagacggactggagcccaagggcactcgctgtcacagcaagacactgagcctcacaccagtatagcatacccagaggcagtacagactgtagttaagaaacgtgggcgtcggagatccggttcctcaggctgggagctgtgatgttctgggcaggagactccctctttccctgcctcagctttctgagctctaaaatgggtatgatgataggagtacctccttttgtgaggttagaatgaatgtagagcgtttggcacaggcacgcagcaaaccctcaggagaagtgaaggttattgttactgttagtccccaccggacggtgaacatcctaaaagcagggctgtatctgccttgtttaccctgtatttctagagcctggtatgccaggcaaataggcactcaaatatttattggattaataagtgaaggaatgtgtgaactgtaacagagatcataataatcacgcttcccttagggttgtcatgaggagtcagaatccagttgggcagggctccctgcaaaacgagccattcacaaaggctcattcctgcaaactccaagatttgcctgtcatttcctgaagccccgccctcgtgccaggctttagataaattaatcagacctcactcctgcctcaagggcatctgggctggctggagcaatcctcgtcatcagtttcatcttgccagtaactggatgaggctagtgtccttaggatcaccccatttcccagatgacgacactggggctctgagggaccaaggccgcctgggcttccttacttggccagtgagggcaaagagatggctgcctcagcctcctcggggcagggagtttgtggacgcacaactgctgtgggcccaaacttgattctgggcccaagaggttccagtcacacagattcattcagcagacattcactgaacactgagctgtgccaggcctgggctgacagattcacagttgagctggggacacagatattactcagataagactatgattgtaaactgtgataaatacaacagagaaaaacaccctgggaagatagaattgagaggcttcccaaggaggcaatattggacccaagatggacaggcgttaagtgctgtgcagggggcaggcaggggaacagagaggacagtatggagaaagacccgaggcttgaggaaacactgagttacagtgcagagggagctcagccagggccaggaggaagaggaagaggaaacagggcaggcagtttaagagaggaggatggtagctgggtacagcggctcacacctgtaatcctggcactttgggaggccaaggtgggaggaccccttgagtccaggagtttgaggccagcgtgggcaacatagcgagaccccgtctctaccaaaaacacaaacattagccgggcatggtggggtgtacctgtagtcccagctacttgggaggctgaggtgggaggatcaattgagcccaggaggttgaggctgcagtgagctgtgatcgcaccactctactccagcctgggcaacaatgagactttgtctcaaaaagagagagagagaggaggatggtacctggcttgggaggccatgtgcaggattgggggctttatcctgaaagcaagggagggggtgttgaagggttggaagtgtgtgaacagatttgtgtgctaaaaagatcctgtggctgctatgtggacaacaaatcaaagagaacaaaatcagaaatatataaagatctgtcatagtcacccaggtaatgatgctaccgcctggaccagggaggaggcagtggaggtggggagaagggccaggttccagaggcctttagtaggcatagtgggcaggactaggggatggattgcatgggagttggggggtggggaggtggccaggatgacatcctgggttccagcttgagcaaatggggagaggtttgttctcaacacacacacagagaccaagacacgcacaagcatgtatatccattcatacataaacaaacacgcccacacaagctcacaggccaagagaaacagagacacagatacattcacaggcatacaaacattcataccttcaaatgtaccagtgccgacggacacaggccaggacacacgccagccatgacacatacctgcagaggtacatatgtacacgtgaaccccagacacactcacacccgaccagaaagcatatactttgaagcacagacagagggagcagcacacagaaacacagcagagatcagcagctctgccctggagctgccccctgctggccgtgtgaccccgggggttatgtcacctttctgtgcctcaattttgtcatctgccaaaagggatgataatggtctctccctcataggttgtggggcaggcgacatgagtcacttcacataaaacacataaagaaatctcatcacctcctttgagaatgaaaaaaaaaaaaaaaagaaaagaaatcccagcactttgggagaccaaggcaggaggattgcttgagcacaggagttcgagaccagtctaggcaacacagctagactcgatccctatttttaaattaaacacacacacgcacagagaaagagaccaggcacgcagaggctgttggtgcaacgtttgctcttttatgcacacactctcggggatccagccactcattgtccccacctgcatctgattccaggcttcctggcttcagaagcctttgcttcctcccaggccccacacctggcccttcctccatcccccatccacccccaccccacttccttccccaccgccctccttacccctgctcagtccccaggagtcggattcagctgtccagaaactcttcagggcaaagaaaggtccagtgcccagtcagtgggacaccacccaaagccaaatcccctctgccctacctctcccctagtccttacccacggccccagtgggcctacccctgccccagtgccctctgccagggattcctggcgagttgctggcaacctcagcatcccttcctgccagctccacccagcccagtcctcggggagccgcctggaacaggacaaagggcagagctctggagtccctagggcctgggtccagccccttccccactcctttgtgcagtcacttgttttgttggaaatgtcccctctcctcatctttttatttattttattttaatttttttgagacagagtttctgtcttgttgccgaggctggagtgcaatggtgtgatcttggctcaccgcaacctctgcctcccaggttcaagcgattctcctgcctcagcctcccgagtagctgggactacaggcacgcgccaccatgcccggctaattttgtatttttagtagagacagggtttctccatgttggccaggctggtctcgaactcccgatctcaggtgatccaccggcctcagcctcccaaagtggtgggattacaggtgtgagccacggcgcccggcccccactcctcatcttaaaagatccctaccggcatggatgctaccactttaccaaggggcggcagtgcaccaggcactgtccaaaggctgaataaaaaaggcaaaagtccctgccctcagggagtttacaatctagtgagggaatcagagagcaaacaatataaattcaggcatgtctcagagatatttggggttcaattccagaccacttgataaagtgagtcacacaaatttgttggtttcccagtgcatagaaaagttatgtttacactatcctgtagtctattaaagtgtacaacagcatatgtctaaaaataccatgtacatattttaatttttttttttctgtagagacggaatctcactatgttgcccaggctagtctcgaactcctagcctcaagtgagcctcctgctttgacctcccaaagtgccaggattacaagcatgagctaccacgcctggccccatactatgctaatgatcatctgagccttcagcaaatcctcatctttttgctggtggagggtcttgccccagtggtggtggctgctgactcacgagggtggtggttgtagaaagtggctgtggcagtttcttaaaataaggtaacaatgaacttttctgcttcgattcactcacaaaactgttctctgtaacatgtgatgctgtttgatagcatttggtccacagtagaactttcaaaattggggtcaggccaggcacggtggctcacacctataatcccagcactttgggaggccgaggtgggcaaatcacccaaggtcaggagtttgaggccagcctggccaacatggtaaaaccccgtctctactaaaaatactaaaattaaccaggcgcggtggcaggcacctgtagtcccagctactcaggaggctgaggtaggagaatcacttgaacctgggaggcggaggttgcggtgagctgagatcgcaccattgcactccagcctgggcaacaagagcgaaacttgtctcaaaaaaaaaaaaaaatgggggtcagtcctgtcaaagcctgctggtgctctatcagccaagtctatgtcatagtctaaatcctttgttgccattgttcctgctatcaaatgtatttctgtttttttatttttttatttattttttgtagagggggagggtctcactatgttacccaggttgatctcaaactggcctcaagctatcttcctgccttggcctcccaaagtgctgcgattataagtatgagccactgcacccagcctacaaaatgtatttctaaatgtatttctattttttattatttaataagacttagagctgggcatggtggcacatgcctgtaatcccagctattcaagaggctgaggcaggatgatcacttgaggtccagtgttcaagaccaggctaggcaacacagccctgtctcttaaaaaacacaaaaaattagccagatgcagtgactctcccagctactcaagaggccaaggcaggaggatctcttgaggcctggaattcaaaaccagcctaggcaatatagcaagactctgtctctaaaaacctggaaaaaaaaaaatgaaccaggcatagtggtgcccatctgtagtccccactactcaggaggctgaagtaggaggatcacttgagcccagaagttcaaggctgcagtgaggtatgatcgtgccactacactccagcccaggtgacacagcaagaatccatctctaaaactaaaaattttaaaaataagaataacaaataataagacttaaaagttgaaattggccgggcgcagtggctcacgcctgtaatcccagcattttgggaggccgaggcaggcgaatcacgaggtcaggagatcgagaccatcctagctaacatggtgaaaccccgtctctactaaaaatacaaaaaattagccaggtgtggtggcgggcgcctgtcgtcccagctactcaggaggctgaggcaggagaatggcgtgaacccgggaggcggagcttgcagtgagctgagattgcgccactgcactccaacctgggcgacagagcgagactccgtctcaaaaaaatataataataataacaaataacaagacttaaaagtcgaaattactccttggctggtgggctgcagaacagatcatgtgttagcgggcatgaaaacacattaatctactccaccagggccctttggtaaccacatgcattgtcattgagaaatattttgttgttttctgtgcagtccgtctcaacagtgggcttgaaatattcagtaaaccatgctgtaaacagacgtgctgtcatccaggctttgttccatttaagagcataggcagagtacatttggcgtaatcctgagggccctagaatttctggaatgataaatgaacaccggcttcaactgagtcaccagctgcattagcccctaacaagggggtcagcctggccttgaagctttggcgcccaggcactgacctcccctccagctaggaaagtcctggatggcatcttcttccaatacctggtggttttatctacactgaaaatatgttgcttaatgtagccgtcttcatcaatgatcttagctagatcttctgcataacttgctgcggctcctccagcagcacttgctacatcaccttgcacttttttttttgagacaaagtttcactcttgttgctcaggctggagtgcaatggcacgatctcggctcactgcaaccaccgcctcccaggttcaagtgattctcctgcctcagcctcccaagtagctgggattacaggcatgcgccaccacgcccggcttcttttttgtattttaagttgagatggggtttctccatgttggtcaggctggtttcaaactcccgacctcaggtgatccacctgcctcagcctcccaaagtgctgggattacaatcgtgagccacgatgcccggccgtcaccctgcacttttatgttacagagatgccttctttccttaaatctcatgaatccacctctgctagcttccaaccttttttctgcagcttcctcacctctctcacccttcaaagaattgaagagggatagggcttcgcttgggattaggctttggcttaaggaaatgtggctggtttgaccttctatccagaccgttcagactttctccatatccacaataagcctagttcactttttttttttttttccagacggagtctcactctgtcacccaggctggagtgcagtggcgcgatctcggctcactacaagctccgcttcccaggttcacgccattctcctgcctcagcctccctagtagctgggactacaggcacccaccaccacgcccggctgattttttgtatttttagtagagctggggtttcaccgtgttagccaggatggtcccgatctcctgacttcgtgatccgcccgcctcggcctcccaaagtgctgggattacaggcatgagccaccatgcccagctaagactggttcactttcttatcattcatgtgttcactggagtagcacttttaattactttcatgaatttttcctttgcattcacaacttagctaactggcagaagaggcctagtttttagcccgtttcagcactggacatgccttcctcactaagcttaatcacttctggcttttgatttaaaatgagagacataagactcttctttcacttgaacactttgaggtcattgtagggttgttaattggcctgatttctattttattttattctatttttcatctcatttcatttatttgagacagactctcgctctattttccaggctggagtacaatggtgtgatcttggctcactacaacctccacctcccgggttcaagcgattctcctgcctcagcctcccgagtagctgggattacaggcacacaccaccatgcccagctaatttttgtatttttagtagagatggggtttcagcatgttggccaggctggtctcaacctcctgacctcaagtgatccacctgcctcagcctcccaaagtgctgggattacaggcattagccaccgtgcccggcctcaatattgtatgtcttagggaatatggaggctcgagaagagagatgggggaaatggctggtcagtggagcagtcagaacacacacagcattaatcggtaaagttcgccctcttacgtggacatggttggtggtgcccccactcacaatagtaacaccagagatcattgatcacagatcatcataacaaatataataataatgaaaaagtgtgaaacactgtgaaaattaccagaatgtgacacagagacacaaagtgagcaactgctgtcagaaaaatggtgccaacagactggtttgacgcagggttgccacaaaccttcaatttgtaaaaaatgcagtatgtgcgaggcacagtgaagcaaggtattcctgtagtaaactgtatagtatgctagatggtgacaagtgccgcagagaaaaatcacccaatacaccatctcaggaaggccaagtgagcccacaaagcaaaccacatgcagaacatgccggccatggccccacttataaattatgtctcccaccctgagccagcagaacagccaagtgcagtttccagatgaggaaaacagactcatccagggtcgccagcaagggcttgggccatctttctttccttttcttttcttctttcctttctttctttccttcctttcctttctttctttcctttcttttctgacagagtctcgctttatcgccaggctggagtacagtggcgtgatctcagctcactgcaacctctgcctcctgggttcaagtgattctcctgtctcagcctcccaatagtggggactacaggcatccaccaccataccgctaatttttgtatttttagtagagacggggtttcagcatgttggccaggatggtctcgatctcctgacctcgtggcccacccacgtcggcctcccaacgtgctggcattataggcatgagccactgtgcctagcccacatcgtcccattttcacagctgcaagcctaacactgcctcctgaggcctctgtctatccatctgtctgccagccctggggaggggccgtcctctcctgagctaactagcccctctgccctcgctctgcttcttcatgccttccttcctgcttcatatatccactgagcacctgctatgtgccaggtcccatgataggccccagggccacctgggggatgacagtccgggacagaagattcacttccagccaagcaaatgaccctgaggcctcagagcccctcagtcacacaggcccctttcaaggccctaatcttttttgttttgttttaagacagagtctcgctctgtcacccaggctggagtgcagtggcacgatcttggctcagtgcaagctccgcgtcccaggttcacaccattctcctgcctccgcctcccgagtagctgggactacaggtgcccaccaccatgcccggctaatttttttgtatttttagtagagacggggtttcaccgtgttagccaggatggtcttgatctgctgacctcatgatccgcccgcctcggcctcccaaaatgctgggattacaggcgtgagccaccacgcctggcccaaggccctaatcttgtatttgtaattctgtatttcttcttcctaaagggccacaccccggtaccttataagtttcatggctccataaaacctagtcctgtcctgggggagatgaacaaacacgtaaacaaattataaagtgtcaaatggcaggatggaacagaactaaatatcatggcagaaaataacgggggcgtgcatatcttagctggggagaagcaactggggagtacctcttggaagtgacaagctgaggccagacaaggaatctgtggaatgacacgggtgaatgacatgggtgaggaatctctctctctgagcctctgtttccctgtgtgaggtggggatgccagtcacagcagggtgggctgagaggggtaagtggcaggtccaggttacccagtgtggtcacaccacccagtaggaccgacaggcagctcaggcccctagctgagcctggcactgcccttaatcggcttttgtccttccaggagggacaggcagggctggctacctcctctctccccccaacagctggggctggctgtgccagggccagactaggaggcgggagctgagatcactgggcctttggctccctgagtcctctctggggacagagagggcagcctggctgggtgagaggggacggtttgttcaggactggggctaggactcctgggtcctaaaggatgaaggggctgggggcctggactcctgggtctgagggaggaggggctgtgggtgtggactcctgggttctaaggcagaggagcctgtaacaggactaccagttgagctgagtctgggagcaggtggggggcagagcagggagctgagccctctactctgtttacagcacgtggtcctcactgatctttctgggtgggaggtggcttgtgcggctacaccctgggcaggccagccccgcccccgggtttattgccccaggctgctactggcacaagccacagaccagcagtcccagcccagggaagctcggaagatgcctaggaggggtgagtgtccagccagctgagagacgggaatggccgctgccaggccccaggacctagaagggaaaggaaataccttcttctaggggaacaggcaaggtgctgggctttgggagggaagtcactggagcagatggtagcattccaccaagggcagcttgttcaggacctgggtgacagggcatccaagaaacagggcagcctgaatggctgggaaaggatatcagaggaaagatcactggggactggaaagtgtggagatcagacgtagtccagggcaagttttgagatgtggcttccagagtcctagcggggagccccacataagtgtggctgtggacccagagagctgggtttacaaaagctctgccacttgcagtgcaactttaacctcctcacttaaaacctgagcctcagtttcctctcctgtaaaatggggatgctggcaataatagagatttgaacctaggtggtgtgggtcccagagggttagcacgctaaagcagcaaacacacagaaagctctcagcacgggacctgcacggatatgctcaaggtcgacaccagtgatgagtatcgctgttccaggcaggggagcagggccggccatgcaacccaggaccagtggacaagcctgaaggccaggggaccccactgggggagaagcaagactgagttttggggatctcacagagaaacagggagggaactgggatttggagggggttccacagccagacttgaaggatgaggaatgactcttcagtgaagtctagaattgtgaactcctgagttcagggagagctgcgcttggggaccagggtcccgagagatgggaatgggagggctggggctgaactctcccaaatgttgttggaggggaagggcctatgggtagcacttggggcctaagaaggaaagatgggatgggggacccggactcctgggtcctgagaatggggaccaactggaggtttagacttcttggaatctaggagaaggagtcttgggccccaggagaattcatggagacaggtgactagactcttgggttcctggaaggaagaaagaaggaccggcagcctcctggatcacaggagaggtgaatgagttagggaagcagagtcgtgtgggctcagggaatgtccggattcaggaggccagggcagcaagtttctgagtcccaaagaggtgatagcaggggctcctgggtcctgaagaggaagggcttggggcttggactcctgggtctgagggaggagggagctgagggcccaaactcctggctcccgaggagggacaaaggcactgggaactggggccccaaacttctgattcccagagacaagagggtgacctcttatgtctaagggaggaggaacctggggtcctgggcccctggaactgaaagaagacagcactgaggtttgaaggaggagtgggtaagctatggcccagactcctgggccccagctaagcaaggcttgatccagccccacctaacaggcctccccacctgcccacagcctcaaggctcatccacaacatggacctgcgcacaatgacacagtcgctggtgactctggcggaggacaacatagccttcttctcgagccagggtcctggggaaacggcccagcggctgtcaggcgtttttgccggtgtacgggagcaggcgctggggctggagccggccctgggccgcctgctgggtgtggcgcacctctttgacctggacccagagacaccggccaacgggtaccgcagcctagtgcacacagcccgctgctgcctggcgcacctcctgcacaaatcccgctatgtggcctccaaccgccgcagcatcttcttccgcaccagccacaacctggccgagctggaggcctacctggctgccctcacccagctccgcgctctggtctactacgcccagcgcctgctggttaccaatcggccgggggtactcttctttgagggcgacgaggggctcaccgccgacttcctccgggagtatgtcacgctgcataagggatgcttctatggccgctgcctgggcttccaggtgagccccctgccccgtgcccctctgggcccacaatgaaggcacctggtggcccctggcctggcctatagtatggtaaagtaaccagtggtcagcattatcggactcagcaaacagcaggtacagaaaggagaagttggctggagctcagacagagctgcaccaggggtctcaaactcatggtccctaggtcatatctgctaggtggtaagaaatgcaacttgcagagcttttttcaccaggatatccactactctctattgtcctacatgcaagagatgtattcactctttgttacctgtctggcccctgaagtcacttgagtttgagacccctcagggagggatctggagccatgtgaccctatagtcattctggccctctctgggcctccccgcacctcagcctccccctcccaccccacatctccaggcttcccttcaggctagcctatcctcagcaacccagcccaggcattcctggaaacctcccctcaccagggctgaacccacaagtattgatcagcccagctgggccagccagctcctccctgtgtcccagccgtgaccctagagtcatgagaaagagatcccggggctgcccaaaccagcatcccagccacaatagccaggcatcaggtgccctctggcctactgggcgcacagccaggggcagggcccagctctgccttggtgcagggcagtctcccctttaaaatgtccgtccccgggagggcagaggcctcccctgtcttggtcactgctccagcccagtgtctagcatgcagtaggaacttggccagtacagagtgaacagaagaacccgccaatcccttgccttggcctcctatggctccatttcctctaatcctgtgtccccattgtatttttttttttttttttttttgtattttgtttagtagagatggggtttcaccatgttggccaggctggtctcaaactcctgacctcaagtgatccacccaccttggcctcccaaagtactgggtttacaggcatgagccactgcacctggaccccactgtctttccttaactgcctgtctgctctgtcagacgctgtctctccctgcccccgtggtggccggctggtcctatgtctaggcctcagtctccctctctgactgtctttctgcctcaggtccctgtgcctggggggctgtctctggccatctccctgttcctgtcttccagctgcctcctctccccatccatcctctctctgactttcaggaagtccctgcaccatcctactccccacctcacagcctaccagtggcaccaccccgcactgggaatgaaatccaaattcctctgcccaggccctatatgagccccctttgcctctccaatgtcaccacctgcccctctccccactgctcactctgctccagccacactggccccctgactgtcgctacccaggtcaagcaccaagcatgagctcacctttttttttttttagagacagagtctcgctctgtcgcccaggctggagtgcagtggtgtgatctccactcactgcaacctctgcctcctgggttcaagcgattctcctgcctcagcctcctatgagctcacctttaagccttcatgctctctgttccctgtgcagggaacaccctcccctcgcttcagtcagatctctcctccgagacccgctaagtagcctgacccctagtcatcactggtgccctctccacctactgcctttttttttttccaaaccattcgtcattccttgtcatgatactgcgcgtggctttgcttatctgctgatcatttgttttccctttgagaacatcaggtccgtgaaccagccgagagctatgcccagcacacagtaggagctcatgaaacgtttactgaatgaatgtgtcttccccgcacatccctgtgcctcgctcctgccctgtccccatccctctcttgagcggtgggtgacgcagccgcgtctctccacagttcacgcctgccatccggccattcctgcagaccatctccattgggctggtgtccttcggggagcactacaaacgcaacgagacaggcctcagtgagtcccagccaggttctactcgcagcctactctcttggccctcctccccactcctgcccaagcagcctgacccactggggctccctgacaccccttctgacccctaggtgtggccgccagctctctcttcaccagcggccgctttgccatcgaccccgagctgcgtggggctgagtttgagcggatcacacagaacctggacgtgcacttctggaaagccttctggaacatcaccgagatggaagtgctatcggtgagggcctgttgcagatggggacactgaggcccagagactcatctgaggccacagtaggtctctgtggggctccaggcccagggatggcacacaaggggaaagactggggatcagagggagaggtgaagggcacccctgcaggcagaccttccctagcaccccttctgtcccctccctccagtctctggccaacatggcatcggccaccgtgagggtaagccgcctgctcagcctgccacccgaagcctttgagatgccactgactgccgaccccacgctcacggtcaccatctcacccccactggcccacacaggccctgggcccgtcctcgtcaggctcatctcctatgacctgcgtgaaggacaggtagggttccagcctcagccagggacagggacagagccgaggagcgtgggcagcccccaccttggcatccccatggaggggtgcagccctggccagctctccccaacctcacacaccgtctccctcctcacccccaggacagtgaggagctcagcagcctgataaagtccaacggccaacggagcctggagctgtggccgcgcccccagcaggcaccccgctcgcggtccctgatagtgcacttccacggcggtggctttgtggcccagacctccagatcccacgagccctacctcaagagctgggcccaggagctgggcgcccccatcatctccatcgactactccctggcccctgaggcccccttcccccgtgcgctggaggagtgcttcttcgcctactgctgggccatcaagcactgcgccctccttggtgagcctcaggcccccacagccacctgcgcctgctcccatcccacccagcttgctttaagctcctccagcctcagcctcacaccctctacctttctctccccccacacctcccagctcctgctcacccaggtcctgcccaatcttccacctcagccactttatcctctgtccccaactgtggcacccagactctccatctcctccacctccacttcccacccaccgtcctgtctccctgggcctctgtcgtccccctctgatagctccaggccctgctctcctgtcctaccagcctcctggcccacagtccagcttctctgacctccctcttcgaagatcaacatcttgggaggacactgaggcacagagcagagtgtggccatgccccagggcacagagcttgcagcccagcccctctgtactgaccctgaaccctgaccttccattcccgccctctgaggcccccctcctgcaacaggcctgagctcagctcccctttcccaccacctgccctccctgctcccaacctccagccccgacagactttcccagtgcttccctgggcctctccaggtcctgagtcatcctgaccctctgtctaccacatgagcccaaatctgtgcctcagtctgccagtctctaaaactgcagtctgctaggccttggagtgccccacaccccaccttggagagcccagttctcccagcttgagttcctccctgccctcctccccaggcctctgcccctgccaggttgtcaccaaccacccctctcccaaaccaggctcaacaggggaacgaatctgccttgcgggggacagtgcaggcgggaacctctgcttcaccgtggctcttcgggcagcagcctacggggtgcgggtgccagatggcatcatggcagcctacccggccacaatgctgcagcctgccgcctctccctcccgcctgctgagcctcatggaccccttgctgcccctcagtgtgctctccaagtgtgtcagcgcctatgctggtgaggcccacaccctcagcagggaaacaggactgcatggatgtctgactcctgcagggacgggctggggaccaggactcctgtgactgaggaaggagaggccaggcagaggaatctaagactccttgtcccttttttttcgtgtgtgtgtgtgtgtgtgtgtgtgtgtgtgtgtgtgtgtgtgagagagagagagagacagacagacacaaggtgtcatgtcgctcaggctgagtgcagtggctcaaacacacctcactgcagccttgacctcccaggctgaagcaatcatcctgcctcagcttcccaagtagctggaactacaggcgtgcaccaccactaccacgcccagctaatttttgtgtttttcgctatgttgcccaggctggtcttgaactcctgggctcaagccatcctctcgccttggcctcccaaagtactgggactacaggcgtgagccactgcgcccagcctccttatcccttttgaagcgattggatattctcgggtccctgggaccacagatgcctgaagttctgggcgttaaaactgggcccagaaaggggaaaacaactcagctacccacatatattctgcaggtgcaaagacggaggaccactccaactcagaccagaaagccctcggcatgatggggctggtgcggcgggacacagccctgctcctccgagacttccgcctgggtgcctcctcatggctcaactccttcctggagttaagtgggcgcaagtcccagaagatgtcggagcccatagcaggtgagtgattcactcccgtcacatgcccagccagggtgggcaggagggacagcctagcacagcaaaagtcccagggaagatgctgggcatggtggttcagacctgcaatcccagcactttgggaggctgaggtgggcagatcacttgaggtcaggggttcaagatcagcctggtcaacatgacgaaaccctgtctctagtaaaagtacaaaaatattagccaggtgtggtggtgcacacctgtaatcccagcactttgggaggccaaggtgggcagatcacttgaggtcaggagttcgagaccagcctggccaatatggcaaaaccccttctctacaaaaaaataaattagcagggtatggtggagtacacctgtagtcccagctaccagagaggctgaagcatgagaaccgcttgaacctgggtagcagaggttgcagtgagccaagactgagcctctgtactccagcctgggtgacacagcgataccttgtctcaaaaaaaaaaatttaaaaaaagagtacgcttactgggctgtggtgaggtctgcctccaaccatttggccagtacaatatatggcacccagtaggtgctattagaagatgccagcacccctggtgtgtccattctgttccagtgaccctctgggccacaaagtacttaagtagttattctcacattgttttgcacctcaccttcgtagatttataaagacaagtaaggctgggtgtggtggcttacgcccataatcccaacactttgggaagccaaggcaggcggatcacttgaggtcaggagttcaagaccagcttggccaacatagtgaaaccccatctctattaaaaatacaaaaatgggccaggcgcaatggctcatacctgtaatcccagcactttgggaggccgaggcgggcagatcacgaggtcaggagtttgagaccagcctgaccaacatggtgaaaccccatccctactaaaaatacaaaaattagccgggcatggtggcatgcatctgtaatcccagctactcaggaggctgaggcaggagaatcacttgaacccaagagacgaggttgcagtgagccgagatcacgccactgcactcaagcctgggtaacagagtgagactgtctcaaaaaaaaaaaaaatacaaaaagtagctggacatggtggcatgcctgtaatcccagctactcaggaggctgtggcgggagaattgcttgaacccgggaggcagaggttacagtgagccgagatcgcaccactgcactccagcctgggcaacagagcaagactccatctcaaaaaaaaaaaaaaaaagtaaaaaactaaaactgtagcatcttggccctcatggtaggcagtgtgggtctgataaaatgaacagagctgaggccaagctgggcacgccaggtgggctggaagtgtatctttagcatcgtttgggcacttgcttgcctggtcacgtgaacggataaaactgaagaacacaaaggaaatgtggggaagcagatccatgtggctacaggtgccagacccctagaaatgtgatacaccctggagacttgttagctccctgtgaacagagcctcccttcaagccactgggcctgcttactattcaaatcattttgatccatttacaccttgtggtaagtgtaatcccagcactatgggaggccgaggcgagcggatcacttgaggccaggaattcgagaacagcctggccaacatggcgaaaccccatctctgctaaaaaaaaaacacaaaaattagccgggcatggtggcacatgcctatagtcccagctactcaggaagctgaggcacgagaatcacttgaacctgggaggtggaggttgcagtgagccatgttcttgccactgcactccagcctgggtgacagagcgagactttgtctcaaaaaaaaaaaaacaaaaaacgatatattatgatccccagtgggtagcggtacctaatcccacatcttatcccactgagtcctgccacctatgaaccaaggactattttcatttccttgatctagaagaaaaaataggttcctagaggtaaactgcacctaatcttcccagtctcacacacacacacacacacacacacacacacacacacacacacacacacatccttcactagaacacactgccccactgccaagacccccaccatgaccacctggggcatctggaactccacccatcccctaggcaagagtctggggaaacacagcctttcacagcgctccacaggcgactgcccttcccatggcattccctgccagccacacacacaaccaaactaacggagccaggcctatctgctctccctctctcagagccgatgcgccgcagtgtgtctgaagcagcactggcccagccccagggcccactgggcacggattccctcaagaacctgaccctgagggacttgagcctgaggggaaactccgagacgtcgtcggacacccccgagatgtcgctgtcagctgagacacttagcccctccacaccctccgatgtcaacttcttattaccacctgaggatgcaggggaagaggctgaggccaaaaatgagctgagccccatggacagaggcctgggcgtccgtgccgccttccccgagggtttccacccccgacgctccagccagggtgccacacagatgcccctctactcctcacccatagtcaagaaccccttcatgtcgccgctgctggcacccgacagcatgctcaagagcctgccacctgtgcacatcgtggtgagcgacagagggggccggtacaggtgcatttagagaagagcagggcacccggggaggagggggaccgggcacgggtacacctgggaaaaagagctccggagtggggagaaagggacaggcgtgtccccaggggagaacaatgccccgaacgaacgggaggaggacaagagtcagggctgcctccgttttactttgcaattttgagtaccaagagacaggatcagtggggcagccccttgggcttggagaatcaagagaaaaaaaaggtgggtttggcggggtggggagggagaggctggagagaggccggggatcgcagttaaagtcattctcccatccttcccacaactccccccattccctccattctctccccaactcctcacccaccatgtctcctgcctccgtccactccgtctgtatccgtatttcccgctccctttgttcatcaaacccctcctcgctctacccgaccccggtctgtctgtcccccaccctctctccacgtccctccccgctgtcccgtaggcgtgcgcgctggaccccatgctggacgactcggtcatgctcgcgcggcgactgcgcaacctgggccagccggtgacgctgcgcgtggtggaggacctgccgcacggcttcctgaccctagcggcgctgtgccgcgagacgcgccaggccgcagagctgtgcgtggagcgcatccgcctcgtcctcactcctcccgccggagccgggccgagcggggagacgggggctgcgggggtagacgggggctgcggggggcgacactaaaagcctgttgttcccatctgcgccggcctccgtcatgaatgccttccgggccgggcggaaggggacgcgggctgtgccttacttaagtcgggggtggcaagggggcggggcgggggcccgaaagctgagaccctcgccacggggagggggacgcgcacacacaccggtcaccgagacggctggacctgcacgccaccgctgccttttgctgctgctgctgcggcgaccgccgcagggacggggactggccctcccttgcaggtcggtttggtttgttgtaaataaaagtatttaattagtttggcctctctcaaatacggtggggtgtttgcccaccagggggcagcatcggactcaagcggctgggaaccaagaaacctggaatgaggggtatgggggactggatttttgggaccagaagggagtggactccttggtaacccggacccacctcccctcggacttcatccaggtacactgccaggagatgctgggtcctcagctcctccccttgaagaccttcggttagctggactcaccctggtcccagggagaccaggctcagcatccatcagggggatataaaagttaaaaataatctctcgggtctcaaaggctccagtgacccaaacaccctacagaactggagcaaagttagcaggaaatcagaaacaaactggcgctcaaaatactgtaaatgcagccgggcacggaggttcacgcctgtaatcccagcactttgggaggcaagacaggaggatagcttgagtccaggggtttgagaccagcctgggcaacatagaccagtctctacaaaaacatttaaaaattagccgggcgtggtggcacactcctgcagtcctacctactcaggagggtgaggcaggaggatcacttaagcccaggagttcgaggttgcagtgagctatgatcgcaccactgcactccaacttgggcaagagtgggaccctgtttccaaaaaaacaaaaactggaaatgcaagctctgtccagctgtgacaatcaactcttggaccaactctctggccccttgtaagccctgagtttggagttgagatgatttatacccaagacatgccttcaaagggcttctgatcctggattcagagagggtggaagaacagacacaggctgtcacagtccccaggggttccacctgtggtagtcagggagggcttcacagaggtggtgatctgagcttgacactacaggatgaacaaaagtctgctaggaagaaaaaacatgccaggttgtgagagccagctggcagtgatcaaagctgccacctggctagaaaaagcttccacctgaccagaaggtcaggtgcaaagtggggaggggcgtgaggggcctggagtggtcagcaggagcagggcctgaagagcctggagtacgatttggactaaactggagggcagtggggagccacaggagcactttgagcaggaaagggccagggtcagctcagggcactgaaagatcctgctgggacactgggggatggacagaaaagggcaaaactggagtcctacaggccaaggaggatgcctgagctggggcaggagccgtaagggtagggagtgtaggtgtagcatcccagagccataaaaggtgggaaggacagcacctactgatgaggttacaggacagcaaggggacagagatgacacccaggtctggccatggaagcaggtggacagtgaagctgtctcttcaatgggaggaggctcaggtgtgtgtgtgacaggtgggacctgtggagggccattctggacatggtgagctggaaggtctcaggaagacaatccaggagacaacaagggtcagaagtgcagtctggggctgggtgtggtggctcacacctgtaatcccagcactttgggaggctgaggcgggtggatcacctgaggtcaggagttcaagactagcccagccaacatggtgaaacactgtctctactaaaaatacaaaaattagccaggtgtggtggtgcacgcctgtaatcccaactaactgagaggctgaggcaagagaatcgcttgaacctggaaggcagaagttgcagtcggccgagactgcaccactgcactccagtctgggcaatagaatgagactctgcctcaaaaaaaaaaaaaaatgcagtctaggtggaaccaagggactagaacctttccaggaagcctgggcaggtgggacaagcaacaagagggccaggacagagacagccctgaggatcacacccctagtaaaggggtgggcgggggtgggcagtggaagg

SEQ ID NO: 12482 - DNA, 9300 bp, Human
gatgggccaagggagctgataaaaataaaaaataaaacctctagaaacccacccctttcctgattacttactgatgaatatgatcctgtcttttaataaaacagggacttaaggaaacatgctgtgaaaagaagctatttcggtctggagtccctactttttataagcagtagtttcttctcacccatagcaagcgttgcacattcagtcacttgtacctgtggccccagcgctgttgttagttctgcaatctcttcttcactttatcttgtagtattctgaacttttttaacctgaattacccccaaagcactacccaaaataaagggacattttaacaggagtacaccagacagcaagaagtctgtgtagagttcttgtttgcataaacatgtttaatgatatagaaaatctattccaaatcaatcattaaaatctaaagcgaaaaatatattacattttaaatgaagggaaaacatctgattttattcaaggttgtggtgactctgttccgcaacttttaaatcaatttaaagttaattcagatgccttttcaatcattgcagttacacatagggaatactgaaccgaaagatgacaaggcaattgtctgtgtccaaacttaagaaaaactatatttccctggacttttcatcccaacagatttcaaattctcctttccaaggagtatttgaccttcacatttcaggccctgtatctcttcatttcctataccaccatatgttagaaaactcaaactgggctacaagtatatatttctgttaactgactttaatgaattttggttgttttcaaaatctgcgatctgtccattgtgccaaccctgcattgcagggaagtcttagcctgtgattccagcttcgctcctgcaaagatagtcactacaggcaggtttaaattgtatttactcggagagaagagggggaagggaaccccctgccccctgccaacctgacaggccaggctgggtgacaagccccccgggtggctgcacctcccactcgccgacctgggcgctgtccttggtgctgccggcgccatagcgagcacaagcgccttaccttctgcccctgcggaagctgcggacgtcccccaaacgttaaaaacgccatatcccactttttatacaaataactaccccggcctgttctctttgtccccttcccgaagccttcaggcagaccgttccgcaaagtctttttttttgttttgttttgtcttctagacccagctcctcggcgctcatctccagctgctttaagacaaggggtgggggaaggggagggaggcaagaaaagatgagggtgggggaggggaaaagagggaatgcaaggggaaggagggaggagacggggagaaggaaagattggaagaaaaggatctccgaggaaggggctgagagaagggcagggtgaactggactaaaggccagagtaggaaggagaagaggggccaaaaaagaaggggatgaaattaagcacagaagatgggtaaagaaaaaagtatcagggaaagggcaaaataagagaaagccttgaggataagagggtagaaggctaaagaacaaggggaccacggggtcggggaagcgctgcctgaacggcgggacagtgacaaagaaagggcgctggcgatattcgcaccaagggtgcgaaacgcaatcgggaggtgagaaatggaaagaaggcgaatgcccggctacaagtagcctgggactgaaaggggacctgggggaggggctgggcccagggcagaaaagtccaggttcccatgcggcctgggcccacgtggagcgggcgctgaatcaccgttcagccgcccccctcccctcctccccgaccggtgcccgcagtccccgcctcctcggccgccgcctccacggggcggggccctggcccgggaccagcgccgcggctataaatgggctgcggcgaggccggcagaacgctgtgacagccacacgccccaaggcctccaagatgagctacacgttggactcgctgggcaacccgtccgcctaccggcgggtaaccgagacccgctcgagcttcagccgcgtcagcggctccccgtccagtggcttccgctcgcagtcgtggtcccgcggctcgcccagcaccgtgtcctcctcctataagcgcagcatgctcgccccgcgcctcgcttacagctcggccatgctcagctccgccgagagcagccttgacttcagccagtcctcgtccctgctcaacggcggctccggacccggcggcgactacaagctgtcccgctccaacgagaaggagcagctgcaggggctgaacgaccgctttgccggctacatagagaaggtgcactacctggagcagcagaataaggagattgaggcggagatccaggcgctgcggcagaagcaggcctcgcacgcccagctgggcgacgcgtacgaccaggagatccgcgagctgcgcgccaccctggagatggtgaaccacgagaaggctcaggtgcagctggactcggaccacctggaggaagacatccaccggctcaaggagcgctttgaggaggaggcgcggttgcgcgacgacactgaggcggccatccgcgcgctgcgcaaagacatcgaggaggcgtcgctggtcaaggtggagctggacaagaaggtgcagtcgctgcaggatgaggtggccttcctgcggagcaaccacgaggaggaggtggccgaccttctggcccagatccaggcatcgcacatcacggtggagcgcaaagactacctgaagacagacatctcgacggcgctgaaggaaatccgctcccagctcgaaagccactcagaccagaatatgcaccaggccgaagagtggttcaaatgccgctacgccaagctcaccgaggcggccgagcagaacaaggaggccatccgctccgccaaggaagagatcgccgagtaccggcgccagctgcagtccaagagcatcgagctagagtcggtgcgcggcaccaaggagtccctggagcggcagctcagcgacatcgaggagcgccacaaccacgacctcagcagctaccaggtaggaaccgcggctgcgcggccagcctgcgccagcgccagcgccgcgcgcccccgacacttgggctcgtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttaggatagcttatgcagaaacgcgtgtattctctacttttccggcagtgatcggaagagctctcaaaattggcttcagcccaaagggctcagatgggaatggccaggtcagccatggagtttccccatgcatgtttgtgtcctgttgagacgtgttctaagtccactggtctccgtgcgtgatgtgcccaggaagtgtcctattgtcttactgatcttgtatgttcatttgagaatcgcttagatttaaaagaaaaagggggtgggacggggggctgggagtcaggtgtcagcgaggtttgcagaagtggagggagacgggaggaggccagggggaaggggtagcaagtggtttgcgaaggaagttgctgtttgcaaggatgagtctggggagattctctgtgtctgtttcaggacaccatccagcagctggaaaatgagcttcggggcacaaagtgggaaatggctcgtcatttgcgcgaataccaggacctcctcaacgtcaagatggctctggatatagaaatcgctgcgtacaggtacgatgcttactacgtgcgtggccggaacactaaccgcagtgcagaggctgttccggcagagcttccaccacttaagttaaagcaggcagggtgcaggcatcaactcagcacctggttatcttgcttacttaaaaagaaattattctaaagaattgcaagtgtagttttatctctttttatgcagctttaaaagaatgaatactagtagaaacaaaaggtttttgaattacacaaaggaggtgcagattaatctcaatgcacatgcttaaactttttatggaaaaatgttttcaaatgctggaagcatgaacagagttttggtttctaatatttcatctagtggtttcagcttttcaaatgtataatgtcaaggacaaacaccaggacgttctatttctctgtttctctgttatatagcttactattgccatcatctggctgagaatagatatagaatgatagaatatagatatagttcttttatatatgtagataatttatatgtattatattttatgctagactgtagtataaattatatcaatatatcatgtatgatattaatctagatctatagatacacatatgtgcatatgcatataaatctagatatatagacacaaatatatatgatcgttttatagatagtgagataggttataggtctattaactgaagtgaccttgctgttgactaagcgcaaaggacaaaatcgttgattaaaatttttctgctaccaataaggtagttataatataacgagaataaattgcatttacagagctatctctcttttcaggaaagctgaataactacattaaatagacactttatgataaaaattatcaacaaatttataactcgatacacctgaaaatctaaacgtttaagaaagtgactactctcagaaaggctgtttggctttggagtttgggggcgttttgtttatggcttcttgtttttttgtttttgtttttgttttttgctatttggccactaacaagtttttcagcatattcatgttgtacctaatggatctctactgcagggccaagacttagtagctgggtgtggttagtggactattgggcaaggttagtcattgtagggggcaactgtctggcagtccaggagaatctttctctgtcactgagtataatgtaatatgccagtaagtgatagcaggtattatagtgaattcatagaatattctacttatgtaattctatttattcaaaggtagctaccacaatacccagaatgtaatgaagctcagaaggcctagtgaaatttttactatgtcttatgttcttggattttctccttagaaaactcctggagggtgaagagactagatttagcacatttgcaggaagcatcactgggccactgtatacacaccgacccccaatcacaatatccagtaagattcagaaaaccaaggtggaagctcccaagcttaaggtccaacacaaatttgtcgaggagatcatagaggaaaccaaagtggaggatgagaagtcagaaatggaagaggccctgacagccattacagaggaattggccgtttccatgaaggaagagaagaaagaagcagcagaagaaaaggaagaggaacccgaagctgaagaagaagaagtagctgccaaaaagtctccagtgaaagcaactgcacctgaagttaaagaagaggaaggggaaaaggaggaagaagaaggccaggaagaagaggaggaagaagatgagggagctaagtcagaccaagccgaagagggaggatccgagaaggaaggctctagtgaaaaagaggaaggtgagcaggaagaaggagaaacagaagctgaagctgaaggagaggaagccgaagctaaagaggaaaagaaagtggaggaaaagagtgaggaagtggctaccaaggaggagctggtggcagatgccaaggtggaaaagccagaaaaagccaagtctcctgtgccaaaatcaccagtggaagagaaaggcaagtctcctgtgcccaagtcaccagtggaagagaaaggcaagtctcctgtgcccaagtcaccagtggaagagaaaggcaagtctcctgtgccgaaatcaccagtggaagagaaaggcaagtctcctgtgtcaaaatcaccagtggaagagaaagccaaatctcctgtgccaaaatcaccagtggaagaggcaaagtcaaaagcagaagtggggaaaggtgaacagaaagaggaagaagaaaaggaagtcaaggaagctcccaaggaagagaaggtagagaaaaaggaagagaaaccaaaggatgtgccagagaagaagaaagctgagtcccctgtaaaggaggaagctgtggcagaggtggtcaccatcaccaaatcggtaaaggtgcacttggagaaagagaccaaagaagaggggaagccactgcagcaggagaaagagaaggagaaagcgggaggagagggaggaagtgaggaggaagggagtgataaaggtgccaagggatccaggaaggaagacatagctgtcaatggggaggtagaaggaaaagaggaggtagagcaggagaccaaggaaaaaggcagtgggagggaagaggagaaaggcgttgtcaccaatggcctagacttgagcccagcagatgaaaagaaggggggtgataaaagtgaggagaaagtggtggtgaccaaaacggtagaaaaaatcaccagtgaggggggagatggtgctaccaaatacatcactaaatctgtaaccgtcactcaaaaggttgaagagcatgaagagacctttgaggagaaactagtgtctactaaaaaggtagaaaaagtcacttcacacgccatagtaaaggaagtcacccagagtgactaagatttgagtccattgcaaaaggttaagccatatgacaatttcaaaatgcatgtgattggcagcttcaaaacagaacgggttctcccatgggggctccagacattgtattttactttgtgcaatatgaggggactgcatgcaagctcagggtgctccctcctcagtctttgggggattcaaatgcatgatattgtatgtacctgggaaatttgccgatttcctaagctgttggaagggggtcacttaaggggggatgtcttgagatgtattatgcaaagtaccaactgagccaaaaacaataaacgaaacacagaactcagccttaagaaagctatatatgaataattatgtttacctcactggtgcatttaaaatggacttttgttcatgggagaacctcgttgacatgcacagtttgcaatcttatgttgatcgatgttaaacgtcacagcagtacttgctcaataaaggtcatattggaaacatagtcaattgctgagtcttatgtcatttctctttttctaatttttatttatttatttttatttagagatggggtcttgctatgtggcctcaagcagtcctcccacctcagccacccaaagtgctgggattacaggcatgagccaccacgcccagcctgttatgccatttcaaagtgaaatctccactacctgaagctttcttgccctgaaatagattattggggggaatcataagtaaactgcacatcttattgctatttccctgacagcaattacttggaaaacgtaattgctgaagatattttcaggtgtcaacatcttcaccgagcccggtcttcatcccaaaattttaaaatcatatttttgaaataaaaataaaagcatcagatacaaataggaatctggtgggatagaaatcttcagtgtttgtttctatcccaaaacagaactcagaacctctaggtaagaggaccaataaaggaggggttcataacttgtgccttggagttgggacagagacagaggagctcatggcatttatgacgatgtgtccagtggggacagggctgacatcactaacactcctacccggaactatccagcctcagaggcatgcctcctgtgcacaaacacacacatacacattgtctgcatcactaatgcttgatttgactgacagagatttacacctttagtattttactaattgtggaaaatgatataaaaaataaataaaataccctacctgagaaaagaaaaatgagattctgtgacataggcaataagtgtttttaaataaaaagacatgatcttgaccaaggaaatactatcatccccttttcaaaacttgttttaggccttgaagaccattaatatattaattagcacattatcctgtccaagtccatgttttttcattaataggatcagctcaataatacaatccttgatatattttcaatgactttttcaagataactccaattttaatgcctaaacatacccaggaagctaattgttaacggcagtttttattgtttcccaatcattagccatttgccaatcctcacaattttggctacatctgagtattatctgtacaattatgtattcagatttctttctttaaaacaatttatgttttaagttaagatgttaatttttctgaagcaaaaatatccatgacacgcaaagtgacacaggattatttaaatataatcagcaaaaaaaaaaaaaactgatctagtgatacagaattaaaaaataaaaaagagcatattggaaggacacagggtaactcctagagtgaaaacatcagcagaggagtcaggggttgggagagaggagctcggacagccccagggtcagaggtcgcaggaatcatcacgcagtcacagggcggattaaactgaaaactctgtgacacttcattggaattccaggaacagagcatcatctatttgccacacacctttgctagcaaagaggagcaccttgattgatagtctcacccaaactgactccaatgacagcactgcagctcttcacagaaaagtctgggagctgttatcagaagtaggaatggaggctggagttatgtgatacgatctatgtgaattttttaaatgcccattaaatatacaatcattactataaaaatactcatttgcacctaaaatcatctcacttaccagcactggaccctggggcttagaagactttcttttttggtagcatatattgtttaaaaatgacaggatcaatcagcaaaactctccaacgcaggcaccagaaacttaactcttcagctctaactttgttttcaaccacttcattttctttcctaagaaggtaagacattcaataatattgccacatattccataaaaaaaaatcactattttctattctttaaaaatgacagaacacctctggctgcagtggcacaggccaatagtcacagctgttccagaggctgagacatgaggatcactcaagccca

SEQ ID NO: 12483 - DNA, 6288 bp, Human
ccctgccctgccaaccacaaggccctgcacatctgagttggcctctgttcctgctcatcacctgcaaaacagccctgcctccccacagccaagttgctggagctgcgccccacctgcccccaccctgcactggcctgactcccccattccacacctggcccagcacccaccacatggtgtggcagacagcactggggcagctgaaagactccatgctacaaattggcactgcccagcttcctgcttctgggagtggggtccattggctgagcttccgctccctggaagagctccagactcctcaatggtttgggatttttcaaaccaattccaaataagccaggggagattttcctgtcttggttcccatcattaccacctccacagttggagattccctcctaatccagatgctcaaaccaggacctcaacaactagggcttcatatatcactgggacacttagcataatcaccattgcaggttgccagacatcacccaaagtgatgttctaccaaagacagaaactgcagctctcccgtgaccttccaggtgctgccctgactcctccagctgaacctgctagggcagagggaagtggaacgtgcagcatatttgccggccactctgcccatgtgcccaccaactcagctgcaggctccagggacacaggctggtgggggggcctggggctcatggctgagccaggtcgcaggacagacaagttggcctggatcaacctgaccaatctcagctggagcagtgagttcttcattgtctgaatctaaaccaggaacccagtggggcttccttagtgcctgtgtaagggctctcggctttcactgctaaggagcttgctaggggcagggtgggtgacctcagccaagggggggatttctcttcttacagaactggagttcctctttcgcaggttctgtgctcccctcaagggtcctttgagatcctccagcctgagtgctcttggggaaacatgctgtgtaaacactatgcccatttcctgcctggagcacaggttttgtggtagggctctcaggggtgaggaggaagcctggcagcccccacatctataaatgctgcgtctaccttaccctctgacttggaggcagagacccaagcagctggaggctctgtgtgtgggtgagtttagccccatcccctaggtgttctccagcttgaggatcgcaggcagagaggaccagcccagcagccacaggcctgaccaaagcccaggctgggaaggagggcaactccccattttccactgggaggtgtttcacagcacagtcaacataggtgacctgcaaagatcctcatgtttgttattttctttggccagatccatccctacagggttcagcagggcctacaggaggggcagtgagagaacagaccccaaaaagaaaggggactccatgactgaccaccttgaggggggccaggctgcgggccccgttcatcttttttcattctcaggtcgctgatttcttggagcctgaaaagaaagtaacacagcagggatgaggacagatggtgtgagtcagtgagtgagtgacctgactaatagcctgggagggacagggcaggttttctgcagagcacggaagattcagctgaagtcagagaggtgaagccagtttcccagggtaacatagtgaggcactgaaagaaaggagactgcactggagcccaggtccccgggctccccagagctccttactcttcctcctcctcagcagcctggagaccccacaacctccagccggaggcctgaagcatgaggccatgccaggtgccaggtgatgctgggaattttcccgggagcttcgggtcttcccagcactctggtctcgcccgccctgcctctcgggctctgcccagcttcctgagtcctgacagagcacagtgggggagatgttggcagaggtggcagatgggctcacggccatccctcctgcaggagcagcgactggacccagagccatgtggctgtgccctctggccctcaacctcatcttgatggcagcctctggtgctgtgtgcgaagtgaaggacgtttgtgttggaagccctggtatccccggcactcctggatcccacggcctgccaggcagggacgggagagatggtgtcaaaggagaccctggccctccaggtactgtgctgcagaccccaccctcagctgagggacacagaccccttttcaggaggcccatctgtccaggcccctaggctgtgggccatagtgagctgggggctatagtaagctgggtgggacttcagtctgcagggctggtgggttcctggggcccttatgatggcgcatcctggagagtctgtcctcatagtgcccacggagtgatagagtgatagctgagccagccctggtgataatgggcatcgagtctcactagctccaaccagttgtgggtgacagatcctacacatccatgtctcttttctctgcaggccccatgggtccacctggagaaatgccatgtcctcctggaaatgatgggctgcctggagcccctggtatccctggagagtgtggagagaagggggagcctggcgagaggggccctccaggtgagcagggtggggcaggtgggcagtggaaacatgggcacagcgaccctgaagtcagttacacggggatgatggggatcagacaaaccctacaggttccccaagggcatttggctcaacctaagtaagagaggataagcttgagggagaaagctgaggtgtctggggagtgtggtcacaattcagggaaaggcaggtgtgggaagtcctccgtgcctcatgaccaccgatggggacacactgagtcaggtgtgggatgagggacagcactgggaggcaggggaggcatgtcctgggatggaggccctgggggcagtctgaagggtgaatgcggacgaggcatccagacagacggtgtgatcaggagccccacagacagaggggaactttgaagctcagagcggtaagcaagtccatcagggcagtgcagagagcatcatgcttgcccttggtggagggtgcgggagagggacttgccccacagaggcgggcagacagaacccctcgagggacagagcaggaaagaggacaaggggtgggggtctcagcaggggcaaggcttcactaaagaataggggaccacggggtgtggagacacactggaatcttgtggaccctctgagcctagggtctgggtggcgcctaacagcaatgaaagggcagagttccaggattgcagatggcaaaacacctgcgtggcagcaagtgggagtcttcactggcctgcccctccttctgtgtggggcactctccacagggcttccagctcatctagatgaggagctccaagccacactccacgactttagacatcaaatcctgcagacaaggggaggtaaggggaccccctgggcctcacggggtaggagtttcccacaaattcccctcattctcagcaccagcttctagaacatagagattacaaataggcatgcacatgcaggtcttggggaaaggaatgacgcttgcttttctgatgtctttgaatggcccagaggagacagaagcagacacaattcactccccatttcataggaaagcaagttctccacctgccttgctttccactgaattctaggaaattgcaccatttctggcaataagtaattgttacttaggtgaatgaataaatggaggagagtctaaaagtgaatttagaaaactgcaattggaagaggaagagaagacacagagagaggcagagatggagagactggggagaatctggtagcagagaccccaggtgagggaggtggcttagagacaaagtggtcagtggcctgacccggactcctctgctctcagccctcagtctgcagggctccataatgacagtaggagagaaggtcttctccagcaatgggcagtccatcacttttgatgccattcaggaggcatgtgccagagcaggcggccgcattgctgtcccaaggaatccagaggaaaatgaggccattgcaagcttcgtgaagaagtacaacacatatgcctatgtaggcctgactgagggtcccagccctggagacttccgctactcagacgggacccctgtaaactacaccaactggtaccgaggggagcccgcaggtcggggaaaagagcagtgtgtggagatgtacacagatgggcagtggaatgacaggaactgcctgtactcccgactgaccatctgtgagttctgagaggcatttaggccatgggacagggaggacgctctctggccttcggcctccatcctgaggctccacttggtctgtgagatgctagaactccctttcaacagaattcacttgtggctattgggactggaggcacccttagccacttcattcctctgatgggccctgactcttccccataatcactgaccagccttgacactccccttgcaaactctcccagcactgcaccccaggcagccactcttagccttggccttcgacatgagatggagccctccttattccccatctggtccagttccttcacttacagatggcagcagtgaggtcttggggtagaaggaccctccaaagtcacacaaagtgcctgcctcctggtcccctcagctctgcctctgcagcccactgcctgcccagtgccatcaggatgagcagtcccggccaagcataatgacagagagaggcagacttcggggaagccctgactgtgcagagctaaggacacagtggagattctctggcactctgaggtctctgtggcaggcctggtcaggctctccatgaggttagaaggccaggtagtgttccagcagggtggtggccaagccaaccccatgattgatgtgtacgattcactcctttgagtctttgaatggcaactcagccccctgacctgaagacagccagcctaggcctctagggtgacctagagccgccttcagatgtgacccgagtaactttcaactgatgaacaaatctgcaccctacttcagatttcagtgggcattcacaccaccccccacaccactggctctgctttctcctttcattaatccattcacccagatatttcattaaaattatcacgtgccaggtcttaggatatgtcgtggggtgggcaaggtaatcagtgacagttgaagatttttttttcccagagcttatgtcttcatctgtgaaatgggaataagatacttgttgctgtcacagttattaccatccccccagctaccaaaattactaccagaactgttactatacacagaggctattgactgagcacctatcatttgccaagaaccttgacaagcacttctaatacagcatattatgtactattcaatctttacacaatgtcacgggaccagtattgtttcctcattttttataaggacactgaagcttggaggagttaaatgttttgagtattattccagagagcaagtggcagaggctggatccaaacccatcttcctggacctgaagcttatgcttccagccaccccactcctgagctgaataaagatgatttaagcttaataaatcgtgaatgtgttcacatgagtttccatagctttggttccaagaaatatcacatttctgtatttttgtaaatcaaatgaactctgactctgagcccccacttgcctgaagattggaaaattcaatctcaggatgtgctttctttgtttggtaggaggagccacctcctctcctcactatgatgctgcagagggatggggagctacagccaccatttggaagaacatacgggcttcctgagtccacatggtccatttgtgggtgggaataccatgtcttctgtcccctactcagccacctgaatgatttctgcagcccagcagtgatggtggcactcagggctcagtcccaggccttagtgagccatcctagtctcaggtctgcatggaatgggaccacactctcatgacccagggctgcgcaggaatgagacaatgtctccaattgcttgaggaggcagctacatatgtgtcccacctcccacttctccccctataacacctgtgaacactctttctcagtgcatttattgcttttcttgggcggaaggaagctcagaaaaccaatgagaataagaggaaatttttctcagtcttttatgagtgataatttttaatctgatcaccattccatatgtgcttaggacccagcacagaaattattgagccttcttcaaa

SEQ ID NO: 12484 - DNA, 21857 bp, Human
  misc_feature (1)...(21857): n = A,T,C or G
acactatatcagagtctgaagatacagttttcatttgcaacgcaagggaattcctttgaatctctaccttatgatttccctgcaaacccactccgatggggctggagagtgctctctcactcagatgaatctctcaggggttgtccagcaggtgtttgccaacttgaagagctacctactatcacagacctataaaagtacgcctgtggacagactgaaaacaaacaaacaaaacacacacacaaacacacaaaacaaccgcacactgggagaagttctaggcaatttccttgcaaataactgctttgaaaattactgttttaaattggcagaacactaaggactttgaacagatcatcccttttactcaatgttttcataaccttgaagtgaaggtggagggagcagtacgttttaaggtgccaggattacactacggggtcagtgctcccggatatgaactttctttttcagaccgaccttgggacctacagctttgtaagttactcatacaactccatcaaatgttacaggtaggtcagaggacattcaggttgtttaagcctctataaatgactcaggcagcaacaatttacaacgtctttgtttctgctatgcagtgccctcctgctagagatggcaaaaatgtggggagggcttcagagcattctaagcctggtatttctggctggaatttttaaatctcactacaatcctgacaagagaccacgaccttaatctcccacggcatgactggttagtcttgatcgtaagccatataatcaacacccaaatgtgcataacacatctaaataatgtcaaaactacactatataccacgcaggggaccagaaatcaatctttacctcaaaaggataagcttccaggatgcaataacatccccttccacccttttctacatccctaaaacagtaatattcacggtaacagcaaagcggaaatcagcttttcctgaacatgtactgaattctagtcacattcacacacgttaattcatttaattccagccacaaggtaggcagcctctgttaacattttacaattgtgagaacgcagagatctgggactggctcaaggtgacacactgcagcaaggagtcagaatttgaatccgaagcagtgtccttccccctcgcaacagctgcggcgttacaaacacaggtcagccacggagaaattaatgacccacagccatccttgcagctctgcgccataactggggagacaagctggttcccgtgactcttcagtctgttttcacccaagtgcatgactgcgggagcaaagcgaccacgtgagcatcccccccccacccccccgcttcccccaggcgagggacagtgccaggccaaggacaagtcacaggtgcaacaacgtgccagaactggatccggagccccagggcgcaagatctcccgcagcgtcacccggcagagggacgggtgtggccaccgggcgcggcaggtcctgcgtgcgctgaaagtgcggctggaggcgcggacggctttccggagccccgagagaggagctaggaatgactttggtcgcagcctctgtaaccccgcatgacggcctctagggggacagcgaggtccccctcgatctctggctgtaatcagccggcggggccagacggtgccgagactccagggcgaggccgcagggagggggctgtcccgccccacgtggaccggctccccgctgggggcgtggccgccgaagcgggccgggccaatgagcgccaccgtcgggctcacccggctgggcacgccgggccgaggagggctgcgtcatgccgggggcggggcttcggggccggcgcgaggcgcggcggggtcacgcgggtcgctgcgcgggctataagtaggggccggcggggtgctccgctggagtgatggctgccggcgctctctgcgtggttcttcttctcggccgctgaaacccccgcggctgcttcctgggaaggtcgtgagtcccgctgagctgtccccggtgccgccgacccgggccgtgtgcccgtggctccagccgctgccgcctcgatctcctcgtctcccgctccgccctcccttttccctggtgagtagtggcgccgcctcgtaaaggctctttcttctccccggggccgggcgcggacgccgtggcgctggaggcggacgccgtgggcggcgcggctggcttctctcttcgccgctggccgcctccactccgcccgtctgcccgcccgcgggcctttttggcggtccccgggcggcgcgcgcgggaacggcccttttccgattttcgcgcggagggcgcgcgcgggctggcagcgcaggggctgggctgggcgcgcgcgggccgcggaggacccggagccacgtgcctctccttctcgcgcgtcctactggggatgggggtctggagtagccggcagaggctattgcgggaccccgggcgcgtgggtagagcggggtgccccactggccccccaggggcacgcagctattgttatttcccccctcccccgcaggatgaacttgcgtcctttctcttctccgccatggaattctgctccgtgcttttagccctcctgagccaaagaaaccccagacaacagatgcccatacgcagcgtatagcagtaactccccagctcggtttctgtgccgtagtttacagtatttaattttatataatatatattatttattatagcatttttgatacctcatattctgtttacacatcttgaaaggcgctcagtagttctcttactaaacaaccactactccagagaatggcaacgctgattaccagtactacagctgctaccgccgcttctggtcctttggtggactacctatggatgctcatcctgggcttcattattgcatttgtcttggcattctccgtgggagccaatgatgtagcaaattcttttggtacagctgtgggctcaggtgtagtgaccctgaagcaagcctgcatcctagctagcatctttgaaacagtgggctctgtcttactgggggccaaagtgagcgaaaccatccggaagggcttgattgacgtggagatgtacaactcgactcaagggctgctgatggccggctcagtcagtgctatgtttggtaagttctttttatgttttgtcctcttcgtggtgggtgagcaaatttgtatcatgggtggttccatttttgtgcataacctttccgattaacctttctgaatgtgccacttacataatggaattttgatatttacttaataaaactttactatgtttcaggttctgctgtgtggcaactcgtggcttcgtttttgaagctccctatttctggaacccattgtattgttggtgcaactattggtttctccctcgtggcaaaggggcaggagggtgtcaagtggtctgaactgataaaaattggtatgtttaattccaaacggcttcttaattttcgttttcgtcatatgttaccatggcattaggtatgggaggatgtgttctaacgtcgagggacagacccaagaattttgaactcttaaacatttaaagtggtttttggtttctgattttcattatttgatattttttcttaatgtgttctattccagtgatgtcttggttcgtgtccccactgctttctggaattatgtctggaattttattcttcctggttcgtgcattcatcctccataaggtaacctttctcccccgtatgaagacctttcatggagcacacccaatcgatttcaaacccagtggtacttttgcagatgtgattggtgtataggtatgcggccttggaaaattttaaaaagctctttgttctgtgcatttcttgtatgttgtggagttctctgaaagcgagtttttaatactcaagagggcagtcaggaaggaaaaattgaatactatgatgtgccaagaagtaggagaaactgggagcaaaaaaataaggaaatttattttgcgtggttttgtgtagctgtatacacattatttgtttaaaccactgttatattcaggctaatataatacgtaaacttggagttcaagacagtgtcccctgtggcttttttaactaagctgccagttaaatgggtctctgccgtgctgattatcataaccagtttataagcttctagatgaggactctgcctcccatagtgacttgactccaatttctcagaatagttgaaaagaaccagttaaaggtagtttttggcccgccccccaaaaaaacttcaggcagccatttaatttcctgtccatttgaaaatcccttttaagtgacccagtttgcatttcttttatcaagaagtcttgctggctgcaaaataaatgttgacaagggattatgttggcataggactgagttacagtgaggataaatgcatttttctcaggaaacaaagttgtcctttttctaaggtgaatggctcttaacaatccattgtaagttcttaaaagtgttcctaaactgtagaaatctgagggagatagcataaatcccagcaggtaagaatgtattcagacccacttgtctggtctagttgtaagcttctctagggaaagatttgtctcttctctgtagaaattctatgactagtaaagtgattcactaatcactgttttccatagccagaatctggcagaatatagcagtttaacactttgaaaacttgaaatatctttagcctggtataatatgagagtaaacagttcattgatatttatggactcctaagtttggtactgttttattcagcagacaggtacgataagcatctaccttcccactccctacaactgtagtgtatgatactgggatgcttaaattagaggctcaccagtagtcatggaccagatttttttgttttttttagagttttcattagaactgtatatcttgctacttagcagagagtcagaagcattagtaggatctcctgttgtgaattcctgcttggtaaaggtttatgctggccctgtgttgattattgagtagcagatcattttgtttttggagagggtttgtgtgtttcacctccacaaaacacttattccccggaaggggaatggtggtgctctgaggtgcaaagagggattctcaggtgcccagaacctctcatttgaggaatgcatacccccacggtgttattgagggctgaagttagatacggtaactgatttcttaattgtatatttcctatatgggtatgggaatgggcatgatcaaatgatgaagaatgattggcatagtgtttaaaacaatattgactttgaggatcttcccccactctgtgcacgtgcacacacacactcttgcaggccaatccctcagtaacaggagttttcagttgagtatgaatatttctgcttccttttaggagttaaatttcaagaaaatatccttagactggtaagcttttggtatcttaactgctaaaatctgaatatttgaccattaagatatattccaactcttaaatgtctatcttgaaaattaagattaacatgacctttttttttaatttcaaaaaattgcttttaaacattttctattctctgaatgtttgttccaagcatgttggggataggtgggaacagacagaatggaggtgaggtacttctatttaggactggcatcgcacagaaggaatatgcttcagtgctcctgttgagtatttttaaattctagtcaaagaaaatagggcttttggcattctcattagttagaaatatatttaggatgtcttcccttttctttagacaaaaccagaatatccaatatgtaaaagtgaactattctggtgaagatggggggttttgtgaagacctttcctgtcccacatgactagacgatgaggcattcacattatttccaggtgaagttttacttgtgtgttaggtggatctctacaatgatgagacctttcttgttttaccttcttcctagactctctggaacttttgatttttttttaaccatgaacctgtatttcacaataaactattggtatagtagtgtcattcataccctaccccatccccaacaactttgcgtagagaatacctcagatttgtttacctcagggaatacttaattgggctatgctatacaggataataaatacacaggctgctacttcagactagtcaattacaatttgatttatggataatcatattacgaaatatctttgaaaatctattgagaagtccccacataatgtctttaaaacccaggaaatttttgggggtgggagtcttgggttgggttttttggagccttttttttttttttttgagacggagtctcactctgttgcccaggctggaatgcagtggcacgatctgggcttactgcaacctccgcctctcgggctcaagcaattctcctgcctcagcctcctgagtagctgggattacaggcgccaccacacccggctagtatttttgtatttttggtagagacggggtttcaccacgttggtcaagctggtcttgaactcctgacctcaggtgctctgtccgtcttggcctcccaaagtgctgggattacaggcttgagccactgcacctggctttttttttttcttaagcgaagtctcgcctgtcacccaggctggagtacggtgacttaattgtagctcactgcagccttgacctcccaggctcaagtgatcctcctgcctcagcctccagagtagctgggactatgggtgtgtgccaccacatctggctaactttttatattttatagaggtggagtcttgctctgttgcttaagttggtcttgaacttctgggctcaagccatcccctgcctcatcctcccaaagtgctaggattacagacagacatgagccaccaccacacctgacctgcattttcttaagactagtctttagaataaaaatacacaccttagtttcctaatcttgttgactgccctcagagtttgaccaccgttgagttagttattcaaggatgcttaacagttcttgatttctgtatgctattgtttttgttttggctatttcactatctgttaacattctctattaaactatagataagagttaaattttagagtggttttcaatgagtgctcatctctgctaatttgaaatggtacctttactttacacatgggtctgagctttcccttgtttcactggtcttaagctactaactttccagtgtattgattattgttggaagctgtagggttttactttctgtttttcctccccaagattttccactggaattgtgatcaagataacattaaaccttttaggctaaggtctttataaagtttttagccttcccatatatgtattcagatctttgctcccaatttttttttttttctgagatggagtcttactctgttgcccaggctggagtgaggtggcccagtctccactgactgcaacctctgtctcccaggttcaagtgattctcctgagtcagcctccagagtagctgggactacagatgcttgccaccacatccgggctaatttttttggtatttttagtagagacagggtttcaccgtattacccaggatggtctcgatctcctgacctcatgattgtcctgcctcggcctcccaaagtgctgggattacaggtgtgagccaccgcgcccagcctcctcccattctttcggtgtttgacttgggtgttctcctatagaattaatacatactaggtatggtagaattcttatttttagtcactggccttactgttccttaaacatttcaagtttttgccttagggcctttgcatttgctgatatctctgtctggaacattcagcgcccaaataatcaggtggtttgccccttctgtacccatagttaatgtacacagcttgctagcttactacatttatgtcatgcttattccttgaccctccccacccaaatggtgcccccccttccatcactctcctcttacccttctttatttctcttcacagcatttgtcagtactttacattattccatactagaaggtgagtgtcagttctattagaacaggaacttggtcttattccctcctatatttcggtgcccagaatagcacttggcacacagtcttttgagtgagtggatgaccttgtgcacaatcagttattatcattgaacttcggtaaagcattaattgtggcatctttgtcagatgtttagataagatggttggcgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcaatctttattcaggatgttatcagtcactggtacagttagtcttgttattaaaagaaaaaagaaaaaaaaacaggtagaagttggaattagccttcgtaggaagaattccagatgcaaatgcaggaaaaactctgttgtccttggaaactactctggagagagttattggcactataattcccaaacctaccctgttaaaagattctgtggaaatgggttaacctttataccttttaagatattgatcttaatgatgttttacaggcagatccagttcctaatggtttgcgagctttgccagttttctatgcctgcacagttggaataaacctcttttccatcatgtatactggagcaccgtgtaagtacctatcaaaatatttaaatgtgaatttaaagttgtttacaaaacttgcattaaatgcccaatttacccctttttgctttacagggctgaaatctcctagaaggtggctggcctgcgcccatttcagaaggctgcaggctagtgtacgctgagttaacctagatagtttttcaaccaaagagacctgctcagattctaaatcactacagacctttcctctttagtcttcacaggatccactgataatatgatcatctccttccctttctcctgtctatgctaaaaatgctggaattaatactgacctcaactactgaagtcattagttatatctgatcttcagtaatcagtcatttaggactggtttgctggatattctcatttttctctcccaaatggagatactattgtttctaagtactaaacttccatgaatctgcttgaatgagaagagttgggatgtttaccacctgctctaagtgcacttggaagaagaaattcatgcagctaagaggaaaaataatttgtgagaatataaaggttgaaatgttgatgactttcatgtttgggactaaggcaaggcatggattaaattatggcgctacaagtttaatttagcaacaacaaaagattggtaacttgtaactggcaggacagtacagttttggtatctagactcatttggcctgatggtctgtgactacataggcagtgacttttattctttatactgtgacccactggatgaaatacaggacacacatgtatgtatgtagagagaaagataactggaatagtgtcatgaagccacttaatgcttactatgtgctatgcacccatattttcaaattctctctttttttttttcttaacatttgttgtggcccactgaaatgatttcagttttgagtaatgggttgtgacttgctcttaaacctcactgaagtagtaagttgctgacccaaagtagagttagctaaatatttttattatttatttatttttttgagacagttttgctcttgttgcccaggctggagtgcaatggcatgatcttggctcaccacaacctctacctcccgggttcaagcaattctcctgcttcagcctcccaagtaactgggattacaggcgtgcaccaccaagcccggctgattttgtatttttagtagagacggggtttctccatgttggtcaggctggtctccaactcctgacctcaggtggtccgcctgcctcagcctcccaaagtgctgggattacagacatgatcaccgcacctcgccaatattttaattttttaccttattttagattgagggattatatgtgtattttgttagatggagctaagtatttttaatcttgctaattaattcttggaataatcaggaacgaaacagacaactttaagaaaatattgttcttacttagactatactgaactgctatgtgccggtgaagagaagtttgtatgccagatttccattgtaaacagttctttgtgataaactaaaaagtctcccatgatgctcttaacactcattctttatgtggtagaagcaaagctcagagatgagtgaaattagaatcattttaaaaacagaaacttagatattttcgttgtgtcctttatggatcatttgtaagaaaaaccagtctctttcctttttgacttggaatgtagaccaacttaaattgtgatagacagtaatttcatgtatattttagtttgtgtgaccacatgatcaaaattgaaagcagaatttaaaatgaaaagatacatagtcaccatagaattgtagtttggggccgggcgcggtggctcatgcttgtaatcccagcactttgggaggccgaggtgggtggatcatgaggtcaggagttcaagaccagcctggccaagttggtgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttggctcactgcaacctcgacctcctgggttcaagtgattctcctgcctcagcctcccaagtagctgggattatagaagcccaccaccacatccagctgatttttttaattttcagtggagacggggtttcaccatgttggccaggctggtcttgaactcgtgacctcaggtgctccacctgtctcagcctcccaaagtgctgggattacaggtgtgagccactgtgcctggccagtgctttacttctgtctttagtacaggctaatggtttggagcctactggcgtgcatatgacagtcagataatgactaatattactcattcttaaaccatgtgaacagtgttgctaggcaagtctttttttaaggtaagacttgtaagtgaaattaccactaaactttgtgtgtgagaaagacaaaactttttttttttttttttttttttttgagacaaagtctgactttgtcacccaggctggagtgcagtggcgcaatctcagctcactgcaacctccgccctgccaggttcaagtgattctcccacctcagcctcccgagtagctgggactacaggcgcccaccaccatgcccggctaatttttttttgtatttttagtagagatggggttttgccatgttgggcaggctggtctcgaactcctgacctcaagtgatctgcctgccacggcctcccaaagtgctgggattacaggcatgagccaccgtgcctggctgaaagacaaagcttttacaactattcttaaattatcaacttttgatagataatatccttgttttctgtatcttgctttgatactgctttcaaggagataatctcattaaagcattttactaaaggccagtatagtgaatgtaatcacttttacacagaattgtgtcagcatgacaaatgtgactactgagacatcattctgttaacattaaaataagtttgtaggtggtaatggaatatgtggcagttaacgatcatgagctaggagagtggaacacttgctgtctttttcatagctagtcataggtccttagcgtgtagtgatctttattatcttccaaggtgaagaaaggaaaaggctcgtatgttgagaagcataggaacttgagtcccgcaggtgttcaagtgggctaggctggtgtgggttttcagatgatcattgagtttttctcccaaatttgtataggcactagcacagtaatcctgtgcacttaaatctggcagcagctgtcaggggtgatgggctggtatggggaacccctcagtccccagaggagggtttacacaatattgcagggggctgttgccctggggttttcaagatgcaccattttatctcctagtgctgggctttgacaaacttcctctgtggggtaccatcctcatctcggtgggatgtgcagttttctgtgcccttatcgtctggttctttgtatgtcccaggatgaagagaaaaattgaacgtaagtaataactaaacagcagaaaagtttaactactaatgttgtgtttattttttatttggccacctgtaaaaatctattagaagagattggcaaaataagagattttaaagggaaatttgaggatatgggtttgttgtccaaactgtttttagaaatggacttacatgacctaagacctgttcttaaaaatggacttacatgacctaagacctagtgataaagagtattcaacctatgctgtagagacaatctggggcattgaatttttttatgttccttgatcagttgccagtgacatgatagataaatagagaaatcatagcctacatttactgagaagtagaaggataccttaatgaaaaataaggggtagatacaagatattttcgtagaggaaatatttaccccaactgcttctgtgtataacttcagattcagacaagcaaagctaagtctaatgtgtacatgttgtatataggctagaatacatgtagacattgtattgcagtatacaatgcaaatacatatacaaacacacattgtgtgtctgctagaattgtagcacagattctagaagtaaacattttcaagtgtcaaggaatcatttaggccattaccacacactcatgtaattaaatactgagtaaattttggttagtatcggacttttttttccttaaaataatcattttctgcccttttcatcgatgtgaaggctgggttagcaagttgaagtttatcgtttcgaagctgagggatgcatagactgcagtggtgttaggaagaacgctgcgtcaccgcagctgaaccgaagagcctccgagaggttctgtgctagtctggctgtgccgagtgcacggtgggaaccaggctttcaggactctctggcctcattttccctctctgggaggagttgagacaagtcttgctttatgttagtcagtctgtagtttgactgaggtgcctggatggataggtcagcatactgagcactggcatgagagaggcagaagatactctggtctgcctgtgggatttacagccatgatgcacatctctttgttttatagaggtggaaattaaagttgtcgtctttagttccctgcattgagctgtgccactttgcttgaattgttggactgaaatttgagagaatcctcttttgaaaagaatagaattgggtacagttcagatttttagtttcagcttatcagccccatggttgagctactttcccctacagaatgagtcagcagggagctaagaagggttcttatatctgtaaagggttgtaaaaataaaaacaaaacaacaatgtgctacagaagcccgtaaaacctaaaatatttacagaaaaattttgggacccctgacatagggtgttctgcattgctggttgttcccaagtgagagttgctggcaaatgataaagcaggcaggaaaaatgttcctgaatgttaattgaagttcacatacattcttgttttgagatgagttttttgggggtggaggaaaggagacgtggaacaaagtagtatggccacaaccaaaccaaaaaagaccccccttttttttcctaggagaaataaagtgtagtccttctgaaagccccttaatggaaaaaaagaatagcttgaaagaagaccatgaagaaacaaagttgtctgttggtgatattgaaaacaagcatcctgtttctgaggtagggcctgccactgtgcccctccaggctgtggtggaggagagaacagtctcattcaaacttggagatttggaggaagctccagagagagagaggcttcccagcgtggacttgaaagaggaaaccagcatagatagcaccgtgaatggtgagttggaattcctggtttcacttttgttacctgcagtggtgaggaggcttattgttttggatttgatgctttttgtattgaatgtcaccttggtgatcttgactaggtgcagtgcagttgcctaatgggaaccttgtccagttcagtcaagccgtcagcaaccaaataaactccagtggccactaccagtatcacaccgtgcataaggattccggcctgtacaaagagctactccataaattacatcttgccaaggtgggagattgcatgggagactccggtgacaaacccttaaggcgcaataatagctatacttcctataccatggcaatatgtggcatgcctctggattcattccgtgccaaagaaggtgaacagaagggcgaagaaatggagaagctgacatggcctaatgcagactccaagaagcgaattcgaatggacagttacaccagttactgcaatgctgtgtctgaccttcactcagcatctgagatagacatgagtgtcaaggcagagatgggtctaggtgacagaaaaggaagtaatggctctctagaagaatggtatgaccaggataagcctgaagtctctctcctcttccagttcctgcagatccttacagcctgctttgggtcattcgcccatggtggcaatgacgtaaggtcagttgacattgatcttagtgttgctaaccctatttttaaaccatttatccttgtcacaggcctgtgcttgtggtagtggtactcctagcatttacaggaccccaaataatacaaataggatgaggtaatagcagttattgacataataagacagtacagttttattcttcagaggaattacaaagaatgtttatttttgtagatgataaatataaacagatacacttcacagagaaggcttttgtccatcaagatgagattcagttctttggtagtgaattgtgggatgtaagatgtaagatgaaaaacttaaaagtttttcatatagaatgattttgtagtttggtttgtaaactgtttattggaacctgagagttgctttaagctgcctataggaggaaagaggccaccatttgcctggcattccctccatcagagctgtgttcatttttctgttgtgtatgttggggttccatttatgtctttagaaagaaaggcccttttgccagatgagcttgaaagctgtactttagacaacctggtagatcattcagcagattgggtcttgccaagatctagttctgcctgaaaagtcacttctgccctctttgtttcttccagcaatgccattgggcctctggttgctttatatttggtttatgacacaggagatgtttcttcaaaagtggcaacaccaatatggcttctactctatggtggtgttggtatctgtgttggtctgtgggtttggggaagaagagttatccagaccatggggaaggatctgacaccgatcacaccctctaggtaagtaggtggagcaggttctacaaatgtcagtactcatttttttcagagatataacactgtcgagtgctaacacaaatctctaaagtaaccaagtttgtataagttcatgatgttcttattgtcattgttctttttagattttacttgtctggcccttaaacattttggtcagacattttacccatttagctctggtggtctctgaagaaaatgacttttctgagaaagctgtgtatgctaagagcggatagttatgtatacttgccttttatttgtcttgggagctaagactcaatgtttaccaaactcttcaaaataaaagtgcaaattttatttaatagtgggattccagaaaaacgtaaaactggaagcctttgaataaggaaactgggcatctgtggcctgatttaaataaagtagatcttaggggttatagcaaataaagatgtcagtggaggttttgtgactgagtagaacaaagcaggactgtgttaacttgaggtgtagtgttagcttctcaaaaaagtcaaactcacttcctgacaagaatccttttgtgtctgtagtggcttcagtattgaactggcatctgccctcactgtggtgattgcatcaaatattggccttcccatcagtacaacacattgtaaagtaagtgtaatgccaatgtgtgtctttcaaatggttcttctaatatgtagggtttttagttttacttctctgatactttgatttagaaagttttgtgcagttggagtcttgaagagttcataagttatttcttgtgtttattcttatttaagcaattaaatagatattctccccaaataatagaaacattgttttatatacagcttactgtagtttctggctactaacctcttcctttgttactttatcctccctcattgtagtctctttataataattttttttttaatctcaagagtcatttctacttggcaccattatgttttatttatttatgtatgagttggagtcttgctgtgtcacctgggctggagttcagtggcacaatctcggctcattgcaacctccgcctcctgggctcaagtgattcttgtgcttcagcctctcaagtagctgggattataggcacccgccaccatgcctggctaatttttgtatttttagtagacacaggatttcaccatgttggccaagctggtcatgaactcctaacctcaggtgatccacctggctcggcctcccaaagtgctaggattacatgcgtgagccaccgcgcccggccgacagcattatgttctttgcctttggggaagccattcagagcagggtaggtgtatgcttagaaactggcaggtgctttaattctggccaggtgggtttctgctgccatttgtggtggctgaaggcctggttctaacaagtctgtgaggcttgccaaaatgttggcaaagcagtttatttacagaaggcatatttcagggcctctcaggattgaaatactgagaaacaaaacaaatcttaaggttgtttgatgacaatctaataattataggagaaggaagaaactggtttccttaagagcatttaagctggtccatcatggatcctgctgagtcatctgtttgctacccggatgtgtctccagacaattgtttattaggtttaatatcagccactctgtaaataatcttaggaagacttacaatgcaatttgttattaaaagcagtgtataggccaggtgcagtggctcatgcctgtaatcccagcactttgggaggccaaggcaggtggatcacaaggtcaggagtttgagaccagcctggccaacatagtgaaaccccatctctactaaaaatacaaaaaattagctaggcgtggtggtgggtgcctgtaatcccagcacttgggaggctgaggcaggagaatcacatgaaaccaggaggtggaggttgcagtgagccaagattgcgccactgtactccagcctgggcgacagtgcgagactccgtctcaaaaaataaataaataaaagcagtatatattcattaaattttagcagtagctgagaaggggaaaagaaatagttcttgtgtccttttactaccgttagtatagattatgattggattttcaaattgccttcattttcccagcttaacctgttgtaaaccagctttcttggactttgtcttgtccaggggtctggggctccttgtccaaacagtctcaggtgtctgtttgccagaataccactggcacttcaataacctgtttccttggtctgcttctcttctaggtgggctctgttgtgtctgttggctggctccggtccaagaaggctgttgactggcgtctctttcgtaacatttttatggcctggtttgtcacagtccccatttctggagttatcagtgctgccatcatggcaatcttcagatatgtcatcctcagaatgtgaagctgtttgagattaaaatttgtgtcaatgtttgggaccatcttaggtattcctgctcccctgaagaatgattacagtgttaacagaagactgacaagagtctttttatttgggagccagaggagggaagtgttacttgtgctataactgcttttgtgctaaatatgaattgtctcaaaattagctgtgtaaaatagcccgggttccactggctcctgctgaggtcccctttccttctgggctgtgaattcctgtacatatttctctactttttgtatcaggcttcaattccattatgttttaatgttgtctctgaagatgacttgtgatttttttttcttttttttaaaccatgaagagccgtttgacagagcatgctctgcgttgttggtttcaccagcttctgccctcacatgcacagggatttaacaacaaaaatataactacaacttcccttgtagtctcttatataagtagagtccttggtactctgccctcctgtcagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaagtgggacagccttccatgttcatttgtctacctcttaactgaataaaaaagcctacagtttttagaaaatttgttctcatggttttctttcatactcgaatcacctgggctcctgatcagttagcctaatatcattcttaggtgatgtgaatatcttaacaagtgagagctactgtccaacttaaagctcccaacccctccctgtatgcttcttgtgtgcccagaatatgcaagacattactccatagggactgtggtggcaacttggcattttcccttttagtagcacagcctgtacactttcatgttagcacacgggtgttttttttgttttgtttttccagttttttcttttgatactttttgtttttttttttgagacggagtctcgctgtgtcaccaggctggagtgcagtggtgtgatctcggctcactgcaacctccacctcctgggttcaagcaattctcctgcctcagcctcctgagtagctgggactacaggcgcccaccaccacatctggctaatttttagtagagacaagctttcagcatgttggccaggctggtctcaaactcctgacctcaagtgatccgcctgtgttggcctcccaaagtgctgggattatagccatgagccactgcgtctggcctactcatggtttttcacagccaaagatttactgttgaatggacagctttattttactattttatgtagattgtttttagctttggtattacggtaaacccttgaacagtgtggaggttggacaccaacccccatgcagtcaaaaaaccatgtataacttttgactccaaaaacttgactaccagtagcctacggttgaccagaagctttagcaataacataaacagttgtgaacacatattttatgtgttatatgtatgtattatatactgtactacgataatgtaagccagagaaaaggaaataaaaccataaggaagatacatttactattcattaagtggaaatggatcataaaggttttcatccttgtcatcttgagttgactgaggaggaaaggaggagttggtcttgctgtctcagggatggcagaggtgaaagtaagtctgtgtataagtggattctgcagttcagactagtgttcaaaggacatcagtacaaggaaagcaaaaatgagtgggaggcaatgtgtagctaagttttgtttaaaagttctcagtatgggattcttcagttctgacccattatatttttgcccctgatcagaagttaatgaaaagtacatttcttggcaaactagattgatagttcctgtcctgagggtttggaacaatacttttgaattttgagtttatttggagcgtttcactagaaaccaacactaagaatcgaacagggtaaggcagtgcctagtctaacctgtgcctgcaaggttaggccactggctgggtacatgccgttgcatcctgctgtcagtttaatggtcttgcagaagactacatttaatcctcatggccttttgtggtagatcttatcctgattttgtacatgatgaaactggcgtggagaacatctgtatttgcccagtattgtcagttagcagagggtgcccgttacttgtagcctttggggctgggtgaaactagctttatgacttgttacttgagggaagggagggtagggggctgttgtaaagggcgaccgagcattaggccttgaactgagggtctgggaggagaccctcagagttctggcactgccttcccttcgtgctgaatgacctcacaaaagcccagatcctttcagagcccagtgattacatggagaagaggaacctccctggcactttcacttggctcaggacagaacagctgagaaaatacttagaccaagcttgtccagctacagacaatttttccagtgtggcccagggaagtgaaaagattgaacacaccaaggatgtgtttctgtaggcagagcaggtagacctggggagaggagcctctagagctagggaagggaccagaggagcggttatatttctactttagttgtctgccatggggcagggacacatggt

SEQ ID NO: 12485 - DNA, 34011 bp, Human
  misc_feature (1)...(34011): n = A,T,C or G
ttttaaacgagaagtgatgtttccggagcattaaaactgaagtgatttcaaaaccatgttgcactcacacgaacaggtgtgcacttaatggactaaactagttcagctgacatgtcttcttcattaggaacagtgtggagactgaaaaactaatttagcctagagcagctatttaattgtaaagtctcctttctcaaatattgatttactatgtgaggaaatatttactttgtatagaagtgtgtggaattggacgagggggttgacctacacatgtggtttggtatacacatatcctcattacagagggtgtaatgaagatataggtggttcagcaccataggaaagggaaaaaagaaaaaaaaaagacggtagaggtggcctcccaagcatccactcccactcctcttgttaatgattcacaatttgttgttattgttgtcatttactgttctccacacctttccacaaggcctgtgtgctttgaaaaaatatgtctctactccggatagaagtggggcacacagggccaggcgcggtggctcacgcctgtaatcccagcactttgggaggccgaggcaggcagatcacaaggtcaggagttcgagatcagcctggccaatatggtgaaaccccatctctactaaaaatacaaaaattagcctggcgtggtggcacgtgcctgtagtcccagatacttgggaggctgaggcagaagaatcacttgaacccgggaggcagaggttgcagtgagccgagatggtaccactgcactccagcctgggcgagagtgcaatgagactccgtctccaaaaaaaaaaaaaaaaagaaaaaaagaaaagtaagtggggcacacgattcaggcctaagctaaccagaccaacctcattcctgatggttgttaatgtttcagatacgggcccgcagccctacgtagagaagaggccaaggtagaaaacatgaatctgaggtaaaaagaaatgaggtacttgtttgcctcatcaagcctctcaattaaactaaccttgaagcctgtcttacctttggacttctagtgatgtcacccggtaaagcccatttgtttcaggacgtaagagttgggttttctgtgacttggaaccaaaaccattccaatttacaaaatgagcaactttaatattacccatgagaaatacttcattggtatatgctctttcctagcgtttttgaaaactaaactaggtgggtgaaaagtatatctttgcatgaaactttttcattccagaaaacattttgtcatcttgataataatggccaatgctactatatccaaatttttgtctttttttttttttgagacagagtctcgctctgccgctcaggtgtgatggcgcgatctcggctcactgcaacctctgcctccctggttcaagcgattctcctgcctcagcctccctgagtagctgggattacaggcatgcgccaccacacctggctaatttttgtatttttactgtagacggggtttcaccattttggccaggctggtctcgaactcccgacttcaagtgatcctcctgcctacctcaaaaagcaacttgataaatccacaggctcggtatattttaaaaattcttttaaatacagtatacttttctctttttttccagaattaaccatgaatcgcacacacagccagaggcttttaacccgagaacggacaaaggggcctgcttgtgcaatacaattatttttaatggttaaacaaattaatacataagaccagctttacctaatataataataacgaaccaaagtttacaacagacaagaaaagcaccagctgtccccgccaccccggagcgatctccaaggggacgcgggagagcgccgcgggggacgcggaagtctgacgtcacaggaactgggggcggggcggggaggcccgcacaccctattgcgcatgctcccgcctccccggccgcggcctggcgcagtgcgcacgcgcgcgggtgggcgggtttgactggccgtagagtctgcgcagttggtgaatggcgttggtggcgggaaagttgagtctctcctgcgccgagccttcggggcgatgtgtagtgccttccatagggctgagtctgggaccgaggtgagagccgccgggttgggagtgagggagatgggaacaaggccgccggtgggcgaggggagccgagggaacccgggggattgggaggcttggggcggcgcggcctggccgggctgggaccggcctctcggcctagacgcccgcgatgctggcaccctctgccacctctcacctgggccccaggggtccgcccctgggcagcctggagtcctccgaggtgggaggaccgggcggaggtggaggaagtctttctttggaagacttgctgcctgcccagatcgatataacatacgaggtctctcctcccaagagttatggtctaaaaacccctcacaaattaactaccgttggaaatgtcaagctatgcaagaaaagctagaaaaggggaggggtcgcccgttggagcatttggagcttttctggaacaggtggtgtttgcggaggttgcctcacctccctgtagcccacgtgtctctgcttagggcagctggccctcgccaccccctagtattcgtttccagcccaggtagctccagagccacacaagccggtggatgcccctcaagaattgaaccaagtgtccagcacttactgtgtgtcaactacgtgttaagggataggagtaagcaacaaaagacataacttctgccattaaagaactagtaagggaggctgctgtaagaattacagtattgcacaaaagtttgttgtccattagaggggcgggcatcatggaagatgcaggaggagatgactgaagtttcaaggaccatttgaaatggtttggcaaggagaggatgacattcagagcggagacagtcgggagtacatggattctgaattaagcaagagcatggctaatttagataactgcaagtatttctgtaaaattggaacaaagggagtgagggacaataggttgggaagtaagcgctgagcagtgggcagggtatgaaggatcttttatgcagatgagagaggaagcaatctcaaaagagtcagcaaacatttttgtggagggccatgtggtaaatatttaggctttgcaggccatgccgtttctgtcacagccactcaactctgctgttctaatgggaaggcagtcatagataaataaaggcacatggcagcgttccaataaagctttgttttttggatttagcctgctggccatagtttgataatccctgttcctaaagagtagaaccactgcttagtataagaacggctacagttataaaccatagatatatatatatttaaaaatatatttatatataatatatatttaaaaatatatttatatataatatatatttaaaaatatatttatatataatatatatttaaaaatatatttataatatagatatatattagaaaatatatttatataatatattttttaatatatattatatataatatatattgagatgaactatattatatataatatatatttaaatatatattatatataatatannnnnnnnnnnnnnnnnnnntggccatagtttgataatccctgttcctaaagagtagaaccactgcttagtataagaacggctacagttataaaccatagatataatatatttttaaatatatattatatataatatatatttaaaaatatatttatatataatatatatttaaaaatatattatataaatatatatttaaaaatatatttataatatagattatatagaaagtatataatacatataaacatattttttatatataaatatatatttttttgagatgaactctcgctctgttgcccaggctggagtgcaatggtgccatctcagctcactgcaacttccgcctcccgggttcaagcgattgtcctgcctcagcctcccaagtagctgggattacaggcacacgccaccacacccagctaacttttgtatttttagtagagacagggtttcgccgtgttggcgaggctagtttcgaactcctgacctcaggtgatccgcctcagcctcccagagtgctgggattacaggtgtgagccactgcgcccggccaaaaccttatatttaaatgattatttgaaacccaggttaaggtccgatgatttttgcaatcagaacaagccttgtatccaaaaaatgagagtctagcacagttaagtcatggaacaaagaatttaacatcatatcctttgcctgccttgtctgtgtggcaatcctaagcctagctcatactactctggagtggagtggggtggaatggtgaataggaagctaggcaattggcgctgctctattttcctttttattaacaaaaccagttaagccagtctctttccctttaagtgtcttgggaactatgtggccactgccaaatttgtttgaactctagcttctttgcacattcatctactttgaatttacttggagggattgtgttgaggaatatatctgaagccataagctaacccaagaaactgaaataaactactttaaatttttggttttttttgagacaagagtctcactctgtcgcccaggctggagtgcagtggcgcgatcttggctcactgtaacctctgcctcccgggttccagcaattctcctgcctcagcctcccgagtagctgggactacaggtgcacgccaccatgcccggctaatttattttttatttttattttttagcagagaccgggtttcactatgttggccaggctggtcttaaactcctgacctcatgatccgcctgcctaagcctcccaaagtgctgggattacaggcatgagccaccacgcctggcctgctttaaaattcactagaattagaacctaataaaatagttaatctttcttgtgagtatcaaggaaaagacatttcatatgggggtcttcaagaaaataaagttgtaagaatatttttttaggctgggtgcagtggctcatgcccgtaatcccaacactttgggaggttgaggtgggcagatcacctgaggtcaggagttagagagaaaccctgtctctactaaaaataaaaaaaattagctgggtgtggtggtgggcgcctgtaatcccagctacttgggagggtgaaggaagagaactgcttgaacccgggaggcgggggtttcagtgagccgacatcacgccactgcactccagcctgggtgacagagcaaaactctgtctcaaaaaaaagaatatatatttttttagcagattctagggatgaagtttatggtaagccaggtggagagtggaaaacatatgtgcccttgatttaaaaaagacaagcatttgactacagtttacaatagaacaatccatttttccctttgcacagtagcaataggatttttacttttatatctcactgagattgtgagaaaagatccagtgatttgggcagtattttggtatcatccaccaaatggcttcatttgaatacagttgttaaataatggtgtactttgcattttttcaagaatgctaatatgccttgaattttaaaataattggtaaataaaaaattggaagtgtctgtccagttttggttgctatgcacagcataccatgttttttttctttaaaaaactaactccattatatttattattaaagcagttcatgtacatggcagaaaattccaatagcactgaagtgaaaagtaggaaatgtctccactcccattatcattacccaaggatagccctgtgaatatctgcacattcttccaggaattttctaatgacgtattttggaggctgagatctagagaatattggactggaagttcagaaaccttggttctgccaggagcaagcattgtgattttggataagtcatttaacctttgctgtacttttgtgaaatgaaggtggtagactgatttctcagttcccttacagctcatatacttctttgtatcctttgaactaaacacagtgtctgcatagtaaatgtaaatatttactgataataaaggttgattttcttaaaaagaaaagctacagggtggtctttgctagaggcaaatattacataagacaaatatttaatgtttcttgtaaaataataattggtgttgtataatcacagagttttagaataatgcttatcaccttttgtctttgcttcccttttacccagaatagaatcccatgttccttcattataattattccattatcattgccatcaaattacttgcctcttaacacctctaagctatttacctacgcatggtgaaaaccaactgtctacttccactcagctgaatattactagagaaaatcacaactaggctgacttgattttattttaaatttatatatttattttcatgttttagagaaggggtctcactctgtcacccaggctggacagcagtggcacgattacagctccctgcagccttgacctcctgggctcaagtgattctcccacctcagcctcccgagtagctgggactaaagggacacaccactacgcctggctaatttttgtattttttgtagtgatggggtttcgccatgtttcccaggctggtctcaactcctgggctcaagtgattcacctgccttggcctcccaaagtgttgagattacaggcatgagccactgtgcctggctccattttaaatttataatcatcattctcaaatgggcacccggtctaactatatttctctagtaattcactttctcactacaaaacatccaaccttatcctggaattccagactcatgttctatcatcttgacatcactatgtgtatgtttaataggcatcccagatttaacatatttatcctcaattgcgtctagatccagggaaaatataataaagagtataggtataagagaagagtattgtatgtatcaatgttaaatttatgattgtgattgtaatgtgactatgcagaataccttttacctcttttttgagtttattttggttttattttttgtttctgtttctttgttaggaatatctttttgcttaggagatacatattaaagtatatgaggggaagctgttcaacaaaagttaactcaatttggcaaaatgttagcaatggtggatctaggtgaaggtattggttcactgtactattcttacgctttctctggaggttttaaatttttccattttttaattttaattttaattttttttgagacagtcttactctgtcacccaggctggagtgcaggggcatgatctcagctcactgcagcctccgcctcccatatccaagtgattctgctgcctcagtctccctagtagctgggattacaggcaggtgccaccatagctagctaattgttgtatttttagtagagatggggtttcaccatattggccaggctggtctcgaactcctgacctcaggtgatctgcccgccttggccacccaaagtgctggaattactggcatgagccatcacacccagactagtgtaagcttttctaaatgatgtttaaaaacatctgtatgggctgggcgtggtggctcacacctgtaatcccagcactttgggaggctgaggtgggcggattacctgagttcgagaccagcctgaccaacatggcaaaaccctgtctctactaaaaatacaaaaattaccgggcatggtggcacacacctgtaatcccagcaactcaggaggctgaggcaggataattgcttgaacccgggaagacagaggttgcagtgagctgagatcacaccactgcactccagcctgggtgacagagtgagacttggtctcaaaaaaaaaaagcctatataatatgtattctactaaataggcgatatactgatgccctaaaacagggcaatgttttgtttgtaccttgatggtagtcataaggatgtgtactcacggacttctgtgtaatagaggtttgcatcaattatccaaacctgaacttctaaatagttggaggttctttacactccccattcttctcccagttctgcctgtgcatgccttgtttgcctgtagtttactaggcagctattaagtttctgccaagcataaagcattgcattttggaattggtaacaaagccaatattgatctctttccttttaaatgtttatatccagatgagggagagtggctagcaatgtgttcttaaggacagtaatagcttcatggagggaaggaaccttgaagaatgcccagaattttcattcattcagtagggaatttagttggaggaaataggctaaagatattccaggtagaaggaaaaaaggcatttctctctcagtacacaatttatatttacctgaaagaactatgtactaaaatctgtcactcaaaattaaaagtcactctcacgcagattagaattggccaactctcttttatgccctcacaatgccccatgtgtatttctgttacagcacctgcctaactttattgtacttttttttttttttacagccttttgactgtttagtttaaataggttacactatgttgctagccttggcccaagcatcctttcacctcggcctcccgaagtgctgggattacaggcatgagccacgatgcctggcctccccatcagttttgttgaaaacagcaactgtgttggctacatctttatatccctagcacttacctcagttcctggaacatacttgacttgcatgaaatgttcaccggtaagtggccaggcatggtggctcatgcctctaatcccagcactttgggaggtcggtgcaggcagatcacttgaggtcaggagtttgagaccagcctggccaacatggtgaaactccgtctctactaaaaatagaaaaaatagccgggtttggtggtgggcgcctgtaatcccagctactcaggaggctgaggcaggagaatcgcttgaacccaggggcttgcagtgagccgagattgtgcctctgcactccagcctgggcgacagagtgagactctgtaaaatgtttaccattaaatgtctgtataattgagcattatctcttttgcagactaaatgcttgctccagcaatgctgctgctgctgaagacatttgggacaccttgttagtgttcaagtttcaactaaaggaatggttgaaagaagtcagataatcgcccagacaggacctcagatggctttcctcctgttttttaatttttaacttttatttttctgtagaggtgggatctcactatgttgcccaggctagtcttgaactcttggcctcaagtactcctgcctcagcctctcaaagtgcttggatgacaggtgtgaaccactgcccctggcctgattttcagtttaataggtccaaaaactcagtttagtccttgtactcatatttgattagtctcagtgatactgaggttgtatagcatagtagaaaaattccaggctttgagaatcacagagatcttgattaaatcctggccctgacatttactagttttctcatgtgaaaaatacaatagtaacaaatagggttgatgtaacaattaaaggacataatataaagaatgtactgctgatcccacagtaagctcaaataactattattagatagctattgttacgataatagaacttagcagatgctgatttacaatccaagtatcaaatctattgactcacaatattagtgaaactgtcaaatagattaaaattattatgtccactgtgtattcttttctagttaggaaattttgcctcggaaaggttgcttagagaattaagagaaacagtttgtcataatggctatcatcaccaagctctgatgcctgatgtattagtcttccctaagaggattaaactgtcatgtcaagcagaatttacttgggttccctttaccctggacacttaacaaactcttctttcgcttctgaaactgcaggttgaccataccttgcttctattgactctttccttgaatctggacatcattaattttaattttctgtaataggcctatgtcagatttttggagtacctcttttcttatccatggaggatatgttccaagacccccaatggatgctgaaaccacagatagtagtgaaccctatatacactatgttttttcccatacagtaatgaacaggtagtgtgtacagcatggatatgctggacaaagggatgattcatgtcccacgtgggacagaacaggatggtacgatattttattatgcaactcagaatgacatgcaattattgaaaacttgtgtatttatttctagaagtttctgtttaatagttccgaactgtggttggctataactgaaaccacagaaaatgaaactgcagataaggggggaccagtgtattttctgcctatgtttagaagtttctttttttttttttttgagatggagtctcgttctgtctcctaggctagagtgcagtggtgtgatctcggctcactgcaacctccaccttctgggttcaagtgattctcctgcctcagcctcccgagtagctaggattacaggcgcccaccaccatgcctagctaattttttgtatttttcatagagatgggggtttcaccatgtcagccaggctggtctggaactcctgacctcaggtgatccacctgcctcagactcccaaagtgctgggattatgggtgtgagcaacaattacaattgttaattgtaatattaacaatttgcttggcttgtgaattgttaatattatccattacttgtaaatttaaatctatttcctatttctgggaggttctttcaccccctttataattcagtatactctgctttgacgttgtaaaacgttgctttggatattctcagtggtggacagtttttctcctttgaaattaaatttgattttctaagtaacagtggaaagtctgatgcagattgcctaatccttgtgggtaactaagaggagtaataccatcttcgcccaaaagagtcccgtcaataaaattataatacttttttctctttttttttttttttttttttgagacggagttttgctcttgttgcccaggctggagtgcaatggcgtaatctcggctcaccgcaacctctgcctcagactcaagcgattcttccgtctcagcctccccagtagctgggattacaggcatgtgccaccacgcctggctaatttagtatttttagtagagacagggtttcaccatgttggtcaggctggtctcgaactcccaatctcaggtgatctgcccaccttggcactcccaaagtgctgggattacaggcgtgagccaccgcacctggcctataatactttcttgagtactattttgccaggatttctcaggggtgaggattctacagtgttttgagaaatgacagtaagagtaaacaattggagtgtcttcccaagttaatctaatgaggatgttattcattcgtatacatgcctttgaagatattttatagttgtttccacgtgctctttcttgtccatgaaagtctctctgtcttgctgggcgcggtggctcatgcctgtaatcccagcactttgggaggctgaggcgggtggatcacctgaggtcaggagtttgagaccagcctgaccaacatggcgaaaccccatctctactaaaaatacaaaaattagccaggcatggtggcacacgcctgtaattccagctacttaggaggctgaggcagaagaatcgcttcaacccaggaggtagaggttgcagtgagctgaacttgtgccactgcactccagcctcggtgacaaagcgagactctgtctcaaaaaaaaaaaaaaaataaagaatctgtatttttctttgagttatactctttcagtcttgtagcccagtggttcttataggttttagtcttaggactatgtaacacatttaaaagtgggagattccactgggcatggtggctcatgcttgtaatcccagcactttgggaggctaaggtgggagaactgcttgagtccaggagttcgagaccagcctggacaacatagggagaccctgtctctgcaaaaagtaaaaaaattagctgggtttggtggcacacacctgtggtcccagctactcaggaggctgatatgcaaggattgcatgggcccaagaggtcaaggctgcagagagccatgatgtcatcactgcacactccagcctgggtgacaaagcaagaccctgtctcaaaaaaaaaattattgaagaatctaaagagcttttctttatgttatatgtgtccatgaaacaaatttaaaattttaaaatatttacattcatgtacagtgacacacacattgaatatttttataaaacatatttttatgaaaaatagctgtatttttctaagaaaaaactgagaaaaatgatgttgttttacatatttgcaaatctttttaatatctggcttaatggaactgggttcttatgcagtctgttatcatatgttggttgggttaaagtatatgaagaacatccatcctctcagagaaagtcacgttgggaaagggaggagtattttaagaccttttcacagaattatagatattcttcttggttactgttaccaaagcttgacaagtagtagttttcctaaaggctaactacaatgtgggatataaaatcttaagaccttgcccaggtgcagtagctcacacctgtaattccagcactttgggaggccaaggcaggtggatcacttgagcccaggagttcgagaccagcctgggcaacatagtgagaccctgtctcctaaaaataacaaaaaaaattagctggacatagtggcacgagcctgtagtccagctacttgggaggccgaggtgggaggatcacttgagcctgggaggttgagtctcatcgtgccattgtactccaacctgggtgacgggagtaagaccctgtctaaaaaaaaaaaaaaaaaaaaaaaaaggtttgtcttacagttggagtgaaatcttttacccaggaatgatttcacaccatgcatcttttggatggttcactgagttatgtgttaggcacagttctccagaggagaaacacaaccaacaaccaataggatacatgtagatatataagaggaaatttattatggaaattggctcacattgttaccagggcagcaagtctggttggggtccacagtccttagttcttgtcttcttggaagaaagaattcagccaagacagaagtagattcaaggcaggactgaagggtttttgaagtaacgttcacttggaagggaccaaatgggcaacttgaaatattgaatgcccctatttcctgatccttcctggtctcctctcatccttctccttggatgggctgctggctaattgcctcatgtgcagtgacttgccagcatctgaaaggggccacgagtgccatttggtgtttggagttctgtgcatgctcgtgtagggcaattttcccgtactggtctagtgctcccagagaaaggtcatatactggtcacactccaccattttgctccctactgcacattcctggacatgtttgctcaattcctaggatcttatcaggaagttgttgcccgtaagcccaagatgtttcctgttaggaaattttcccctccctggtgccagctgcaaccagttatcattcctgaagaggccacctggacattccttggggcctgtcttgccccactcacacctgtctgtctacctactctaatagcgtgatgatggaggccaggaaatcccagacacaccatctgcaagctggagaaccagaaagcctgtggtgtaattcagtctgagtctgaagggctgagagccaggagagcccgtggtggaactcccagtccagggctttaaaggctcgagaatggtgtagggttgggggacaggcggcactggggtaagtcccagaatcaggggctccaatatctgagggcaggagaagatgggtgtcccagttcaagaaaagagggattggaggatgcccgtctgcattagtgaggatggatcctttttaatcagtctactgatgatgctcgtgtcctccagaaacaccctcatgacacacccagaaataatgctttaccagctatttgggcatctcttaacttaatctagttgacacatacaattaactatcacagccaccttcaggcttaataagtctctagaagaactcagaactcagtgaaagctgttatgctcatggttatggtttgcaacagcaaaaggatatagattaaaatcagccaagggaagagacacaataggacaaagttcaggaagttccaagtacagagcttccagctgtcctcttccagtggagtcatcaacagtgctaaattctcccagcaacaatgtgtgacaatagaatattggcaagcagggaatctcagctagactctggtgtccgaaggttttattggggctctgccatgtggacatagtcaaccgcctgcatagctgaccttagcttccagcacttccaggttggcctaacactgcatgacccaaagcccccaccataaatcacattgctgtgtggctcaaagttctcttgtaaacagagactatttttggggggggtggcagggggacagggtcttgctctgtggcccaggctggagtgcagtggcataatcttgactcactgcagcctcgacctcctggactcaagcgattcttttctgtcagccttctgagtagctgggactacaggtgtatgccaccatgcccagccaatttttgtattttttgtagagacagggtttcgccatgtttcccaggctggtcttaaactcccgggctcaagcgagcctcctgccttgtcctcccgagggactaggattacaggcgcgagccactgtgcccggcccaaagacacttttatcaggcaagacattccaagggtttagaattacctctcaggagccaaggacaaaaaccagacctccctttgggcaaggttaaattattcactacacagtatgtttctcatgtcatcacaaagaatattttttaaagtgtactcaagggtcatgatttagtaaaagcagtctttttttttttttttttttttttttttacttcaaagacattcttacgtaaagctggttttgttctgcctgagtgcaggtagtgcttggcgatgtgtgctaatacatttccacaccactgccttgattacgctagctgtcagcaggtacccactattgcttttaggaccttagtatcaaactaggcaaataacatcttaatttttactttttctgtttacgaaaatagttttggccatgggtatgccctcagaacctctgctctaattaagcaccctgtaactttaccttgtattatgacataatctcatctagaggactgagactgcacattctttgagggtaggttgtcatcttcatctttgtagtcaacattttacctagcacagtgcttcatacgcaacagaaattcaacgaacgcctgttaaattaatgcatagaactttttcatcacttgaggaagtctttccacaacttgatttggtttaaaaaaatgcaaataaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaatgcaaataaaaggtgactttcttcccatttgtgatagatttttttttcttttgtcatatagaagggttgtcaaatctgtgctgattcccaagaaacttgagaatcagttttgtctcccttgtgacagttaaatccttcaccgagattgccccctgtgatcctaatgacttccgtcatggtgcagacactcctcctccagactagggtgacaaaccccagccctctctccacgtatggttttaactctcctcacatctgtcccctagtaaccaccaagatgatctgtttgaaatgcagataggctgggcgcggtggctcacgcctgtaatcccagcagattgggaggccgatgggagcggatcatttgaggtcaggagtttgaaaccagcctgccccaacatggtgaaaccttgtctctactaaaaatacaaaaattagccgggcgtggtggtgggtgcctgtaatcccagctactcaggaggctgaggcaggagaatcacttgagcccagaaggcagaggttacagtgagcagagatcgcaccactgaactccagcctgggcgacagggcaagactccgcctcaaaaaagaaaaagaagtggataatatgccaggtactcttttcacatatttaatcctcatcagccttatgagggagggtgctgtttgttatcctcacttgacagatgagaagcctaaggacctcagtgacctagcaggtctggctctggggtcccaaatgtctactcttaactatgttctaaatacttctcactgcttagtgtcacacctgttggctgttgtctacaagccaaagataagctcccaaacatggcgtctgagcccttccatgctctgacttctgctctcttgtagggcttccctgggtcctgcctgtttggtgctgttacagtatctaggagttcaaagctgctcacagtgtccctatgcacaatgctatttataacctctgcactgtggctgctcctgtttctgttagcaggtctactaggcctgcctgtgccccattcacctggcagtcttacttaggagagagcccaggtggtggctcctcaaggaagttctcctccacctttctcctttgtccccttccccagtgaaataaagagctcacaatgaatggggcagacaaatgaaggcagataactgtgtaacaagtgtggtaagaattaactgtgtgaaagttaattacaaggaaggtaaaaattttgccatagcagtttgtcttatatcctaaactagactatccattcctttgagggtacagactcattttatactgtcagtatttggtagataaacaaaaagtaaaatatctgaaaaataagtaaacacaacatttctcctaaactatatttcctatttcatattttcttccaaatccacaaaattatgaaaaaaattttttttgagatagggcctcactctgtcacccaggctgcaacctctgcctctttgactcaagtgatcttcccacctcagcctcctcagtagctgggattacagtgtgtgccaccatgcccagataatttttgtattttttgtagagtcaggtttcaccatgtcgcccaggctggtctgaaactggactcaagcgatctgcccaccttggcctcccaaagtattgggattacaggtgtgagccacagcacccagcctaaagttatgaaatcttacagactttcggaaaatggtataaatatagatgtctaggattttatatttttaaataatgagttttccttctctcttcttttataagctccttgcccgacttgaaggtagaagttccttgaaagaaatagaaccaaatctgtttgctgatgaagattcacctgtgcatggtaaaaaatacaacctttatataaataaatgcaaatctttataaaaggatttttcacataagctcacatgtatacacatactcctcacaagagtttatacaggttaaactgtacaattggaaaatgagacacaggttgtgacagaaagcttttaagctttcctcatcggtgtcagacaagtttgcttctctgcagtaaatcttcagaatatgccttgacctctgtcttattctcaacacacaatatttatgcaagtcctgttattatagtttatgttgaaattccttttctttagaagcttgcggagttgtagggaagtccttgggtacccacttgttagtatttctacaacagggaaaacttactaagggcgtgcgcttaggttgattttttttcttttaatgtggcggcttcatagagataaaattcacccaccgaagtgtgcagttaagtgatttttaggttattacacagttgtgcaaccgttaccacagctgactttagagcattttatctccccgtaaagaagctcatttctagtaatcatcatctcccatgttccccagctctaggcaactactaatctactttctaactatggatttgccttttctggacatttcatataattggaatcatgtaatatgtgatcttctgtgactggcctcttttactttgaataatttgcactgaattgtataattcagtgtcaccatttcataacacgtatcagtagttcattctttgttaaatatttcattgcatgagtgtacatgttgcttatccatttgttagctgatggacatttgggttgtttccatttgctggctgttgtgcataatgctgctgtggttatctgtgtacatgtttttctgtggatagatgtcttcagttctatcggataatacctaggataggcattgctaggtcatatggcaattctacatttaaccttttgagaaactgccagactgttttccaaaggagcttcacattttacttgcaccatcattgcattgccagcaattcccatattctgggaataattgttattgtctgtctttttgataatagccatcctagtcagtatgaagtgttatctctttgtggtttttgatttacattgtcctcacggccaatgatgttgggtatctttgcacaggcttattggcaaattgtatatctttgaagaaacgtcagatcctttgctcatttaaaaaatcaggttatagccgagcgcagtggctcacacctgtaatcccagcactttaggagtcttaggcaggcagatcacgaggtcaggagtttgagaccagcctggccaatatggtgaaacccccatctctactaaaaatgaagtatccaactgttattgttgaattgtctgtttctctcctgagttttatcattttttgcttttgtattttggggcttcatgtattgttaagcacatataactttttattttgtcttattgctggctgacccatttatcattataaaatgttcttctttgtcacctcacatccattaggaaggctactatcaaaaaaaaaacaggaaatagcaagtgttagcaaggatgtggagaaattgtaacccttttgcactgttggtaagattgtaaaatggtgcgaccattatggaaaacagtatggaggttcctcaaacaattaaaaatagagctaccatatgatcacataatctcacttctgggtattcatccaaaagaattgaaagtaggatcttggagaaatatttgcacactcttgtttatagcagcactattcacaatagctaagaggtaaaaccaacctaaatgtccatcaatgtgcttataatgaatccctggggggaaaagtatccatcaatggttgagtggtgtatacaaaatgtgatatatacatgcagttgatattattcagccttacaaaggaagagaattctgtcacgtgctacaacgtggatgaaccttgaggacattgtggtaaatgaaataggccagacacaaaaagacaaactgcttgattccacttatatgcagtttctaaggtagttaaattcacagaaaagaaagtaaaatggtagttaccaggagctggggaggcgggggaagggagtcattgtttaatgggtgcaaaatgggagttttgcaagatggaaaagttgtggagttctgcttcattgctttgcagcaatgtcaatgtacttcacactgctgagctgtacacttaaaaatggttaaagtagggaccaggcacggtggctcacacctgtaatcccagcactttgggaggccaaggtaggtggatcacctgaggtctggagttggagaccagcctggccgacatggtgaaaccccgtctctactaaaaatagaaaaaattagccaggcgtggtggcaggcgcctgcagtcccagctactcgggaggctgaggcaggagaatggcatgaacccgggagggattcagtgagcttgcagtgagccaagattgtgccactgcactccagcctgggcgacagagtgagactccgcctcaaaaaaaaaaaagaaaaagaaaaagaaaaattacccaggtgtgatggctcatgcctgtaatcccagctacttgagaggtcaagacaggagaatcacttgaacctgggaggtggaagttgcaatgagccgagattgcgccacttcactccagcctgggtgacagagcaagactccgtctcaaaaagaaaaagaaaaaaaaaaacaaaaaaaaacaaagacaaaaagtttatgattgcattttgctgtctgttttttatatatgtcttatgtcttttctgtttctttctcctttactgttttcttttgtgttaaatattttctaatgtaccattttaattcccttgtcattgttttcactatatttttctgaattatttttctagtgattgccctgggattacaagtaagatcataatttctaacagtctagttggattaatacaaacttaatttccatattttgtaaaaagctttgtttactgtataggtattccctacatctttatacattgtatggtcatcagcacatttaatattattactgaattaaagtaattaaaatgatcacttaagaatactttctggccaggtgcggtggctcacacctgtaatccagcactttgggaggctgaggtctgtggatcacctgaggtcagaagttcaaggccagcctggccaacatggtgaaacctcatctctacaaaaattagctgggcatgatggcgggtgcctgtaatcccagctactcggggggctgagacaggagaattgcttggacctgggaggcagaggttgcagtgagccgagattgcaccactgcactccagcctgggcaacagagcaagactgtcgcaaaaacaacttccttcttaaatcagatagatgaaaaaacagttacaaatacaaaaacacgtttatactatcttttttttttttttagatggagtctcactctgtcgcccaggatggagtgaagtggtgtgatctcggctcactgcaacctcctcctcctgggttcaagtgattctcctgcctcagcctccccagtacctgggactacaggtgtgtgctaccacacctggctaattttttgtttttagtagagacggggtttcaccacgttggccaggctgctcttgaactcctgacctcaggtgattcgcccaccttggcctcccaaagtgttgggattacagaggtgagccaccatacctggcctgtactgtcttttatatttgcctagatagttacatttccctgtgctctttattttctcatttggatttcaggaactgtgtcctttcattcagcctgcaggactccctttagtattttttgtacagcagatttgctaaccaaaattctccataataaaacacaaattttgatcaaatatgtaagacaaaaaacagaatggtctttgtactctctctgtaaggaaggatattattaaggtgagccttatgaaactgacaatatgttaaaatgggtttgtggaacaacttctacattagaatattatattatagaaacgttgaaaaacaccatcatgttcagtaactaacaaaatttactgaaaactactgaagatcctatagctgtaaaactagttagatgagtattccattggaacaatagcagatagaagactgggattataaagattatttatcaacaatagaagtttatcagagcttgttacagaaaagcttaagttgaagtagtaagatttaggggttatagagtctcaatgccattgtaaactttttttttgagatagagtcttgctctgtctcatctgtatttttagtagagatggggtttcaccatattggccaggctggtctcgaacacccaacctcagggaatccacccaccttggcctcccaaaatgctgggattacaggtgtgagccactgcacccatccgaacattttttaaaatttattttaatttaattttaaattctaggatacatgtgtagaacgtgaaggtttgttatatagataaacgcgtgccatggtggttggctgcgcctatcaacccatcacctaggttacttgtcctggctatttgtcctgacgcgctccctcccctcatgccttcagcaggccccggtgtctgttgttcccctccctgtgtccatgtgttctcatccaaacatttatttttatttttgttttgttttgttttgagacagagtctcactctgtcacccaggctggagtgcagctcgatctcggctcactgcaacctcagcctcccaaatagctggaattacaggcagatgctaccatgcccagcaaattttttgtatttttagtagagacagggttccaacatgttggccaggctggtcttgaactcctgacctcaagtgatccacctgtgtcagcctcccaaagtgctgagattacaggcatgagccattgtgcccagtgccaaacttttctttttgagacagggtctcactcttgttgcccaggctggagtgcagtggcgccgtgacggctcgctgcagcctcgaccaacccccgggctcaggtgatcctcgcacctctgcctcctgaatagctgggaccacagatgtgtgccaccacaccagactaatttttgtgtattttgtagagatggagttttgccatgttgcccaggatggtcttgaactcctgggctcaagccatctgcccacctcagcctcccaaagtgctgggattatgggcgtgaaccaccacgcccaacctgtaaacatatttttaatgcttttttggataggagttattcagtaccatgtaccaattcattacttctttacttctataatgattataatctgcaaattcaacatatttgttatataattggtaggctggtaccaagatgatagcttttttggcttttcctttcttttccttattttgaaggatctttagattcagaactctttctgacaatctgttacccaaactccttacagcgttctatttgtaagaggaactgtcaaggccaaatcatccagattttctgatttagtttaatatcttcaagtgccaaaccttagggatttttttactgcgagttgtcacgttccataatttggctggacaaggatgctgtagcagccacagaaacatatgagacggtgacttcaagtacattgaaaaggatgatgtcccttctgtaggacataatatttgattacaggttttgatcttgaggatcaaacagtaaatgtttataaaatcagtaaaactgatttcagttcatcattaaacatatttgtgaggaatttagttcaaggaccttaatgataattcatgtgtctcttgcaagtttgcagtgtcttcccggttgttataaaagccttttttatacctgctttgctattaatgtgtaaaagaaaaagagtatctcttaggcagggatttaaccttcaacttctttgcctcagtttcactcgtcgggaatccactctgtccttgctgttactctagaagcagtgaatgcctaggctagtgccgttgtctcctgtcttctgagtatctcagttttaaaagtttggttcacaaaatgagatgttaaatgtgcttttgcggactacacaattaatgctccaaggtcactattttggacaaactcagtgatcttttccctgctgtttttcattgtcatgacttttctgctatatttattatttagtagtttcattttcttgaaacattctcttttgccctgtaatgtttttcttcctggttttcctattaaatttctgttttagctgtcttctaatgcctcttctaactgtggatatatctcaaaaatttagttttggccttaattttaggtccataatacccacccatcaaagagatttttgttttttctctattatttctgtgtggattactcccagtctgctataaccagccccttattacctaccatcttgaatctttttttttttttttttttgagatggagtttcactcttgttgcccaggctgaagtgcaatggcgcaatctgggctcactgcaaccctctgcctcccaggttcaagcagttctcctgcctcagcctcccaagtagctgggattacaggcacgtgccaccatgcccagctaatttttatatttttagtagaagcagggtttcttcatgttggccaggctggtcttgaactcctgacctcaggtgatccacctgcctcagcctcccaaagtactgggattacaggcgtgagccaccgcgcccggcttaccatcttgaatcttaaattttagtggctgtaggacattttcattttgtgacacctagagataacattttaaaaaacccataccattttgaaagctaaatttttgctggaatactcaatgtgaattatgtgaactaaaaatttctactttgggttgggtgtggtggtgcatgcctataagtctagcactttgggaggctgaggtaggtggatcacttgaacccaggggtttgagaccaccctgggcaactcagcaagactccatctctacaaaaaaatacaaaaattacccaggtgtggtggcacacacctgtggtcccagctactcaggaggcggaggtgggaggatggcttgagcctgggaggcggaggttgcagtgagctgaggtcacgccactacactcttgcctgggcgacagaatgagaccctgtctcaaaaaaagtctactttatgtctgtatttgatttgtgcaggtacttccaagcctatctttgagaacttttaagtcaccacattaggtttacctgctgtattagtccatttttacgctgctgataaagacatacccaagactgggcaatttacaaaagaaagaggtttaattggacttacagttccatgtggctggggaagcctcacaatcattgcagaaggcaaggaggaacaagtcccatcctacgtggatggcagcaagcaaagagagcttgtacaggaaaattctcccttataataagcatcagatcccatgagacttactcactatcacgagaacagcacaggaaagacccgcccccatgattcaattacccccactgggtccctcccacaatacgtgggatttcaaatgagatttgggtggggacacagcctaaccatatcacctgcagaactgaggccctcaccacgctaagtgtgagcaccctgtggtctctgggcagcaggctccacacctggcagtttgctcctcttgctttgcctcctatgttggtccctgtgtcaaccctggtctaggactttcttacctgctgaactctgccaccaaagccacacactccacctgtcattccctaccagacccgcttccatttaaaatgccagtttcacaattggcttttaggcccttaaccctcacaaaccaagacttatatttttattctttagatgtctctcaagaggatcttgagaagaaggtaactgatgaagcacattcagaagatcctgggttttgtgctggggacagaatactcaagtcccaaccttagagaagctagcaggaaatgtaatcaagtaaatagtgattatatagtgtgatctgtgtgatgatgggagatgatagagtttgctttccctacctcagtgttattaggagcaaacaggatatgtctgaagcagcctctttaaggcatgcagtactctagaaaggtgagtagctgtgggtcggcctctctggctgcctctatgggagcaggagagggaggatttgctgtggtctgcttcttggtttccccgtctgcgcttctgcatggtcccttgttctctatcacatagggcagtaaaagacgcttggcaggagtggcgggttcagcatagctcctcagtaacatagtaagagagggcacactgaacatctgggtggaatacaggtttagttgctatgttaacttttaattagatggacaattgttaatatgaaaatagttttactccttgagcctagaatcttttttttttcttttcttttctttttagagacagggtctccctctgttgtctgggctagagtgcagtggcatgatcatggctcaccgtagcctcaacctcacaggctcccacttcaccctgagtagctgagactgggactgtaggcacatgctaccacgcccggctatttcttttttttaattttttgtaaaggcagggtctccctatgttgcccaggctcgtcatgaactcctgggctcaagtgatcctcccacttcagcttccaaagtgctggattacagatgtgagccactatgcccagccatgtgtagaattcttaaatacaaaagagaagtctatgagaactgataacatactatgctataagaaagctgaagccaggcatggtggctcatgcctgtaatcccagcactttgggaggctgaggcaggcagaccacttgagcccaggagttcaagaccagcctgggcaacatggtggaacccagtctttacaagaaatacaaaaattagccaggcatgatgacacatgcctgtagtcccaactacttgagaggctgaggtggaatcattttttaaatttcttcttaaggtaaatttagaattgcaagttgtatgtaagattatggtggaaatttggtgcagtcttggctcactgcagcctctacctcctgggttcaactgattctccaacctcagcttcccaattagctgggactactgatgcacaccaccatgggtggctttttttttttttttaattgtagagttggggtctcactatattgaccaggctgatattgaactcttgggctcaagtgatcctcctgccttgacctcccaaagtgctgggagttacaggcatgagctactgtacccagcctagatttcttatacattatttgtgaatactccaatatacaacggtttgttgataataataagaaaggccaggtgcggtggttcacacctgtaatcccagcactttgggaggccgaggtgggtagatcacctgaggtcaggagttcgagaccagcctggccaacatggcaaaaccccatctctaccaaaaatacaaaaattagctgggcgcggtagcgcacgcctgtaatcccagctactcgggaggctgaggcaggagaattgcttgaacccaggaggcgaaagttgcagtaagccaagattgaaccactgcactccagcctaggcaacagaacaagactccatctcaaaaaaaaattaaaattaaataataagaaataaagtaattgcatttttttgtgtttttgtttttgttttttgagacggagtttcgctcttgtcgcccaggctggagtccaatggcgtgatctcagctcactgcaacctctgtctcccaggttcaagtgattctcctgcctcagcctctcaagtagctgggattacaggtgcccaccaccatgcccagctaattttttgtatttttagtagggtttcagtatgttggccaggctggtcttgaattcctgacctcaggtgatcctcccgcctctgcctcccaaagtgctgggattacaggcgtgagccactgcgcccagcccttgaatccgtatttagaccatcatttggttggggctaataattggcattttaacatagtgtttccaatcaggtagttcagccgtaaattaataatgacaagcaagagttgaatgccactgtgagtgcattttgaaaagctctggaagcaaggcaacttccccagtgttgtttgatttaacttgtgctgtccttagttattcgagcctagatagaaggagagttggagtctttaacgttcagagtagttgactttgatttttaatgctaggaaaataatttctaatgcagctggacatggtttccagagataattcaaatagcaaagaataactgaaggcagtttgggaacgtgtaaggttgttttcagttgaaggatgctgttggcatttagggtctgagagccatgggctcttgcctcaataatgtgtgaaaccacaaaatccagaattgttccccccataacatcaataacactgagaaacctaattagggagtgccttcacctgcgtgtcatagaagtccaacttagtggcttgcccaggtggaggcttgttttcctcacatcctgagtggcacagaggcaggctgtgcgtggctggtgggggctccgtgtgcccagagtcctgggtaccttctgtcttccacgccaccatcctaagggtgggtttcatcctcactgcttccagatggctgctccacccccacaggagggtgcggcagggcagaaggggtccctggataggaaagaatcatcaacagagagcagcctgcatctcactggcgacagctgtgttacctggtaaccttgcttttcaaaggagactatgaaaaatagttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttacaaattgaagtgggagtgcatgtgagcctggccggaggagagtcccctagcctcttccaaccttcccaccaggctctaatttccttatttattgtatttgcttgtacagctccattttggcaaaagtgaatttagattttctttcacattccagtaagtgtctttttaaacttttttgcagactttgcattttgtaacctacccttgagctactgcattttgactgagatttttaaattttacacaggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaacatttttttattattggagaaagtggggttgaattttgttgatatacatcataaaatagtcttttgcagggtactacgcaagccttaaaatttttcttaagacagagtcttgctctgtctcccaggctggagtgcagtggcacaatcatggctcactgcagccttgaactcctggcctcaagggatcctcctatgtgtgcctcctagagtgcagggattacaggcgtgagccactgctcgtggccaaaagttttcttttttttttttttctttttgaaacagtcttactctgtctcccaggctgctggagtgcagtggcacaatctcggcccgctgcagcctctgcctcttgggttcaagtgattcttccacctcagcctcccaggtagctgggattacaggcacccaccaccacgcctggctaatttttgtatttttaatagagacggggtttcaccatgttggccaggctggtctcgaactcctgacctcaagtgatccacccacctcggcctcccaaagtgctaggattacaggcccgtgcccagccctaaagttttaaactctaggggaattaacagtatttctttacagaatggatttgttaaactagcacagtaaaagtaaagactattctgtttctaggctgttgaatcaaagtgattttagcaattaaactttgtattaatttaccaccaatatttcttcacaaaggaacttttaaaagattatctcagaaagtaaatctgagaggtaagaagtaataatgagtaaatggtaagtacttgagtaaatctaaagaaatattgatagtaaggcaatcctaagcaaaaagaacaaagctggaggcatcacgctacccagcttcaaactatactacaaggctacagtaaccaaaacagcatagtactggcacaaaaacacacgtagactgatggaacagaatagagaatttagaaatgagaccacacacctataatttttttgatcttcgatgaacctgacaaaaacaagcaatgggcaatggattctctattcaataaatcgtgctgggataactggccagccatatggaaaagattgaaaatggacgccttccttatgccatatacaaaaattaactcaagatggattaaagacttaatgtaaaacccaaaacagtaaaaatcctggaagacaacccaggcagtaccattcaggacataggcacaggcaaagatttcatgacgaagacgccaaaaacaattgcaacagaagcaaaaattcacaaatgggatctaattaaactaaagagctgcacagcaaaagaaactatcaagagagtaaacagacagcttacagaatgggagaaaattgttgcaaactatgcatctgagaaaggtctgaaatccagcatctatacgtaatttaaacaaatttagaagaaaaaaccaccccattaaaaagtgggcaaaggacatgaacagacacttttcaaaagaagacatctgtggccaacaatcctatggaaaaaagcccagcatcactgatcattagagaaatgcaaatcgaaacaacaacgagataccatctcacaccagtccaaatggctattataaaaatgtcagaaaataacagatgctggtgaggttgtggagaaaaagatatgcttatacactgttggtggaaatgtaaattaaattagttcagccattgtggaagacagtgtggggataaagacagagataccattcaacccagcaatctcattactgggtatatacccaaaggaatagaaatcattgttataaagacacatgcacgcgtatgttcgttgcagcactgcccatcagtgacagactggattaaaaaaatgtggtacatacacaccagggaatactatacagccataaaaaggaacaagactgactgggcgtggtggctcatgcctgtgatcctagcactttgcgaggccgaggtgggtggattgcccgcgctcaggaggtcaagaccagcctgggcaacacggtgaaaccccatctctattaaaatacaaaaaattagctgggcatggtggtgcgtgcctgtagtgccagctactcaggaggccgaggcaggagaattgctggaacccaggaggtggaggttgcagtgagctgagatcgcgccattgcactcccgcctgggcgactccatctctaaaaaataaaaaataaaatataaggaacaagatcatacctttgccagggacatggatggagctggacgctattatccttagcaaactaacataggaacagaaaaccagatactgcatgttttcacttataagtgggagctaaatgatgagaactcctggatacaaagaagggaacaacacacacacacacacacaccctctcacagacttagaatacgtggcaagaaaagcatataatttgacattaggagcagaagaattagtgtgctaaggtccttgcattgtccgggagaaggggaaaagtatcaacattagacattgataaagggtctgcaccttttgatttcttaaccactcaaggatagaaaaggggcataactttaaaatgaaacaggaaaatggtgggctgatttttaaatttaaaagaaccgaatacagcaggacagatccaaagcacagaggagatggtgtatttaactccatccacaccaatcattacattacatgcaaagggactgaggactccagttaaaatgacagttttaggctggtttttaaaatacatatttgctgttttatttttagagacaaggtctcgctccgttgcccaggctggagtgcagtggcatcataactcactgcagcctcgaactcctgggttccagtgagcctccacctcagcctccaaagtagctgtgattacaggtgtgtgccaccttgcctagctgagtcccttgaattgataaaaggtatatacaaaaatccctcagtaaacattagttaatagtgaaatattagaagtgtctcttttaaaatcaagaacaagagtgcctgctattactacttgtattcaacattgtactgaaagtgtcaacacagtaaagcaaggaaaatgaaaaagcatgaaaaaaaggcatatggaagaaacaaaactgtcattctttaaaggttagatgattgtatgtatggaaatccaatatcatctataagcagattattagaattaagagtttagcaaatttgcgagctaaaacatcaacatttaagtttttctaagtaccagcaacagaattaaaaaatagaattttaggctgagtgcagtggctcacaactgtaatcccagcactttgggaggccaaggagggaggattgcttgagtcctaggagttcaagaccagcctgggcaacatagtgtaagaccctgtctctataaaaataaattttaaaaaagaaaatggaattttaaatatatataatatttaatcataactaaaaatataaagtttctagaaataaatctaataaaaatatgcaagacctttttggagaaaattacaaagctttattgtaagaagcagagtttaacccttttcccatttagaaaaaaaaagtgcagctcactgccagcgctcatttaattttacgtaaacacactcttggaggctgaagcaaatcttactgattttcaatgtgaaaataaaatataaaaactattcttggagttatttctaaacagaactaacatcagaatcatctgaatcatcagaatcatctctttcagaaaaatcggactcatcgaatgaatcttcggctaactgttgagaacgatgttaacatcacgtgtaggaatactacattttccaggatttgacattttcagcgatcgagaattactatgttttgtaaatggaaataccactactaaagacagaatgctataaatagaatgatgtcttttgtttctaaagtcgatatactagagcgatgtgaaaataatcataaaagcgagatatttcgtggcaaagttatctcggggtaaacgctgcagctgtaagcactgccggtgagtattctcaggacaaatgggaaaaagggttaaagaacccctaaataaatggagagaagtagcatgtttgtgattgagagactcagtgtcattaatataaagatgtcagttttgcgactgagcaattgatccaatgcaattactgtcaaaatcc

SEQ ID NO: 12486 - DNA, 51242 bp, Human
gtagagttgaaacttattaatctgctttctgtccacccttgtgttggtggagaggtccctgagataaggtggacctgctccaccctcagggcacagactgcactgtgtaatcagtgctcagggtcacaggagctaatgggccatgggaaccaaaggcagggacatgaccaaggttttggtgattaggaaagggttcccagaggaggagatgtctctaccataggtcatggggaagcctatatgggctgacttcctgagcggggttaaggcagactaactcccagctagacaaagaagctcaaagaagtgtgttaaatggaggtcttccctcctgtggctggtagaccagggcaggctgggctcacagctctttaagaacacttcttctcaaggagacccaaggacactcagggattaggcttccagcatctgtgcagagaactgtcagctcagagctgctcaaaagtaaaaatgccagctaccagtgatgtcatcaccctagtcattcctctcactgtgggaggtcctgtggtccagtgggtagagcagaagagcccctgctaggctgcccgccccgcatcctgctctccaaattcctactctggatggaggaggcgaaagtggtcacattgggctaagaatgagagtaaaaaaatcatttgaagaaaaacttgatgttattcctcagagagatggcagagccaggggacctttttgcctccctcctgtgagactttgctgtgtgtccgctccagcattaacctcggctccagccttctctggacaactcccctccccttaatgcccaatctgtccccctatccatttctgagctaatctggggtatcaggctgtccatggtgttggagggggtagggctataccttaggctgagctagtgaaatctgtccataagcccggacactgtacactgggagagactgggagagaggacacacagttggatccttggcgggggttggggggaagggggctgggctgcagactggaagggagtgggggctgtgcagctgcttgggggtgcaggtaggggactgggtggaacaggaactcacccagcgtgggtccacatagtaggtgtcataatgtggatgggaacacagggagaaggggctccaaagccagttccagagtgctggggcgtccgaggaaccggcccaaccgctccccgctgcagccggcttgtccctttctcggaactaccgagggagaggcgcgtgcggaggtcggcgttcggatctcgcatccgtcactgttgccggcgcatttcctcgaagtcttacctcgaagggctgggtcccacccgcgcgccctgtgcgtgtctccctgtttccccacgccctccttgcctggctgctgcgaggctttgcaggggaaagactggcgcggggttcgcaccctgcccatgtcacaggaaaaccgtgggagcctccccgacgcggcgcatttccggaagccccctctccaggagggttgcgggaaggccgggactctgcatccagacgaacccggtcgcctcccaagaggaaagtcggagacccagctgaggggcaaaaatgccagggaaaggcgagcccagagcttggtgatggagaaattgggaagccaccccccacccttcaatcttaggatggggaattcgcaactgaagccggagcttcagacttggggcgcactcccagcttagcccaggaaagagatttaagggcgcagcagtgtggatacctctcaccccggccccgaaggtctagcgagggtctaacctgggccccttgccaggcccgccccccgcccctttccagcccccggcccgtgcgccgctgcccctttaagaagcccaggtaggcaggcccggctgctggagccgctcctatggcaacccgcgagctgcggcggcttcatgaatattccggggcgcgggagcccgagcgctgccggagggcgcttcgggggaggcggccgctgatgtaagcccggcgggtcgctgggctccgctcggttgcggcgggagccccgggacgggccggacgggccggggcagaggaggcgaggcgagctcgcgggtggccagccacaaagcccgggcggcgagacagacggacagccagccctcccgcgggacgcacgcccgggacccgcgcgggccgtgcgctctgcactccggagcggttccctgagcgccgcggccgcagagcctctccggccggcgcccattgttccccgcgggggcggggcgcctggagccgggcggcgcgccgcgcccctgaacgccagagggagggagggaggcaagaagggagcgcggggtccccgcgcccagccgggcccgggaggaggtgtagcgcggcgagcccggggactcggagcgggactaggatcctccccgcggcgcgcagcctgcccaagcatgggcgcctgaggctgcccccacgccggcggcaaaggacgcgtccccacgggcggactgaccggcgggcggacctggagcccgtccgcggcgccgcgctcctgcccccggcccggtccgaccccggcccctggcgccatggacaagctgccgccgtccatgcgcaagcggctctacagcctcccgcagcaggtgggggccaaggcgtggatcatggacgaggaagaggacgccgaggaggagggggccgggggccgccaagaccccagccgcaggagcatccggctgcggccactgccctcgccctccccctcggcggccgcgggtggcacggagtcccggagctcggccctcggggcagcggacagcgaagggccggcccgcggcgcgggcaagtccagcacgaacggcgactgcaggcgcttccgcgggagcctggcctcgctgggcagccggggcggcggcagcggcggcacggggagcggcagcagtcacggacacctgcatgactccgcggaggagcggcggctcatcgccgagggcgacgcgtcccccggcgaggacaggacgcccccaggcctggcggccgagcccgagcgccccggcgcctcggcgcagcccgcagcctcgccgccgccgccccagcagccaccgcagccggcctccgcctcctgcgagcagccctcggtggacaccgctatcaaagtggagggaggcgcggctgccggcgaccagatcctcccggaggccgaggtgcgcctgggccaggccggcttcatgcagcgccagttcggggccatgctccaacccggggtcaacaaattctccctaaggatgttcggcagccagaaagccgtggagcgcgaacaggagagggtcaagtcggccggattttggattatccacccctacagtgacttcaggtaaggggccacagcgatgatcctgtgggtgccctgcgcggtggcaggcatgcctcctcctgaccctgcctcccagccggagttaactttcctgccttgcgctgggagctccaagagaggcagggcgcctctaggctccgagacacccccaggccccctcctgcaccgcgctgggggaactttcctctgggttcagtcactggtcttctcgggtctgggctgcattggagacagaatgaaaaggtgttctgagcctggcctacccctgccggcagccaggatagggctctgccaccttaagccacatattcctcctcccccttcaaggctgcagagtcaggatggccatcctagaggcagctccgggtcattcagcctgcagagcagggccgtgaagagagacagacctcttagcaacgggccagctccttgggtgctgacagcaggcatttatgtctgctttctggtgccctgggaagctgcggccgggtccctggaggaccgaagtcactggggcctcaggccgggatgaaaaccccctgcacccaccgtaaccctgagctcagctcctcatgctgagtggtgggccaagagcaggcaccctgggcagctggcatccagagcggcagggctgaatgaccttgctcatagtgatgggtgaagatgcctggtgttctgactgatgagcagctgtcctgtgtcccatgcttgtccagtggcccatccataccccagagacccaagctccagcatctgcttggtctctcatgggccactcgtgggtccccaaacaaggtatgactgccagtcagggagagggaccctgcccccttccacatcacttgagtcggatgccactgaacagcagataccactgggagcttgtgggcatatttgtgcaaaaagagggattgttggttgtttctagggttgggatcagggatgcctttacctaagtcaaggtcctaaggttccctagtgcccctctgggctttcgtgatgcatgagattgtgatgaaggtctgggaaacacttttcaagctgggtttaattctctcattctctctttctctgggccctgccgcctacttatctcccttccttgcctaccttagttgcctgcctataaaaatgagcattttgccaacccagagccctctttgcaaactccagggaagctgggtttgtaatgagagcaaagccattttccatccaatgagagagatttctcgcactgggaatgaccagtcagacaacactcggtggcttaaaataggtagtgaacagagcccctccccccttttttcctttgacagactgctcttcctaaccctaatatctccagggttcccattcccagaagactagggagaccagagggcaggctaaacagacagccatagtcatcaaattgtgtgagcaaatgtgggaccctcccatcaggaacggtgtctgggttcccagtgccaggttcctgaagagtgggcttgcctctggccagtactgggccctgaggatcctgggccgagctagagaggagtgagcaggggctatgtctcctccacccccatgggtgtcctgggtttttcctcctgtctctcaactcttcagtggtggtgataggcagttccagtaccaacccctcgagattgctgaagggccctcccctcccttgcccaggtccctgctgtttttgttgtcagaaagcatctgttcagggttctcatcaccaagcccattgcctggggagcctacaagaggccaaccccaggcatgcccagcctccctcagcagcaagcattggccggggaccttctggatgctgggcctggcccttcctatctcccttaccttagaagttggagagtgaggactgggttgatttcatcagataggatccttttccccttcctggtcttaccccattctggtatgtctgtctgcagtccccctgctgcagaatctcccactaactgcaggctgcctgggacatggctgcaggagagggtgtggggatagggaagcggggatacagcagaattgtgaaatgggcaacaggaaaagggtcagagtgggctttgaatttgggtttgtgcaacaagcaacagggactggtagctgcaagtggcacgtcctctttgcacagccttgtagctgtctggagctgggtggggtgtaaggaaagaaatccaagaaagaccatctgagtgtgtctggaggagcggtggccatacctttcctgcttctaggccaaaacagctagtgtcatccttagaatgtcaaacaggcaagagcctagctaattcttctaagcttcgaaaacccaccacccaaccccacctaacccaccgcaccccgaccagcacccccagccttggtctctagagttttagccattggccttgggcctctatgtgtagccaatcgccattgcccacctcaggcttcgcaagagcttctgcaagcattgctcaggctagtcgaggatttattcatcattttgacgggcaggaagcattgatccagcagaactggtttaataaagaattgccagcaaacaatgatagattgagtttgcggtttggagttcagggctggctgtgatgggctgcttccagcatctcccattgctgggggaggaaggctgggtgccttttccagggcaagggtgggctgtgctttgagggaccagcataacctgggccatggctaatcataggcttttctgggctacctctgcttctcattactctacctgcccccgatcccaccccccaatagaaaagaaaccatgccctggccaccgccatggcttccccaggctccctgggcttttctggcttcccctcccctccaactccccatctgccttttgaaacttgtatttgtggtgtgttaagggaagaggccaggatgctgcagcccctcaggacatagctccccgggctcctccccgaggctggctgggctcttgggtcctggatgggtccttccttccacacaagctgtgtcctggagaacctggaacaacaacaacaacaaaaaacataggtactggctaatcttgtttttctaagaggagagaaaggaaatggaaccccaagtgcagatgtagctggttgtgttcctggaagctggtcaggctcagggagtcagcctgggtgtgtgtatctaggtgtctgtctgagtgggtgtctgggggctgtgtgggtggatgtggaagctggtggggaagtccctgtgtggaacgtcagttctgggattgctgctgcgcccccaaagctggctcagccttaataatggaggcaggcagaagcttggcctttctcatccccctgtccctaccctctcctagactgagcctcctgaagccatgaggaagggaagacgggggtgcttaaagtgtcctttccttggggcagaaagagctgggctccaaaatcttggaaactgggccagtggcctagcaggtcccaggggtgtcctgagccgacttcctgctgctggtcactggcaccccgtcactgccattactcacctcccatcacctccccaaccctgactgctgtggagccctgtgtgggttatgagccttatttgagccccagttttcccatttagaaaatgggaatcttgttgcctgttgccatgtcaagcacaaattgtacaactgtggtcgccctgccgaggtgagaagctgcagtgagctgtcagaggagccgtgatgctgttgtgaaccacacctcccctgtcctcacaacttcctttccttggttttgggaagatcacaagggcctctgtccttggctcaagcaggggttgtgaaccttcttggggtcagacattttactccatccagaaggatacctgggtgtccagacacatagagtgtggcacttaatttctggtgtctgtggccccctaagttgaggaccatctgggagctcaaggttgtgaacccctctctaggccatcccagaagagagcctgggcctggtgagaggcagacactcaccttctctggagcctggcagtgggggtccctctgcaatctggggcttgggcctcccattgccagcaggatggaaacaaaaacagggctcagagttagatgcctgaggggggaaaggggttctcccttgggactggtttcttttctatttcctcagtcctacccgctcccacctttctcactttgaatcctggaaaggactgttctggcaggaggtggcaaggaggaagaggcagcagcctgactctgggtctgggggttccgaggccccttctttgctgggctttcctggggccattacccaggaatgttgttaggactctcagtgtgcaaagccaggcggaaaggagccgcaggctgtgttggagggggaagggtgcctagttgcagaggggaattccaaggtgagctgcctgggctgtgctatcagctggcacagtgggcagcagggctctctctggggatgagatgtgtcccacctgacaaggcaggggctgctggagctcaggaccgaggtgcttccaggatgctgggtgcacaaaaacccgataggggcagagggccaggatccccatactgcctggctagagaggcctcggctccaggttctccctgctgcaaggctcaagttcctggtctggtggctacatggtaaggatgggggttaccttctcccctgcttggccctgccacactggttcccttagctgctgtgagcttcgagggttttgggctgccaggtagctgcctgcctcacatagggagtttccaactgtgctgacctgtctccctgtccatccacccttctctcccatgctttagggcccagtgtccccagggccttgtgggatgctctctcaggccaccctggccaccatccatctcttcctggctgaccaccttgtggcatttggacggagctctgtgtttgttacaatgcagcttgtcctgctgtaatgtcatccgactcacccggcgatcttgttcaatacagattctgattcagtaggtctggatggggcctgagatgctgtatttctcattaagcgcccaaagattgctaatgtggctggtgtccagaccaggaccatgcttggagtattgaggttactgttcatgcgcttgttccatgcttagcccaagctcccaaactgagctccctgagggcagagctccgttttatctctttggcctcagagcctgtggcctctatccccaagctcagcgtggcagggtgaagtctgtgaactgggctgagccaagtcacagaggtctgcctgccagtgtggggatgtgggattcatagcttgctcttcctcctttcctgcactgctgcttggacgctgctggtcccgcatgctggcttttgggatgggtgtgaacaggaagaagctgggtggtcagaggaccctcattaatccatcctgtcccaccacttttgcagcttttctcccatccaaagggccagaggggtgggcctggctggggagaaggcgcagggagtactgtgactgctgcattgcaatgagatttctggaaaggagcagatgtcggtatgagcgcagaggtgactgagcaggggagccagtggctctgacaggggccagctgagaggaggacagaggcatccaggccttcttcccaatcttatatccttcttccctgccccaggctatggccagcagccgcccctgggggctgggcttgcttgtcacttctccctgccccctcctaccctgaaaggcattagctttcatacaaatgatggggctgacaagtgtcatagcagcctgagtggcccttgtgcctgccacaacactgaccaccatggaggaattcactcagagcagaaggtccagccccagtcccctgggggcttgtcttagaaccgaggaggcagccggctcctgcacagactcacttggctcaagggctcttacaaagctgcgactgccagttgctaattaatagaagggctactgaggccggccagacagtcttgctttcgcccaggggatgctgaagaattcacgtttcccagacagagagggccatgggcgggcaggggcattgtgttggctttggagaggatgttctctgccagctaggcttctttactgaggaggcattgccagggccctagaagtctgcagtcccaagggctaggaagccactgggagacactgtaccatcagcacccactcggatctgaggtgggaggcagcacagagaggtggtgagctccccgtcaccgtgggcgctcaagataagactgggcagtacttcgatcagaggttgccaagcagcatcccatgcaccaaatacagcatccagatgtgctctgtttggccagcatagtgggtcataacaaatctgagccaatgtttttaaatggaaagatacaacatgaaaatatggctctcgggcttctcttgaaaaactggaaaccctggcagccctggccccacattcccactccacagcggggagctgaaggagacactagaggctgcctcctttacattggcttttgctctgcagttgtgcaggtccccagctgtcgctaaggccactgtcttacacccagccacgtcattcatgccatttagctgcctgacccctgtaggctttggattttatagccctagactcaaatcaacagagactaaagccaggtgggttcacagatcagtaaccaccatttacaaagcacctaccatgtgccaggctgtgctaggagctctatatctcccatttcatttattcttcacgatggcctccaaatagttttatatccccaacttacagataagcctccgacgaggaaaggagagagagagagagagaggtcccccaaatcatgcagccatgaatatcagaactggaatttgacattcctccttcttttatgttagtgtttaaaaaatttaattacacaagtagttcaagaaaacattctcctgagaattaaaacgtcgaggaggggctcagaaagggatagtcagcaggcacagaaaatcgatcaggtgtcggaatatcagatctggagaggccttagcaagccgctggcctggagcctttgtttcatagatggggagtagaggagcaaagagggggagcagctggctcaaggtcacagagtatgtcagaggcgaaaccagagaccaagtgggttgtgtaacgtcttgtctgcaaaggccttcaagcttaagtccacccccagcttcccagccagagggttcacagggaaggcttttcctgaatggtcctgtcagttggagctttttcttgtcactctagcttcatacctgtctttctgggatgatagatattttcaggatcccatcaaaattaggctgctcccatgagaagggagccttcccctttctgaagatgcagagtctggtggctgggacatgctgtcctgaccccagatctggggatgctgtttctgaggatgctgggctgggatgccagctcacctcctcttcctgggcaggtcctgactgctagagacctttggggtttggggaccatatccgggtgccattaatgcccctgttcatggatggcggtgattggggttcagaggagaaggggcaagtgtccagtggtatctttctctgatccaccagagaaatggtcacgtgatctattcatgctagacttcagaaaagtcaagaagtggggttgatctgtggtttaggactcagtgtgtgaccagaatcagggcttattctgtgaccatggctagaactcagcttctgacaatggtcggggctcagtgtgtaaccaggattggggttcagtccgtggctggggtcagggctaagtctgtggccaagggaagggtttggtctagggtcaggaactggcatccttgtgcaaagcctttgagccaatttcggtgcccttgctgaggtaccaaggctcaggactctaccttcgtgccccgcccccctttaggaagctctccctaagttccctgagctcctacacctcttagtatctgagccagctgcctctggtcctctctgggaggtaaagtacaaattataaataaacaacagagccaccactgccgacgccagagccaccaaatctcacacgtgacagctccccacccaactctgctctcttcatcgtttggggctggtgtttggtgttctcagccaggcagcaagctcaggtgccctcagggtcagggctggacctcgagccgtgccggctggatagggggactccctccacccactgctcccccagctctgggctaccacaaattgcagagcaagcagcggggcctccaggtctgatcacggcagctgcgggggcctgataattggctgctgatgattttgtgtctgtctaagcatttatctgtgtgggtggatgtgttatgtctgcgtgaacgaggctttcagaaattaatacataatgggggctggctaatacattatcctctgggcttggagagaggcaagctaagggagtcatgccctccagaataccatatcacccattccaagactgctttcactattaagggtgctggaggtggcaaaatggagagtagggttccacttctggtttatgggagggcagatgagcaatagatcaatatggattgatggtcagggaaggcatcctggagcaagtgactctgagctggatctgaaggaaagagagaaccactctgtgcactttcttggaagcttaagctaagggccgcctggctggggtgggtgttggcaggtgctgggggctgcttattcagaacctgcctcctttaacctgtactccttagtccctgcccttcacccttgaggactctgagcgggctgcctgtgctgccatctgagtacgtgtggtgtgtttgcctgtgtgtatgtgtgcaccctggtcctaggtgcacagcctttgagaagactcgcttctcctgccttactaggcccagaaggcaggtgttgcctgcaataatgtcactgagcgtgtggcctggagcccagaagtaattaccctgcagttccccgttggaggctagagcagcccctgttaatgattaatgtgagtccccagccactgtatgccaaagtcagccatgggcttctcccacctccagtatcttcagaggatgtgagggcacttgttcctttccccaaagacaggaaagaccctcaggtccacaggtcccgttcatgccattagcaccttttagaagaaacttggtccagcaggggagactgcccctggggcctggcttcctgcagtgtgggggccggcccgccccagagccctgggtcctctatcttgagccagcctgcccagaactgcccacctctcccaccctcagcttcccctcctgaccctcatcctgttctgctgggtgacctcagcaagctcctctcttctctcagtgtccagggtcgggcctcagtatgaggctgaagagagcagagctaattggccaaataggtattgagccctgaatcctgaccccattagcacaaatagagccagcagggcagggacagtgctgccgaccagtagagcttttgagaatctccctccctctttctggctctgtcaccgaggtccagccagtcatgatcctagagttctgcagtccctgggggccagggacacgtggaagatctcttacctaggggccttgttttgtggaggctttgtcggcccttgtcctggggagcggggctgggggtcttcctggcacgttgtgtcatattggtgaggcctcttgaaggccctccctccattaggtcatggcctccgtggatggaggccaggctttcttttctttgtttccggggcatccttcccgggaagtgatgcagcaggagcttaatgaaaatgaactgaaatgccatccgggaaagggcctcaaccacgctctcctcccagcctcccctcctagggagcagtcccctcctggaagctcagacctggcctcagaagagctcagagtgtgaggacccatgcagactgcagggcacaccagatgactgtgggtggaggggccctgtgggacaggccagcgggatcatctactctgggattggcagaggaaggaaacaggaaaagccgttcaacgtgtcccagaggctctggggcatcatcatcctgttgggttgctctgtagctcctggggacagagtctaggggacaagcctgtgaatcctaccagtagaagacttggctctgtgctgcccagctgtgtggacttaactgaggcctcacctctctgagtcttgctttcctcctctgaaaatgggaccagagaggggttgggtgttagcaagatcccaaagcctgaattggcagccgctgaagagtcatctgggtgcttatgtgatcatggatgtttgggctccctgggtgaggccgggcaggtagagtttcaggaagcactcaggtgattctgcctccatcactttgggagccaatgagctgggcatccccaagcccccatctgcactaacagcctgcagttctctgattgctctgcatttgccttagtcctacggtggctccccagagcttggggtaaaatcctgccttcttagcacaatatccaaccccattggtaataggcctccctctccagggagcttttataccttttttttccttgtgggttgtgaggagtcaaaatcataaaattctgaggccagaagggacctcagagaacatggccccactcatcttccttgttagactgtgttttcctggagagaaggcagcccgttccctccagctctgtgtccccagatgccccagagaatccttgttgtttggccccaagctccatcccatcaaaaaggggtggtgtagacccttgcagagtcagtatttagctactctttatagggaagccttcctatggcctccttgttagccccttctatgaccaatgctgcctgccttaagaagttctgccccgggtcaggcactgtggctcactcctgtaatcccagcatttttggaggctgaggcaggaggatcactcgagcccaggagttaaagaccagcctgggcaacatggagagaccctacctctacaaaaaaaaaaaaaaaaaaagaaaagaaaagaaagaaaaattagctgggcatggtagtgtgtgcctgtagtcccagccactccagagactcaagcaggagcgtggcttgagcccagggaggtcgaggctgcagtgagccaagattgcaccaccacactccagcctgggctacagagtgagaccctatctcaaaaaaaaaaaaaaaagcaaaaaacaaagacgttctgccccaaatccatttccagtgcttcatgttgcccctcaagcctgtttcctcccgctgctggcagtgccttcctgtgtgagcaggtgagctctcccacctaatttccccagagggtgtgctcccgtgctactccacaacaatgttctatttttgctccaatctcctgagtgggaggacagaaggttcctgggggagtggtgttggagccttctttgattcttgtaagcttgactgagaggttctccaactgcttgttacctcccccatcttccccagtggtcttgtccactgggtgaagcacagagaggttaggccctggcctgagggaacatgcatctgggcaacttggagcactgtgaagcagatgtcccctgctgtgcagtttggcggtgtgtgtgtgtgtgtgtgtgcgcatgtacatattcactggtgtgtttctgcatatgcaacatagggtctgcagaggaggaattagcccatcagataaacaatgggttttcatctcaaagtgtttcttttgcccaggcctgttctcactgtgctgttgagaaggtgcggttgcagtccctttctcaaggaattctcttcctctataactttcccagcccctcatgtaccctggaagagccctgagttctcaagctggcgttcaggatgtcttccacattctcttcagagctgggagctgaggtgtcagggttccctgaggtgcgcgttcttccgtgagtgagctgtcaatctggccagctgcccttggctgacctctttagcctctgcactgcagagattcatggaactcagcatatctttagagatgtctagctccatcctcgtgttgtgccaatggggaaactgaggaagagacagtgagaggaagggacttattcaaggtcacatagcaagttagagacagggacgggactagaacttgagaatctcaggcccctgacccagacaccttccatcgcatagcatgggcctccttcctgtaacccctggcctctagccacagtgctgtctcctgaccagcggacctacttgggcgcctgcatcctctttgaggctttagtacccaacagggcatgctgccccctgctcctttctggagcaagcctggctgaatttctcctcccctctggccatccccagcctgagggatacagagtcagagattctgcatcaaccctcttactcccttcccttggctcatggccccatctgcccatggagctggcctggattttcagctccgctgtggggtgggtctgtccatcctctatattgagggcttcttgaggtgggaccatttgtgtccctcaggatcctcctagctctcaggccaggacctgcatcttaatggccatagaatgatgatgatgatgatgatgatggggatgatgatgatggggataatggcccacttgaattgagtatttatgccatatagcatattgtaaatattatctcatttggtcttcctagactcctgtgaggtggggattaatgttctcatcctgcacattagaaaacaggctcagagaggttaagtgatttgcccaaggcctcacagcagagcacctagccaccgtacatctacaatagcctggccacacagaaatgtggtccctgcaccagcagtctcagcatcacctgggtgcttgttaacagtgcagatgttggccccaccccacagccgactgaagtccaccaggtctgcagctcagaaagtccccaggtgatgtgtgtgcacattcctgtgtgaggggcgccgtgctgtatggctgaaggatcacaggccaagaagagaagactgggttagctgttgccctcacacagctcaccttcttggggagaggctgaggccagctctcattgcatcatgacaggcaggacctcagcccaggatggggaggtaccttagaagaggcaggggtaaagggtcatcattgggttttaagaaaaacaaaacgaaacaaactttgttcctcaaatattgataaacatagaaaaattggaaaataaatgtacacccaaatccaaacaacccgcctgtaaaccaagccccagatgcccttggctctaaatcggactgtgtctgaggcagccctaggcaggcaagggagcagcttacctgggagccctgtgattctgagtcagagtttttgaggtgggttaaaaatagagccctagtggccaggcgggggtgggaggaagacagcaatttatctattgtggtggggagaccctggggtcagggaagaacaacagtgaggggaggttgggcaggaaggttgggcagtgggtggggctatatttccctccagagacctgagctgagcacccagcctggctcaagaaggctgtgggaggtgatttcaaccctgagggtacagggggaggctaagatgccagccccaggacacaggcagggaggactcctgctcaccctgggacaaaacactcccccaccaccagagaggcagctccttctagggtatgggatggtgaaggtggtgacagtggctctgcctcagagaatggtaaagaggagctagacagatagggggtgtggagggggagtaataggtgctttcagacagttatcaaggtgtgaggaggggaggcaggaaaggcatcctcatgcgtgtcacgtgtctgtgtcatggactgacatgcgtgtgatgttaagctatcctcctttgcctattacacctgctcttcagacaaccaccctctctccaccttcatcattgatctccaaaacatcttctcatcctgacctcccgggcacggcaatgactttgccacatatttctgctgaccacttaggagccatctggggaccaggatcgtgtctttcccctgacacatgttagaggaccccttacagcacagggcgctggccattgtttaaaggtagatgaatgtttctgattataaaggtaacatctgcctgttttggggaaggtggaaaatgtagaaaggtgaaatggagaaactcagagtcacgatatattcccacccttagaaatcatcaatgttaatgatttagtgaattctttttttgttttatctttggcagtcttttcttcttctggcaacagtctcccgtccgtccgtccatccatccatccatccatccatccatccatccatccatccatctgtccatccatccatttaacaataagataatgttactgagattcctccccatcccttgcccaactgtgtgttcccatcttggaaaaggaagagaaatcatttctgcccttggggagctcacagtaggggaagccctaagactcctcctgggtctgtctggttggggaatggaggggattccgggagagcagtggagttgcctccttcatcccctcctcagggctcctgagtctcactgctaggcctatttgggaagaagggagaacttctaaaatcccctgtggtggaggtggggtagaggagggccaagggggtgtgcccataatgagaggcttattatgggtggttggttctgctcccaccgcctgcacagctcaggctggaaacacagtcagggccctggttggcagtctttagccacaaggtcccccgaccagctctctctcatcccatcctgtcagagaccccaggccccctgtttcttctgtcccatgtctgttcacctgccttctcccccactttcaatgtctccgctctttttctgtcacttttccaccatgatcctcagcactgggtgggaccacctgccgagggctgttgctgtgagtcttgggggtttggatgtgctaagttcttccctgattgtcggaggcttgtggaagcctggtgggaaggagtctgtttctgagggctgcccgcatcatgtggcttctgctgggctccctgccactcagcctttggcacgcactcctgaggcatgcatggcatgcactcatctgttcacccatcccccatccactcattcgtatgtttccacccattcacgtatttatgaggacctaccgtataaaaggtactgcgccgacttcagagagtcagtgatggcaagttagactgtcacacacacagtttcttataacatgataagtactatgccagggcagcgcctgtgaggggcagttaaccagatttcctaggatacaaagaaggcttcccaggagaagtgatgcctcctgtgaaccaaggggggtaggtgggtacaagtggggagaagagttccaggcagagatgacagcatgtgggaaagcccagaggcaaagaaagcaccatgcgttggggacaccgaaggctgctgagtctgtctgcagcagagtgtgcaaggagaggaatggggagcatcaaggcaggagaaggaggcagagtccaggccaggaaaggccttggggacaacagtgaggaatttggatttcacttaagaggtgatgggaagcgcagaaggatttggggcttagcaaagtgtggagagtcgattggaggagggtgctggccccagccctgaccctgaggtatgtgaggtcctggactggccaggagctcagctgggaagctgttggagtagtccccatggtgggttgatgggacacgttggatccagtgtgatgaagtgttggaaggcaagggagatagaagagttgaggatagctctgaggtttctgggatatacttttggatgcctggtggtaccattttctgggagcacaagagtgtggaggaagctgtgaagctctgtctgaatatggcaagggtgaggttcccgtgggacatccagttgtagacatgtagtcagcaagtggatgcatgggtttacagttcaagagaggggtatggtttacaaggcagcagaataacaaggccatgggagtcagtgaaatcacctggaaagagtgcacagagcgggaagagatgagggccccaaggagcaaaaacatggaaaggtcatgccgagggaaaggaggccgttcaagggaagggaaaggagaggcagtgagaacagagaaaagtcagtggagtgggccaccttggaagccaaggaggagactgtctgcaggtaagaatggtctacaggaccagatgatgctaaaggccagggaggaaatggactggaaagtgaccattggatttagcagcaggatgcatattggtgacgtgctgaggagtggagagcagcatcgcttctcggccttttggctaagatcaagtggagtggagaggagcgctgggtgaggggcacgaaagcgagagtgtggggacggtgacacctccttcaaggagcttggtaagagataagacagcaggggttcagggagggatttttttttaagtttagagagcttaaaaggaaaagctgatgggaaaggatcagtggagagagacagatggaagagagagagggaatcttctgtagattaaggtccctggggaggaaaatggggatggtatcaaaagggcaggtagaagagccgctgattcccctgtgactgggaagaggagatgggattggggagatgcttcaaggtggcagaaagaggaaggggacactggcggctttgcttttctctgtgacgtagaaagtggtgttatctgctgactctgagagaaaaagtggtggtttcagagctttgaggagagaggaattaatttgaaatagcagctatggggaatgggcaggaaagtttactaggttctcctggaaggatcaggggacagagatgagggctgtgaatgaggccatgatgatgacattgaggcatgaggagctaagaaacttggatatttagtaggactggtctgaggttgtgggattctctacacagctcccatgtgaacatgaaaagggttgatggtggtccttgcctggggctgggatttcatgacggtgccaggaggaggggcatgggagttaaaggcgttggttttagagaggcgaatgagctggaccatcgtgtctggggtgaagggtggttgggaggatgtaggagggttctgatgagaggatcagaggagtcagcagactggatattcccaggactctgaaaaacaggtgcagcacaactgaatagaagagccggcaggaaagaagggcagggtgtacaagaggactgcagagatgcagcaccggaggtggtgacgtggtcaagtgtgtgctttggaatggaccattgaggtgggattgttagagtcagggtggcaagctaccaagaggccaaggtgttgtctgggtcaatgatatggagtagaagtcacccaggacaatcacaggatttggagtggaacgggaggttgtgaaccaggtgccagcattgccaaagtccttgaggatggcagatgggtgctggaaggatggccagcaaatgacaaggatacccaaaagatcttgtagacgtttctgccacaggcaggaggtagcagcagtagggagaggggaggatgctgactcacccctgattctgaggcatgagggatttggaagagtgatgtccttaggacacaactagggttcacttaagcggggaggcagtggggtctgggagtgaagaagttaaggatgcaggtgccatggaagagagcacaggagagagagctgggagggagacaaggagcttggggagggacagagtttgggagtaataaaataccaccagccagattgatatttctgtggagtggttagaaagcaggcctctggagtcagactctttgggtttgaatacttggcccaccatatatggcaaatctctcaactccttgtacctcagtctcctcatctgtaaaatgggcataatcatagtatctacctcataggggtttttttttaatgaagattaaataaagtagtccagataaggtactcagattagtgcctggcaaatggtaagtgtccaaaaagtattgactgccatcctcctccattctcactgttttcagtgtcaggatctttgctgggtctggaaaaccaagggaatgggaaagataacccaaagggcatatgagttggagagaatgaaaatgcaggctggagaccaggaaggaggtggggcaagggtccagctgagagacagatgcagaagccatcatggaagcagctagactagacatggtgactgctgggggtgttgctgtaggggtgggtgggaggtaagaggcagcagtaagggatggctgggaggttttgagcctagattattgaaatgcaaactgtgccattcagctttgaggaggatgatgctgagttcagctctggagtcgttggctgtaggagacagcaggccctccaggtggatgcattttgcaggcaggtaagaatgcaggtctggtgctgggagtggcactgagtgggagctgtctgcaaagttggagagggtaacagatggggcactgagtgtgctgctcacctgggagaaagcgtggagacccacgggctacagtcagcactgcagggacatgggtgtctgagacaaggtccctgtcctccatgaacccatggtgttttaggagctaaaaccaagactcaggctgtgcagaggcttcagtggtcagagttgaagagctagcttgaaaggtggaaaatattttaatgacaaaacaatgacattcttcttccagctgacaggattcccagtggatatcatttgtgccaaaatgtatgcaagaaagtatgcatgtgtaaaaatggatgcatgtaggagggcaaaaggcaagagcgtgtttacaaaaaatgtattcatggtattgcatgtgggtgtgcatgtgtgtgtgcgtgtgtgcacgcatgttcgtgtctgtgcatgtgcacatgtgcatgcgtgtatatatgtgcatatgtcctcaaaggcaagcgtgggtgtgtgtggacaagaagaggctgaaggaggtcatccctagctgggacctccacttttcctactttcattctgtcacccttcccatcctctttggcctccagggaaggagagggcccttagtcttgtccttgagtccccgagttcagtatcagccacctcctgtcatgtcttcctcagctcccttgaggctatgaacttcctctcacaccaaaacatgaaatttccagatatcggtgtaatgggctgcttggctttttaccatcccccattctttctgcatatgggacctgcccctccagtgtcagcctataagttgcctcttcctgctgagaggccacctgcctgcctgggtggacccattggtccaggtaggaagtaaggattgagataagacaggtctggaagcctggggctgctggggctcccagagcccagttggtgtcttgctggccaggactcctgttaacttaaagggcactgggctggaggaggatcctctggatttggagagactagggcccctaattcaggcacgtgccaactccaggatatctgagcctgactgccccttgctttcctgtcagggcattacacccaccaccctggattcacaccctggattgtgagatttattcatgagtgattctcggggtggccagatgataagggagcattgggcatccagcttgaggcttcggaaatgttactcttccttcctttgtgagccttcgttttcccttctataggacatgtgtgaccgtgaccgagtgattgctgatggccagggtgccttcagcacttgagaggtgtgctacttcctctacctcagacagccctagcatcaggagcatgggccccccaaatcctctttgcagtcttctcttctttctctggggcaggggccacacctgctgtggtaggctgcctttccactgtgatgtaaaggtgtcagaaaggcatatctgcctcccacatccctctagggtacccacaaccccaagaactcaaactctggagtcccagagacttctcctaatcttgtgtctgtccctcactagctgtgtagtctagggcagacacttctctgtcagcctcaagatcatcatctgtaaaataacagcagccacagtgctagtgtgagggataaatgaagtaatgcatggaaaacccaagtaagttctctatacatgtgaagtgttttggggtctttatgaataaagacttttcagtcaccaaggagccccagtaaaaatgctcagagatattaaggcatcacttgagatgcttcgaccagcaggattggaaatgaagaggggccagcaagctgaggatgccagtgtagaagctgttgccaccttcccctggctaaacccactgaacggggctggcaggtgtgctgggcgctgtccgtggtgctgaacgtcatatctagctctggcagggcctggctttcggagacctgtgcaagcatctggcaaggagtaaggaaaggtagtccagaagccaacggcagttcccaaaacccaactcctctcacctcctccagaagcagtttcccggcctcacccttctaggccaccgggatcccatttttatggatacctgggctttttacggatacctgggctcatagggatggtttcttacaccattgccaattgccttctatccaagccttgcgctctgaccagaccatgagtctctggaggtgagggcatctgtgtactgaggcaaataggtctgtcatctgattgctggagggacctcctgctactggctttcctgggtctattacaggctcctctgtgatcccactcccagcagatgttttgctttggctcttctctgggagatttgatcctccctcttacctctttcctgcaaatttattgattttgatgatttatttactcatttcataatgtagctgggcataggtcagagcatttgacagaaatcaattgatttcctccttatgacagtgctgctagtcaggtactgtggttatcctcattgagcagataacaaaactgaggtgtggcatggtaaagtgacttgctagtaaaccatggagcaggaatcgaaccctgacttcaggcccatccctcctcccaccatattatactgtctctccagcagctctgtgatgttccagggtagtggtttgtgggaaagaatgatccaggatcccgaccccagcccagatcgagtgctggaaatatccctgagcatctggaagctcaagattgaaaccattagtcagagtgcgaggaaatgggtgtttttgccttatgcaatttggttttatgaagaccacaaaatgcaaacattctcctgttaattactctctcaaatttggactgtaattgagggaactagagctggggagagtgtagaaacccgttggagtggcaggcccgcccgagtcagcattcccagccgccttgcacccgctctgttaattttagaaactcctccagcctgggtgtattattagctttatgtacagagggccacatagccctcagtggcctttctatgcacagttaaaaaatttgttttcttttgtttttcccaggagattaaatgaagagggatgacagcagagtgtatagaggggtgtttgtgcactgtgtgtgtgaatggggatacctgcgtgtggcatctaatgagtgtacacagctgtctttgagtgaggtctatgtggctgggtagagcatgcacggctctagggcaccccatagatgctgaaaccatcctcctggggcccatgactcattagcaggtgtgctgcattctttgtagtaaagtgtgaagctgaggatgggtcctcaggccttagttgggttctctcagctggcatatgggtactggggccacaggaaggagtggtgggtcatggggtagagaggagctgaagttggcctcttggcatccggccttatcccccataaggccctgtcttgaggccctgaagagcttggctttcaaaggagctgcagaaagctgactctctggaaactgccctttgccacacagtgtgatgtaggacagccatctcacccaccttcagcaaaacaggccctaccctctccttgaatcacagccccattttgagtctggcaaacaaacaaacaatttgctatgaagtaatttctttgcaacctggaactctgcaggcaggggcactttggtttacagtgagaccctctgaagactcgaggaaagcttatctctttctttcccacttccttcctcctggcttccctgcagtaaagaatcaaagatggtggaaaggttatttctcctgggagaagacatgcttatttctgcctcacttaatacctttatctgttattgtgtaaatgtctaaattaatagcagagggaaacagctctgcagtgcaagtttttggtcttggggccagccctgggatggctggtgcttgggcagggtccctgggaataactggccatgccttctggattggggtcttggccacctgtgttgtttccacactccagaaggccccctgcttggtgagttgggagaaacccaccacagacctgtgagttggtgttgtgcctcctcctcatgctgctcaacttctccaaggctttgccctgaggctccctctacaaacgacttgaaggtgcctgaggccttaggagaaatgattctggaagccctgggctggtctctttctatcacattgagtggtatctcactggtgcctgaaatccccccattaattattcttgttttgaagctatctctccccctccacacccccatgttaggatgcaaacctctgagggaaggagatggtcagacattttctgattataggggatggactaaaggtggatgccagagaaccagtttgggagagggccagatcagaatgataggactcattacacagtgaggaaactgaggcccagaatagggaggcccttccggatgtcacatagcatgttgatgacaaagctggggccggagcctgggcctcctgccttccaggcacctgagtcatgtctgtacctcccctgctctttggtcatggtctgtggaatgtctccctgacagcccatctcaagccacagctgaccctcagggaggatggggcagcctagcctgagcctggggtggtgtggggtgagctgctccttttgctaaaacagcctcttgcttctctctgagtgtcactgatttgcttttcagcctgactcttactgcgggctggggatgggaggaggaagcttgttgttggggctcggggaaactcacagaagggcagcacggagggtatccttagtgaatgaagagcctcttattgtgtcattccctgtgccaatctccacatcttgccctggtacccatgtgcctgtcttcctgtctcagaacctcccaagacttctctgtcccagatgctgtccctcagatcttcctcccttagtctgtaacttgtcctctctctcttcctggcgactgacccctgtgtctctgggcagattttactgggacctgaccatgctgctgctgatggtgggaaacctgattatcattcctgtgggcatcaccttcttcaaggatgagaacaccacaccctggattgtcttcaatgtggtgtcagacacattcttcctcatcgacttggtcctcaacttccgcacagggatcgtggtggaggacaacacagagatcatcctggacccgcagcggattaaaatgaagtacctgaaaagctggttcatggtagatttcatttcctccatccccgtggactacatcttcctcattgtggagacacgcatcgactcggaggtctacaagactgcccgggccctgcgcattgtccgcttcacgaagatcctcagcctcttacgcctgttacgcctctcccgcctcattcgatatattcaccagtgggaagaggtaagtggtcagtgcaaacctcttgggggaaaggccactccccacagagggagtgaggaactggcagggaacctcagataattgaacataggctgtcagattgtggcaggcacacctgctccaagaggacaaatactagtaagttcttgacctcttatcatgtgctggatactttacatgcagtatctcaatgaagtgtgtaacagctatagagggaaccatataggtacatgtatatactcatttttcacctgaagaaacagacagaaatattaagtgacttatacaaggttgcatgattagtaatttgtgaacctggaatgtgaacttaagccgatcacctctagagcccacattattaaccactgcgttatgttgtagggtttgtaaacccataaacttgttggggacaggcagggaatagggatgggtgaaaagggccagttgggggacagtagacagtgtggtggatgagaagaactagagaacatctccgttatattgggtggcctctatgcagctccagctaatttttgtcaagtgggaatgggcccagggttgctagatctatagcattatgagaaatggaaatctggatttttatacaaattttgttggcaactctcttagtttgggttcttcctgagcagaacctgagacaaagatttgcatgaaagggatgttttggggatgcattcccaggaaaatctggtaaggggactggggagagggacagggaaaggcaggaagccaagcaatggttggacattggagggtgtcctgtggatggctgtttgcctcagccctatgggatctgaggatagtgtgcgccacaccttggagttgtcccagtcagggcaagggagttggaatgtttatatccccttacctgtcagtcattggttcaaggcactgccagccctcagcactcacagccaaagcagtttccagcagcccgggcaggcctctgacaaaaggtgcggccgctggctgtagagagtgaaatcacgcgggcaagttggagtcttgtgctcagaaactgtaaagggatcctaggggctgtgaacactggctacaggaggaaaataaaacattgaaaaagaactgggcggaccaactgcattgtgaacaaacctcactcatccatgggctgaagcagtcatctgcagcagaggagctaagggctttgctgggaggaagagcagctgaccttgccaagtgcttcggtctgtgtctgccacccacccaagttacacaacttggcagcagcggcaggcaggccagcctggagggcctactctctctgtgagacagcccaccttggatccctgccacctgtgggcgggacaagcttccatggagggccatttcccgctccatccctgtgccgcgtggctgacttcccagcctccaggaccccctgcttgcctggcagaagttcccatgttcaggacatgaagccccccatgctcacccccagcagcagcctgggcctcgactggcagcacctatggctgatggtcagaggcgtcatgaacgcatgtgccataggagaagtgtgtgcaccagtttggcagcgtccctccatggcagaaattctctttggcttggaaaattcacattacttatgctgacagagaggggccgtgactctcccaaggtcatgcagttagacctctggtagaactgggacagaatccagctagccctcttggcccccagcacatagtgtgggctgtcccaccccggtgtagtggaatggcgcatttaagacccaagttaaaatcccggctccacactgcctagcatgtagctttgggtccactttgcctctctgtgcctcagtctctttatctgcaaaataggtataagttgtacctgatgtttataaagccttagcatgaagcctggtgcagaagaactgtttaatatgtgtccctcctggccgggcgcggtggctcacgcctgtaatcctagcactttgggaggccgagatgggtggattgcttgaggccaggagttcaaaaccagcctggccaacgtggtgaaaccccgtctctactaaaaatacaaaaaattagccaggcgtggtggtgggcgcctgtaatcccagctactcgggaggctgaaataagagaattgcttgaacccaggaggcagaggttgcagagtgagccaagatcgcaccactgtactccagcctgggcaacaagagtgaaactccgtctcaaaaaaataaataaatagatgttatttatatttataatatatatatatttatacacacacacacacacacacacacacacacacctacctccctccccaccaagttgtcttagtaacatttccttggttccccatacttagctgtcaagagaaacagggcaagatttatgatcctcatgtgtcaagtgaggaaactgaagatcagaaaggccagccgccccagtggtagggcttttggcctaggcctcctgtcttcctgttccatgcacttcccgccttctcagatggaaagggaatgactttgattctacgattgtttcctttcatggctggggcccctccatgggggactggacttcattcagtccagcaagtgcttgccgggcacccacctgtgctggcctgggtgggcgctgggatcaaaggactaggacgactgttggcagagagtgggagggcagtggcaggggaggagatctgtgcaacaggttgagttggaggtgcctgtgagacagagatgtgcagagatgtggcaggtggtctgagctgagggctgagaggggacagtgactctggagggtgcggctgggtccactctgaggggctgtgaaggaaagatggaggcgtgtttcccctcatgctctgacacacttgtctcctggtttccgtcgcaggtggaaatgtaggaccaggttggctccctcagaccctgagaaacccccaaccttctgcatgtcttggacccacagctagactgccatgaaaagcagagacacgccagctctttccctcctccagcatccattcgtgtctccaggcctcagcctcccaggggctgaccttactcctccagggcctgagggctgtggtcttttgtaggagttggcagagatgccagtggctggacagggtgagtcgtgggttggagctaagcttgtctttcacgtccccacattatgcatcctgggagctcaggcccagggctcctgtccccactgccaccctggccaggccaccctcttgggcacccagaactggtcaggcgctggtcctggcctttctctgggggaggcagaggccccaggaggccttgagtcaggcctctgaactagacgtgccgccccatctcgtggggaggaagaagatcccaggaggccagatggatgactctcacccttccacacacaaacctttatctctcctaccagctgggaagaaaattgctttgagctagtttctgccgggcacactggccagcctagggctctcactggacccctgagattggactggggtttcccagctggccccaggaaccctgtctccaggaccatagcaggccactccagcccgggggcttctcccacctctgcttggcccagaggcagcagcagaaagaccctttggagccctaggtccacatgagagctgaggagagtatttagtacagaaaaccctgccctaatctcctctttcaagtccctctatgagtctctttcctcctttgggcctcagtttccccacttgtgaggcacataatgatgttctctgaagctgtggctccctggggcccagtccccagctcccatctgccttggcaaggtttatgttagctgattctgaagaccttgttgtagctcacggaacgtgaaggaggatgccctcggttggggctagggagcttgcctcccacagactggggaaagcttgccccaggctgcctggcactgcaagaagctagactcctgaccccaggcttctactgcctcccccagccgggcccagaccaggcccccaggagatctcctaagtgttggtggcagtcaggcagtcttgtgagtcagcgcaggtgggccaccatcttggaggatgcaagcctcttgcctccatcctgggcgatctgggtcagcagactccctcccgagcctctccagccatgcctcctccctccctccgaggtgtgagcttgttccaggcatggaggctattgttagaaaccatggttacccttctttggacgttaccctgcaaggctcagcactccagtgacccatcccagaagtctctcctctcccttggcagcctgaagtggccaaagaggggctggaggcagaaggccagctggggctgctgtgtggcctctgatgagtcccctcatcctgtagaccttgattgcctcatctcagaatcaggtgcttggcatctgcgagaagtggagatgacacaaggagaggtcctggggcgtgggtactggccctgtctcctgcacccaggatgggacccggcatgaccctcagtgcagctgccttcaaactgcacccagcatgcatatgcagcagcctgttctgccaggcctggggttgctgtcttcaacgcagacacttgttcttgagacacaggtggaagttgttcttccatgaggagaaaatgaatccacaggagaggattcaatcaggccccaggaagaggccttggtggaaacagcagcagccagacctccaatttctggcctctccttgggactgagaaatcaactctttgttgggagggctgggaaagagagggaaggaaaggaaccaacatgtcctgagtgcctaccatgtgctagtggtggatatgatctcacctgacccccatgatagccctgagatctggcaattacccattccacagatgaggaaactgaggctcggggtggaaaaggcagtggctctgtccttgcactgcagttgagaaactgcagaaggagtgagagcagggcttccccaagttccatgtgtggcagagtgagctgcctggaccgcctgacgggcaaggcttgtagtggcctggaaatgaaggtgctcaacccctgcagtcagaaccaacatcgtaagagggagttctaatgaaatataaagagcaaggcaaatatttgcctggtgcaactgactctccggtggcctgtggccccagccaacagtggggacacaccagtgtttagcagcctctcccagcaacgtccagccttgttctcggcaaccacttcccaggtgctggagagtggtgcaggtgaggtgagtgtcctcaaatctagggcaccccctaacctgaatggatgtgcccccaccagctcttcccaggcagctcagactgtgcgttgttggcgctccagctttgtggtgtctaaaaaccacctgaaacacacctctccagccctgccacctgcacccaccaccccagtgcccacagtcctcctcaccgcagttccaggcttcaccaccaccatgctctcagtaggacacggaagtctgtgtcccctgcaggagaaggcaccttggttcttcccacagggacaagggtaggttccctgtgggctgcatctgcccagagcgggtacctttttgttcttccactgtctacactagcaggagccctgctgaccaccattctcgtcactgtcaccattgccttcaccttcatcacgaagcccttctcagttcctgaaaccttaccacatgctctgtgccgtgttcattgctgagatcacgataaaggcacaattagacaaggacctgatcttagaagaaaaggagtaatgaaaagataaaggcgatacagaaggaaaggaggtcattgcaggaaaacatgccaccttcgatgctctgtctttaaggcccagcgtgatctgtccaaaggagcagttactgtggcctgtgacagtctgggactctttctagccatgcccggaggcttccttgagctcccatatggtacccactcattcatttagatgtacgcgcatttattcaggcaatcagcagatatttttgatgcctgcttgtgctaagcatggaggaacacagaagtgagaagtagagaggagccctgcctcgtgcagcagcacgcaagtcagtgaatgtcatttcagatagtgagaactccaggaaggaaattcatcagggcaaagagtcacagtgagaatgggaagggagagcccttggctgtgtcacacacagggatccagtgtccttcctttccatggaagtggcttttgagccaagacaggatgacaagaaggagctggaggcagcacgcaggcagatggaagagcaagcccagtactgagggcctggggcaagcacgaactggcctggggcattcaaggacatgaaggaaggccgctgtggccagagatggctttgggcagagtcagggaggccggtagttgggagccgagatgccgagggccacagttggcatttggagtgtattcatgggtgcagtgggaagtcattggaaggtttatggtaagagagtgacatggtctgatttatgtctccaagaggtctttctagctgcttggttgagagtggcttggaggggcggggagcctcatcaagaggttggggctgtcatcttgcgggtgtttagattggggtcatattgggattggagggaagtaaatggctttgagatgtccacttaggcagtagagccaaaaccacctggattgatgggatgtggggagggatgagagactcactcacggctggctggtgggtttttgttgctcagcctcacgaacagcgacaccaattgtgagatggaaacaggttttggatgtgtccacgtagagatagaccgagacagctggacatacgagccaatttgtgttactctgagtccacctgtgtgtcttaggcatgacagaagcaaggaactgggggtatcccagggcttgaaagaggagcacagggaaggttgccttcatcagaggaggagcattgccggtctccacggccccttgtgatggcggcaacacagttgcatcctggggagccctttagccagggagaccccactcagggtgcttccagagatgccctagactttgataccctcctcaactaaagaaactttcagcagaattcctgctgccttgacaagccaggggtgggaggagaacggcatgcttgtggctgtgggctctgctaccagccgtgctgtccagccccacagcagcatctgggctgggggtgctcagagcctggaccagcctctctactcacctccccattgtgccctgcttgccttcctctgttgctgggtttctatatacatgttcccaagtccctttcctgggtgcggcttccttccccagccagactatgagctctgggcaagcaagggcaagactttcctccctgacccccatagggaggggggctttcttgggcactgacacaggctgacttccaggggacatggcatagacatttgggtctttctaagggtacttccccgagacccaggaaagaagggccccactggcccccactccggaaggctcctctccccacagtgaggagtctgggggctctttgcaactctttcttgaccacacttgggtacccagcattcctggcgcagacacctctaagcttgctgtcaaggcctgtgcagggccgttcccaggatgtcctgaggggaccattctgcctctgtgcccaccccttgacccacttacaagtggctgttcgcaggagtggcatggatgtggcttggctgtgggccagggtcctctgctggggggcacagtcagggaagagaagggaggtgggctgtgctctggtgtggttttctaagagttctcatttcaagtctggccctccagggcattacgatggtgccttctgtcaaggtaggagaatagaatatattttctttaacagtttgttggcttgagttacgactttaaatatccaaatctgtggcttgtggaacctgatttgccccttgtcctggactctccaaccctggggcaggcctgcctcattaccccagctcagcactcagccatgtgcctcggggaggctgctgtcctgcccccacgggcccccgtctgtgcctccagtacccttggcctcctgcgcagctttcctgtctgtggcagagggctgggttctgaaggttggtgtctcagtcagctcaggctgtgacaacataaacaacagaggctgggggcgctgaaataacaaacactacttcccacagctctggaggctggcagtctgggttgagagtgccagcacgggggcttctggtaaggccttttttttttctgacttgtagacggccgccttctccctgtgccctcacaggacaaagagatcgtctctgtctggtctctttttataagggcactcatcccactcatgagggtgccaacttcatgacctgatgaccttccgaaggcctcatttccaaatgccatcacctcgagggttaggaattcaacgtaggaatttgggagggacacaaaggtgcagtccctagcagctgggaagagaaggagcttaataataatggccccacccttgcgtctatgactggtgtgcagagagcactttgctagctagtttaattcacaagcaatcttgtaaaacagggggcagatgtctagcttgtttgagggggaggctgagttgtggtggtggggaggcaggtgtggaggatggccggctctgagaccgtgaatggtgctgtgtcactcgccctccccaaacccctggtgtcttagctcagacaccagggggttgggtgagctggggagctagtggcatcctggtcaaccaagacatagaaaggttaggatttgcccagggtcatagacatgtcacattcacctaagtgttaattaaggaggcaaaagtgggatcttccccccggctggtgctgggggctctggtgctcagggacctgctggggagagcctcacggtcttaggatacaggtgcctgaacatgaccagccacagaaaatggaccagagaccccaaattcataatcagatctgctctgtgtcccagacccaggccccagcccagccacagaccggcctgctctccagggcccaccattccttccaggccatggcagatgctgagcagtgtcagcttagccaggagctcaaacgctgacagccccagagctggtctgtgccccagtggtactgggctgcagggcacacagcaccgtctacaccatcacactgtgtgcaggggctggggaggcgagaagctggcaattcccacctggcctaggacccagcttgctgtgtgaatctgggcacctcattcagccactttgggtttgagttgttttatccacaaaatggaactgctgagagctaccctttcctcactaggtcaatctaacaatctaatatggtggctacaggcctcagaatcaggcagacctggctacaacatctggcctttccactgccactgtgatcttgggcaagttcctgtacttctctgagccttggtataaaacagatgaacaatatcttcagcaaaggatttttgtgagtttaaatagaggatggctgtggaatttcatgtccacagtcaggtgtggcactattgtcccctctgtcaccagggccacagggaaatgatggggcaagcttaagctaccggaccccatgaacctttcgctgtccacttcatcctggaaagactcccagctttgtagctggaaccttcagggtcatgcccttgatgggggccacaggtgggggtgactgcaggtgatgagctgtggacaaaaagtattcatcttcggtcactagtatcagaacagcttgccactagctacagggctgtagctggaagaccagtagacaggggctgacatatctaggctctgtctgtttgggcctagtttccacatctgaaatgggcttaaactaggtctctgtggcatttgacccaagcccccctccaagaggggtgtctttgcctgggaatagtatggagggatgagaatgggggctgggtggctagacccacttcaaagtctcccaggccacagaagcaaggccagagcttccagagactttcctctagacttgcctccacctctccatcccccactgccctgtcagcaaggggaccccagcatggcagctttgggaggaggaggggctgagatatgcccaccttggccctgtccagctacactgcagccccccactccgagctgcaggagtagagaggggctggtgccagtgggctggggtcaagggtgctgtaaaggagaacattaccccaaatacgtattaaccaatcaggaagattaattattaataacagcttatcaattaataatggtttgtaatttattgaacactcctctacccattactaagcactttatatgtataatttagtccttttgacagcccactcagataagaatttttatcaccattttccagatgagaaaacatgatcagagaggttcaaggttacacagctaggaactgggtaggacctgggcttgggatcaaggtctgcctgaacttggggcctgtgagcctgtgccgcttcctctgcagttccgtggctaccgtgtgtgagtcttgagaatttagtgatagatttagggaaacacgcccctggcatgtctgtagacttttggttccctgaggagcctcaggctggcaggcttttctccctggtatcctcacaccccaggaaagctgagaaagtggcttctctgcccacttctgggctgcatggggctccaggtgtccttccacatgtcctggatggctagacctttcaggaagaccccccatctgtatagatgccaggagatgtccctctgggaccctgcagcctacagtcttcctcttccaagacctagactgacgccttcccatcccacccccagcctggatttgcactgagtgggcgccctgcagagtccaggcagagcagtgcccaccagcagctccagggcagggaaagtggccgctggccctcctggccactcacctatcccagccaatttctcctcctctgctggcagatcttccacatgacctacgacctggccagcgccgtggtgcgcatcgtgaacctcatcggcatgatgctcctgctctgccactgggacggctgcctgcagttcctggtacccatgctacaggacttccctgacgactgctgggtgtccatcaacaacatggtggtgagtgcgcccagcccggtcctctctctgggccataggcgggctctccagaggtagggtggcgagatgtggacttggaacttctgagttccagcatgtaggaccctgagtgctgcctggggctgagggggcacatagctctacccagtacaggcccaatcgcttgctgccagtccagggatccattcacagctctgggttgggagctggtacctccatcttctcacagcctccattgcaactgggagcctcagtatttcatcttgattttacccagggagactaagacctgggcggcctcccccaggcatggcaatgctgggctggcagctcctggcctcctgcctctgccccttagaagccaagtccttaaaagctgaggctgaggctgggtgcagtggctcataccagtaatcccagtgctttaggaggccgaggcagggggatcccttcagcccaggaattgtaaaccagcctgagcggcatagggagacccctgacttcaacaaataaataaaatttatttttaaaaaattagctggtgtggtggcaagcacatgtgtcccggctgtacagggggatcccttgagctcgcttgtacttcagcctgggtgacagagcaagatcctgtctcaaaaggaataaataaataaaaataaaaaacaaaaagctgagcccaagaaaacagacgccttcaagggtactatttgcagcccacgcagactcccaggtcatatgtggtcactttctactccaacagcagagctgggctgcccccaccccccaacatatcctgatccgaggtggagtcccgatagggagggcaggcaggatgaagcctgaccccaccctatccctccaaccttgcaagtgggtcagggtgggtgagagaagttgaacttggggcctcggaagccatagggcagagtttccagtccccctgtggatgaggtgggttccaggcaggacagaagacaccctggatctgtgagcctttctgtgtctctggtgaacccctgcctctcccaggcttcctcccagtcagtttggtttggtctgaaggcaaattcccagggccccaggggaggaaaaattggctttgaaagaggtgaaagagaccctgaggcatctttcagcatcaaacaggcctttacaaaacagccttttgatgagctaagtgtaaatgaatcagccatatggattgaattccctgttcccagaggctcagcagtaaaggccgctgggggcctacccctgttccccaaggctgggaacccaggtctcttccacccctggggatgagccctcctggtccccactccagtctagactgagccatcagacccaaggagccagctcagctctgttcagggcagtctggctgaccttgaatatggctcgaagctcacgggctcctgcgccttcccctgggggctgggcctctggcaggtgctctgtgggcctgggtaggtttctgcactgtggctcatgcatctgccctgtgagcagaaagacaccagggaggtggccagtgctggcattcgtcaggttcaatgggccctcatctggggcagtgtcctctctatgtgagggtggcaggcccacacatgcactaaattcaagagatggcccttccgatcccagtgttcccacgctgagccttccttgagacaccgactggctttgtagacaaaaatagccaagagcttccctcctcctgtccccacgccttgtgtgttccggagagtctgccttgggggtagtgggaggagaactggtggccgcagccctagcagaggcgggcagggttcatgcaggaggcccgttagctcacagctttaacttttgctcatccaaaatgaggacagtgtttttcggctcagtccgccagagcttgtccccccaagggaagcatatctggttttataattgaggtcagtggggaaatgggcttcacttggcagctgtttagggggttggggggtggagctgttttagcaagggaaggacagcacggtggctcagcccggggcctttgctacccagccaggaggctccaagctgccccatgggggctgggccacgctggctcccgtacctttactggggcttccagtctgatctctgcccccattgcaagaggaaggcacaagaggaggactcgctggcagcacaggctgcttctcacccaaggctttcagccaacagcaaggttagggagccctgggcccagccactgagaaagttaggttgaggtgaggaggtggcagggccttttcttgctagtgagaagggccttccctctcatccactgtccccacccatccgtctgtccacagaacaactcctgggggaagcagtactcctacgcgctcttcaaggccatgagccacatgctgtgcatcggctacgggcggcaggcgcccgtgggcatgtccgacgtctggctcaccatgctcagcatgatcgtgggtgccacctgctacgccatgttcattggccacgccactgccctcatccagtccctggactcctcccggcgccagtaccaggaaaaggtaggtctacccagggagcacccgcacattggtccctcccaagagggagcacaggccaccagccagtgggcccccagcaggaaccgccccctgctcccaccccacaggatcggaactcccagtgtgagggaagagcaggaggagggagacacctctgagatgagaatctgagtttcagctccctggcctggcccctccacatgtctttttttctgttcccaccttccccgtctccagtgtcactggggcctgtggctcctggctgaggccctgtgccctccgtgctgctccagtaggcatttgacagtcaccacgcccttcctggctgctcactcgttctccaggaccgcactctcgcggtgttgctcctgcccctctggccagtcccctgcccccatttgctggcttctcttcccagtcactgccactggagtccccagtggcccgggcctcgcccctgaccctccctctgtctggggccccggtgctgtggtttcaccacccaggcccacaggctctgtgcccatctttgcacagtggggcctgcacagcatcagcagccccacctcatctctcagctccaggtggtttatttcatccctctctggacaccccacgcccctcatgtctgtaatgagaaggctgccctgttctctctactccaagtctctgctcttcccagatgcccaggccagagactaggagccatccctgacctctctctgtcatcaatgcctacctcaaagccacagctccttctctgcatcccaaccaccttcccccgtccccagcttcatctctccctggggtctcaacagcagccccctcaccacagagaatgagtcctgtggcctggagtcaggccacctgggccctaccccagcttctctgctgccgagctctgtttgagcgtgggcctgtgcctccacagcgtgaggccccgtttcctcatctgcagggcgggggtggtactgggcatcaggctgtgggggttgcaagtaagctcccctgtgtttatcagctaagcaggttctgccctggcaccttccactgcacacctcacacagcagttggagcggcatctaaaacacgtcagcctcatcctctgcttgaaactcttcagggacttcacgttgctctgaagatgtagattaactcctcagcatgttttcccagcctggcatttgaggagcataaccagggatctgccctcatgctcagctcctgccctgggccttgcaccctttatttcagcctggccagacttctctccccatgcctgctcctgccatgggacccagacacgggctttcaccctcaactctcctccccaggtgtccacctgacaccctctccacgtccagcctcaccacttagagaagccgtctatgacctggccagcccctcacctgtcatgtgaccccatggcaccctctcctccttcaccacactcagcactctgtgatgatgtaattaaccataggcagccatctgtttaacaaacccaccttccctctccaggccacggctccatgaggggaggacccagtatgtcgttttctgttttatgccccatgcctggcacacagtagggtcagcatttatggattcactgcctgcctgcctgtcccaggcactgtcctttggtggggtgactgacaggtgggggccacccaggtgtggaggtccaggtcccatgatgccaagaagagagctcaggagagcctacagagctgggaggcaaggagagctcactgtggggaagcagaggaaggagaaggtggaagagaattctaggccaggcatcaggatgaggatgagcataggggtggtggcagagaaattagcctggctagaacacagggtcctaggttagaggacccttctctacctcctagggaggtagagaaggcatcgagctacaaaggtcagggcttagtccgggcccagatgagggatcattctggagccagcaccaggacccagcctgtgactggggtggggctcagccaggtgagggatccttctggagccagcaccagtgcccagcctgtgactggggtggggctcagcatgtgagtggggtcagggctcagtgtgtgatcaaggctaggttttagtctggggtcaagatcagggattagtttagaaaaagcatctggggccgggcgctgtggctcacgcctgtaatcccagcactttgggaggccaaggtgggcagatcacctgaggtcaagagttcatgaccagcctggccaacatggtgaaacttcatccctactaaaagtaaaaaaaaaattagctgggcgtggtggtgcacacctgtagtcccagctactcagggaggctgaggcaggagaatcacttgaacctaggaggcggaggttgcagtgagctaagattgcaccactgcaccccagcctgggcaacagagggagactccatctcaaaaaaaaaaaaaaaagaaaaagaaaaagcgtctgggaggctgggcatgatggctcatgcctgcaatcccagcactttgagaggctgaagcgagctgatttcttgagcccaggagttcaagagcagcctgggcaacgtggcaaaaccctgtctgtactaaaaatacaaaaattagccaggcgtggtggcatgtgcctatagtgccagctgtttaggaggctgagatgggagaatcgcttgagcccaggaggttgaggctgcagtgagctgtgttcatatcactgcactccagtctaggcaacacaacgagaccctgtcttaacaaaaaaaataaataaataaataaataaataaaaagaaaaaaagaaaagaaaatgcatcagagtttattttagggccagagtcaaggcgtctgtggcttttcatttgagactttaaaatgtttgtcctttggctaatatctaagtctgcccaataaatttctcttaaatgtcttccctcctctccatccccacgtctgtctctcacctggaccacttcaaccttttaactcctgccccatgtccagaccctgcctccctacccctacctgttctctgggggtcaggggagggactctctaaaacacagctccaggttttccagctgcctccatccctgtaaccagccaggaagtcactgtcccctgggactttgcataacttggagcagtcagaggccagggtggctggaagaagtttaggaaatgtcatttctcagccctcatttgcccgtgggtgtttctgtgcagcagttgtgcgttcccacctctttggagcacacatagatgcaaacaggctgccccgtttctgattgctgctggggtgatagggacttcctctacttcccatccgggaggagtctgtgttgttgcctaatcaatacctcccatccctcatcctgctcttgggaatcccactgtccacccacaatctaggatggtgggagcaatgtccactcctctcagtgagggcgggcaggatcgtttcttatttgtttgagccccagggtctgaggctcacaaatcttttgtacccgagcctctatttgaaggtcccctcaaattagtctaccctgcttttcccttacctggagttgctctcaacgaaatgacccgaggtctcagctgaggccacgtttggattcatagcatcgagcagccaggcatccttgcttctgcctctgagcattctgatccatcgcacccttgcctcctgactgtgccagttgtcactgctgggaggaaacagcttctttccccgcagagtcggtgaggcctccctgtccccagtgtaacattccaaggaaatgtgatcgacctccctggagatacagttgatgtcctgtcactgggctttggacattccctgccgccctcacccacctccttagtattgaacacagcgaggagcagatgctggtgggggcccctcctccatgccaagcagctgggagcccgggcagttgttttgagcacagtgaggtcatttccacactgtagacctcagatctcaaggaaccaagtttagccaggaaatcccccggggtgggtgcccggatgtggtgcctgccgaggtggtggggctggctgctgacgccccctggtggggtggagctgacgcccccttctcccggcctcagtacaagcaggtggagcagtacatgtcctttcacaagctcccgcccgacacccggcagcgcatccacgactactacgagcaccgctaccagggcaagatgttcgacgaggagagcatcctgggcgagctaagcgagcccctgcgggaggtgagctgtgtggcggcccggcgtggaggggagccaggccttcctggcagccagctcccctcaccacctccttcccgtgtcccaatccaccctgtccggcaggagatcatcaactttaactgtcggaagctggtggcctccatgccactgtttgccaatgcggaccccaacttcgtgacgtccatgctgaccaagctgcgtttcgaggtcttccagcctggggactacatcatccgggaaggcaccattggcaagaagatgtacttcatccagcatggcgtggtcagcgtgctcaccaagggcaacaaggagaccaagctggccgacggctcctactttggaggtgaggcagccctgggccctgggggacagggcagctgctcccaggggctggtttggggagataccgaggggacagaggcagtgagcacccttcttggccacagcctggagggaggtgtctgtgagcccagggtaggggtgtcttagtcagtctgggttcttgtaacaaaagtgccgcagactgggtggcttgtaaactgcagaaatgtatgtgtcatggttctggaggctggccatctgagctgagggggccagcatggtcggggctggtgagggccctcttctgggctgcactgctgacttctcgctgtgtcctcatgtggcagaaggaggatgagccagctccccggcctcctcctaaaaaggcactaattccatccacgagggctccaccctcgtgatctaatcacctccctaggccccacctccaaataccatcatgctgggattaggggttcaacatataaattttgggggaacacattcagtccagagcagagggtatgtcccaaagatgggaaagtctgtccagcccccatttggtggggaagaggcatccagtgtggccgcagtctgggggcagggccttgtgagcctgccaaggcttctgtgccaggcagtcagggccaaggtcagggtgggcagtccccctggcctgggcgggctgtgcatgcctcatcctgagtcctgatgctctggcagagatctgcctgctgacccggggccggcgcacagccagcgtgagggccgacacctactgccgcctctactcgctgagcgtggacaacttcaatgaggtgctggaggagtaccccatgatgcgaagggccttcgagaccgtggcgctggaccgcctggaccgcattggtgagggggaggggccacaggcggggcaggtggggggtgttgggggaggagggcagggctcctttatgcctaagccaggtctgcacctgatctccttccccgctctgccctgagtgcctgttcttgttctgtggcccaggcaagaagaactccatcctcctccacaaagtccagcacgacctcaactccggcgtcttcaactaccaggagaatgagatcatccagcagattgtgcagcatgaccgggagatggcccactgcgcgcaccgcgtccaggctgctgcctctgccaccccaacccccacgcccgtcatctggaccccgctgatccaggcaccactgcaggctgccgctgccaccacttctgtggccatagccctcacccaccaccctcgcctgcctgctgccatcttccgccctcccccaggatctgggctgggcaacctcggtgccgggcagacgccaaggcacctgaaacggctgcagtccctgatcccttctgcgctgggctccgcctcgcccgccagcagcccgtcccaggtggacacaccgtcttcatcctccttccacatccaacagctggctggattctctgcccccgctggactgagcccactcctgccctcatccagctcctccccaccccccggggcctgtggctccccctcggctcccacaccatcagctggcgtagccgccaccaccatagccgggtttggccacttccacaaggcgctgggtggctccctgtcctcctccgactctcccctgctcaccccgctgcagccaggcgcccgctccccgcaggctgcccagccatctcccgcgccacccggggcccggggaggcctgggactcccggagcacttcctgccacccccaccctcatccagatccccgtcatctagccccgggcagctgggccagcctcccggggagttgtccctaggtctggccactggcccactgagcacgccagagacacccccacggcagcctgagccgccgtcccttgtggcaggggcctctgggggggcttcccctgtaggctttactccccgaggaggtctcagcccccctggccacagcccaggccccccaagaaccttcccgagtgccccgccccgggcctctggctcccacggatccttgctcctgccacctgcatccagccccccaccaccccaggtcccccagcgccggggcacacccccgctcacccccggccgcctcacccaggacctcaagctcatctccgcgtctcagccagccctgcctcaggacggggcgcagactctccgcagagcctccccgcactcctcaggggagtccatggctgccttcccgctcttccccagggctgggggtggcagcgggggcagtgggagcagcgggggcctcggtccccctgggaggccctatggtgccatccccggccagcacgtcactctgcctcggaagacatcctcaggttctttgccaccccctctgtctttgtttggggcaagagccacctcttctggggggccccctctgactgctggaccccagagggaacctggggccaggcctgagccagtgcgctccaaactgccgtccaatctatgagctgggcccttccttccctcttctttcttcttttctctcccttccttcttccttcaggtttaactgtgattaggagatataccaataacagtaataattatttaaaaaaccacacacaccagaaaaacaaaagacagcagaaaataaccaggtattcttagagctatagatttttggtcacttgcttttatagactattttaatactcagcactagagggagggagggggagggaggagggagcaggcaggtcccaaatgcaaaagccagagaaaggcagatggggtctccggggctgggcaggggtgggagtggccagtgttggcggttcttagagcagatgtgtcattgtgttcatttagagaaacagctgccatcagcccgttagctgtaacttggagctccactctgcccccagaaaggggctgccctggggtgtgccctggggagcctcagaagcctgcgaccttgggagaaaagggccagggccctgagggcctagcattttttctactgtaaacgtagcaagatctgtatatgaatatgtatatgtatatgtatgtaagatgtgtatatgtatagctatgtagcgctctgtagagccatgtagatagccactcacatgtgcgcacacgtgtgcggtctagtttaatcccatgttgacaggatgcccaggtcaccttacacccagcaacccgccttggcccgcaggctgtgcactgcatggtctagggacgttctctctccagtcctcagggaagaggaccccaggacttcgcagcaggccccctctctccccatctctggtctcaaagccagtcccagcctgacctctcaccacacggaagtggaagactcccctttcctagggcctcaagcacacaccgccacctctggggccgtcagtttgcccatctgtacagtgggaggtgagcggaacttctgtttattgagtctgctctgtgccaagcactggtttcgcactttacacacattaactccttcagtttcacaaagaccatggggtgggtactttgattctccccatttagcagaggaagaaacagttttgggtaatttttccagaatcatgtaactaggagtggcagagtggggactgatttgaggttcgagtccacgcctccttgaggcccaagtctgtgttccttccatcagaaaactgtgttgaggggggctgaggtagatggtccccaagcatggtacagaaggaagacaccagattttggcagcagtcaggcctgggtttgaatcccagccctgccacttcttagctgtatgatcttgggcaagttatctgacctttctgtcacctcatttgtaaaatgggaataattatggtactgcctcacaaggacctatgaggaccagatgagaaaaatctatatgtgaaatgcccagcccagcgcctggcacataccatggtaggtgctcaataaaaaatcacatttcttctgcccctcatatgcccagcctattgctccagcaaactatgtgagagcccagggagctttggctgagggctccaagacttaaaatctcaggactcaggaggtggctgggcctccctaagggcccaaggaaggtgtgtggccagaggtgggtgggagccaggccttgagaagtgggaagacttcaacagggagagagggagggaatggtgggtgggatggagtgtatggtggggagattcctgaggtggatgtggagtggtggatcagggctttgggaggggatccccaggctgaggggtcagagggacggccttgggtgatagggtaagggattgtctgggcttagtcctggcaactaggagccataagcaggttccagattgcgggaacgagaaagcagctcagatgcctttggaggcaccatcctccctcctcccagatgggatcttgccagagccaaggtcaggggtctgcccctgcctatagggccagagcaggtatggctgcaatccccaaataatgagaagggctggtcccacattatccatccagaaccttccatgctccaagccagaatgttggcaagatcgggttttgccttgagctatcctgggatgtgagacaaaccgatttctccatagatgggctgcagggagtgggaggcagtactccaggagagaagtgggtgaaggttcctgggatcttaggtaaagactagacgccgcctagtactggtctctactgtgctggctcaggagttctgagaactggaaggacttagcctcaacctgagttctgcacacaccccttccccttaaggaaggcagctctgagaggcagcaggacttgatccaaacccacagtcttgtcctggaggcagcaggggtgaaggtggagggtccagggccatgaggagcccccttgccatcagagcctggcctaaccaccctcttctctacttacacacacatgcattttataatagctctgacccaacctggccactctgcagagactgggacagacaggtgcaggcaatgggccctcccacacccagtcacctacaaggaattttcaaatccacttttaaaacagaaaccggtaaatgcgccgtattgtatattttatttaaataaaaaaaattccagcagatgctaccttcttctaggggccagggataggggtgggggtgaggtcattgggaaatcctggagtcttgggaactcgggtgtggaaggcaggggacatggcccagagggcacttgtgtatgtgcaaacctatgcctgcaagagcatggagctgtgttctgtgcatagaggtgtgcacgggggatgtgcaaggcctggctatggacacaggtgtgcacgtgcttatggactggtgagaatcattgaggagggtgagagcgagtggg

SEQ ID NO: 12487 - DNA, 29465 bp, Human
gtcaggagatcgagaccatcctggctaacacagtgaaaccccgtctctactaaaaatacaaaaaattagctgggcgtggtggcaggcgcctgtagtcccagctactcgggaggctgaggcaggagaatggcgtgaacccgggagacagagcttgcagtgagccgagatcacgccactgcagtccagcctgggcaacagtctgagactccgtctcaaaaaaacaaaaaaaaacaaaaaaaaaacaccaaacattttctttatacccttattctataagctttgatctatttttaatttttaaaaattaaaaaagatttattaaaactaagacacaaatatgcaagttagcctaggctgacacaaaatcaagaccatattagaggcttcttggaaaatctattttcaagtgttttacttttctaacaacattggtaaaacacttggcaatcatcttggggaattgggcatcactgacaggaggaactgcaagtgtaaaggccttgaacttcatggacaaggcagaactggttggaatttagtgagggaaggacagcagggcagaggtcagtaaggttggtgtgtccaaggtgatgtaaggtgttggagcaccttcaggaaggtgaatttgctctcttttctcctaggttctctgggaaggctttggaagacttttacaccagtaagtaacatgatcatatgtacatttccaacattctgcctgctatgtggggtggattaaaagagagagaatggaaacagtggggcccggtaaataatcattttatttaccctggtgatagatgattgtgataggaatggagaaaataaaaaataatggaaagagatgaaggtggaactgatagaacatactgttggaattaatgttgatggaaagtatagaatgaaggctgacttttttttggcaagattaacagggaaatggtaatgccattaaccaagatgggggatcctgggccaggagtagggttggagggagattcagttctgcttgcagtcataagactgagatacctaatgggtactcaaggagagatggatgaagttgaagtcgaagctcagagaagaggtcagaattgggtgtgaaaggaaaggggactggctgagatctccttgggagtgagtttagatagggaggaagttcaaggacagagtcttaggcatatcaacattagaaaccagagaaaagataaggattcagcaaaacgtattgacaaggaacaaccaatgagacacgaggaaaatcagatctgaatgaattaaatgaaacaaggcatcaagaaggaacgagtggtggaatctgtcaagcactgacagatggggcctgggatgtgaccactggatttgctggcagagaggctggtgatggctttgctaagggctgtcttgttgctgatggattcatgagaaaactagaggtggggaaccagaatgcaaatatgtatgagtcttctgaaatgttttgccataaaagggaggagaatcacagagttaattttcatggaaaactcaatggcctttgtgcaaaaaattacaatcagaaaaccataaaaatcactcaagtcgaccaaaatgtattaagtctctcctctttggaaagctcagttctattaaacagcaggatggtggaaaagggactcaaaaggggcaaaatataccccatctccatgaagattataataactctgagagaccccagaaggggatagtgctgtcagtgaaacatgtggggtgtcaggatccttataagaagggacattgattctgattaaggatgagggaagacataggtgacctcagctgggcttgaagcatgaggaagatttaatgagcttgatttgattatcaatcaaacaataaaatgtaaagttaaaaattaaaccactgggccaataaaattctccaagctggtaacataagggctaaaggttttgggtaattatttacctcccagaattagacaattgcaaagagcttagaatatttatttgaaaggaatgaggatcctgcactcttcctccctcaggttagttagctttcaaacttttacccttaatattctgcttttgagatgatgggaatgggtctgtttctgttagagagcagcttaatttgctgtttaggggcagagattgtgggagtggagaagagaatgcctgtgtcctgagataattctggtaagtgagaagggatgttgcattaagagccctggaactacagggaattaattcaagagaatgaaattttctaaaagtatagctgaacagagacagacagacagacacacacacatacacacacacacacacacacacacacacacacacagaggaagaaagagagagaggaagagacagaaactaaatgatatatttggattgtttttgtgaaatacattaatttttttaagcattgatcaaatccacagtgagacaataaatgccaatactgaattctcagagaggaagattttcatcatgcctaaaaaattaatgaaaaccaaacggttctggtttggttccagcgaatttatgggaaagcaaaataaatgaaatctaatatggctttgggaagtagttaatgatgaagagtttagggcagaggactttatttgcaaactgtgaataagagccatgggctgtttctcataaggaggaaaaatgttcagtgctgagaccacctaagatgacatttgagctgttaatagctctgcccagcaccttaaggaaaagtctcattctacagtggactgataactagcagaggaacagggtgcatatgaatccaaaaagaacagacacaagcagtcttggcaagaaaaactgatgagaaattgatataagaatggctggctccatttctttgctgttttttcctcatttacctggtttcaaaataaatagataaggctgatgactcacacatttatatttctacaaaggcccttctgttcttagctatggactcacagacacaaaacttacctgtcaatcttcccttctgggtctaacaggagtctcaaccccaagtgtccaaaataaagttcttgcttttcctctggaacctgttgccctccctgctcatttcgccaacttctttgagtgcaacactattcactcatttgctcaagccgtaagtctagaagtctctgatgattcttccctttctctcattcccatatacacctcattagcaagtcttagtggcatatctccaaaacaggtcctgaatgtggtctttttcaccacaactagcctagcccatccaccatcaacacttgtacaggtgaagaaacaacttcttgttcagtctcttggttctcaatcttgtcctttacagcccatgtgccacacagtggccatagtagatccagtccccttaccaggcctataggacccaaaatggtctggccattttgggagatcgagaccatcctgcccacccctttgatctcatctcctaccattaacctcctcattcactctgcatcgccatgttggactaccttctgcctagaaaaacgtgacaaacttgctggttcctctgcctggaattgttcttgctcagcgctgtctccttctcagtgttcccgtttcagctcaaatataaccatttcacacaaccacactaggtaagtggttagactaggcagagtgcttgccctcctctcctgatgctaatgacctagttgctgtcaatgctactcttgtttttttcataccatgtggcattcttacttctttcttttcatatgtgcccctcctgggatgtaactttctcgcaggtgtactgtctgtgcctgcatcacgctgtccccacaacagcactgtcctcccttcaccctcggctgtctgttcccactgctctcattaacgccagcaaaaccattatcgcctgttactgaaaaaactggcaattgatttctggttataataagtaaaaggagagggcaatttaatgagaactaagttcttcagtcatgcaggagatggagctatgaaagcacaacattgcattcattgattcaataaatatttactgaatcaatgaatgaacttgcggccagtgaactcttagacattggaacactcgaagagtctgtgtgggtatagcttgtggaaaaaaatgttgccctgaaagctatgtctttagttcttgtgactgatatgattttttcaattcaactaattgccctgaggtgtgaaaataaatgataagcaaattatttttccagcagactattcagtcccctcattttaccaagtttcttttcagaattaccagaaccattccatttgccaatgagtatttgtttggatttcaattcaattttgagtgtgttttcgaattccagtgcagactagagggttccatggtctaacatctgtggttttgaatgacatcattgaggcaacttctctgtcagttgcttacttaccagctttagtggtacgttacataacatttccacttatctttaaacacaatagcaccaaaggatcaggtctattttcttttatattaataagaatagtccttcacagagagcacatggaaaatgatttcatttcaccagcacctactgcttatccctttacattttattcctttacatctgcttggtgctgtaactttatatctgcttggtgctgtaacttctctgatcattgtcagtagtaatagatttattgcttatttgtagtcttcaaataatctcattttttaattaataggtccagtccagtgaaaaccagaaaattccaaacttgatctaaaagtataccttctttcccctgccccccaacccgctgctccagtttgggcctggggagggaagggatcatttggttggtttcttgatccctttctctgtcagcaactcctctcacccctcttgctagctgtggcttctgatctttccagggctggtgggtagggagttagaagcaagaagcaggaagtgtctttcttagctggagctcttgtgacctggcattggtggtctctgggttggatgaatgttcaatgctgaatcctttattgtaccccactgggggcatccaccagtcctcccatgtcaggggtgatatgtgttcactaactcagcagttagggttcctttctcaggtgttgggcatcaggcagtccgccctgtcttttggggtcgtgtggcttctccagacagttgtcatttaagagattgtaaactggatttttcctgagtcatctgtatctggttcacaagggacctgctggtctccacctgtgcttcttcacctctgctgccgtgggacgtatcacagcctccagtgtggtgtagacctttgctgtgctctgcagcctcagaccaagagtcaccacctcatgcccttagattctgaggcatgtgtcactcacctttatgcacacacatgcacacacacataggggacatatgtcaagctccctgaatgacctccttgcaggcagctcctataatttgacttgaagtgacggggcagtgccctcctcctttctttcctggagtgagagtgaatacctgacagagaataccagcaactgtctctaaaaacattctcacctttttcatctcagcctacctgtgtccctgaaatttatttttaattacagtaataattcaaattacattattgttgtaacacatgtaaacaccaaagacaaagttcaatgcctgcatggccgttcctaccctccccattcctttgcagagagagtttctatttcttcctggtttaatctaggagggttttatatttccaggaatttatccatctcctctaggttttctagtttacacacgtaaaggtgtttatagtagtcttgaatgatattttgtatttctctggtatcaattttaatatctcccgttttgtttcaaattgagcttatttggatcttctctcttttttccttggttagtgtcgctgatggtctggcaattttatttatcttttcaaagaaccagctttttgtttcatttatcttttgtattttttgtttgtttgtttcaatttccacttagttttgctctgatcttggttatttcttttcttctgctggttttgggtttggtttgttcttgtttctctagttccttgaggtgtaaacttagattgtctatttgtgctctttcagactttttgatgtaggcatttaatggtatgaactttcctcttagcaccgcttttgctgtatcccagaggttttgataggttatgtcacggttgtcgttcagttcaaagaattttttaattttcatcttgatttcattgttgagccaatgatcatttaggagcagcttatttaatttccatgtatttgcacagctttgagagttccttttggagttgatttccaattttattctgctgtggtctgagggagtacttgatataatttcgatttccttaaatttgttgagacttgttttgtggcctatcatatggtctgtcttggagaatgtcccatgtgctgatgaatagaatgtatattctgcagttgttgggtagagtgttctgtaaatatctgttaagtctatttgttctagggtatagtttaagtccattgtttctttgctgactttctgtcttgatgacctgtctagtgctgtctgtggagtactgaagtcccccactattattatgttgctgtctatctcatttcttaggtctagtagtaattgttttataaacttaagagctccagtgttaggtgcatatatatttaggattgtgatattttcctgtagtccttttgttgctatataatgtctctctttatctttttcaactgctgttgcttataagtttgttttgtctgatgtaagaatagctactcctcactccagcctgggcggcagagtgagactccgtctcaaaaaacaaaacaaaaacaaacaaaaaaagaatagctactcctgctcgcttttggtgtccatttgcatggaatatctagtcccacctctttaccttaagtttatgtgaatccttagatgttaggtgaatctcttgaagactatagatacttggttgtttacctgtcttttaaatctttatatgcttttatatatgtatccaattctttgatagctgtatagtatttcagaaaatatctgcatttaactatgcaaatattaaataatcattagttagctcctgactttttgcttttacaaatattgctttaaggaatgtcctgaaacatattattctgtgtggctgtgcttattagtctctggtacacaccgtgaagcagcaatacaagtgggaggatgcagcttgactccctcaaacaatagctcatttccccacatttttgcctaagcttggtgatcatagttttttaaaatgtttatgaaaactgataggtaagaaataataggatctggttcttttaatatccatgtccttgatagcaaagcgaagcacattttcccatgtttgttcttaatctatattcatatattattccaatagtttcctactttttaccaatttactgtattttatttttttattagcttgaagaagttgagcaaatgctactccatatctgatagaatgctgtaattaatttctccccttctgtaagtgatcttctatggtatctattattataaataagttttgctctttttgtgtcctgcagtatccttaaatatgtttaggtgtaaatttcatttcatttctctagcttgagactcattttgattcctgaatctgagaaatcttgtggtttcatctcttctgaaaaattcctatccgttatttcctaaagtattgccttttctcagttctctttattttgtcctcctagaagtcctattcaacatacattggaccttttcactccattttccaggttcttaactttgctgtcatccctcatcatctcactgagctttattctgtacaatttacatagctcattaccgttgattttgctaattctttcattagctatgtctagtcacttagtttcaaattttaatgcctaattttttttgtatttcaagtagtatctttcttaaatctgcctattctttttggtatctttttatgttctagggtccatattttatttcttcaattatttaaagcatacttacataatgtctttgtcagtttattctatttttggaagttcgcagtagtttaattttgctacacattgagtctgaaaacttgttttggatggatcacttttttgagtgtttataattttttattttgagctcataatatatagagcttcatctgcagtaattctgtgtaatctgttttgagtgaatcagactgggcttgattctttggtcagttttttagctggggatgagttctcagacaatgaagacagtatgaattccaaccctcaattctccataacctagatatgaactttcacaattttcaggtgaagtactttattttcaaaccataactcaggacaaagagggttgtcactgttattgttgaaaggggaagagcctctgtaaccaagttttgaacccctgtgaggcatctgactctatattagaatctcccttataatcgcctccctggcatgggcctaaggcttcatccttcatccccacaggcacttagatctcaggcccccacatcactgaaattgatgcttctgtgacccaatctcatggtcactgaagttagcacagacatctaactcggtggagatatctcttactgtctttgcagctacgtaaaagggtgtttgctatattttatgtaatatgtataggtgtttataatagtttttcaggtaatttaatccactggaatctcctagatgaaatttcaaataaggttgtcaagttttcatgtccatttgatactagtatcaatttagagacatgggaacacagaactagaaaggatattacaatttatgaaggcaatccaggccagatttctcacttgcgagatataaatactaagacccagggtaaactgcgacctttcaaagaccaaccaattggttagtgatagagccaggatgacaagttagttttcataaaccctaatctaccacttttcttatacagcaacatttgctcctagttcttagaaagaattggggtaatatcatataagattctccctgtattttcttttgtattctttttatttcagtaagtaaatgccagtccctaggaagagagaaccaaaatgtctaccggaccagatgtcaaggctacagtgggggacatttccagtgatggcaatttaaacgtggctcaagaggaatgctccaggaaaggtaaaatcatgcacagtaatctggtagtaaataaaactaggatctgtggcactgtaacttgtggtactaaataaaactaggatctgtggcatcttttgttgatacacatcattttccttgctaccaccaattgccaataattctatacggttatacattgttattgataattatttcatttctcataagaaactttgaaggtatataagacaggcaggtatcatgacattatttagagatgaaggaaaaaaatcagaacaggttctaagtaggaaatatagaaaccaaccttggcttgtctgattctaagtccaagacatgtcctattagatctctctgctcatgttaaatccagacctgaccccgaaccccaaaatgggctttttgcttctaccatgtcatagaagtcacctttctccctttctcttatctatattacaacatcatgctttttataatatgcattaagggaaactgtagaacatcttattttaccctaaatgcttaatgagttataactatgttatccattaattcttttaaggatatagtcatttcataagataatgacttcaaaaggcaaaaccctaaccaagatggaatgctttgtaatactcaacattttagccagtttgtctgttaagaattatgcatatcttcaagaaaagagatttctcctaatctcaaccatcacagaagaaatcaggaaatgtgcatgttagtactcaacctacaactagtcaccatttgacccagaatgaatactattccagtagtctcggctgaaggtctcatctgtttctaaggatttcagagtctactagactataccattggccaaattcttttatcctatcattctgtctctcccttaaaattaataatacgaagaacttatgtgtaaaattttaccaaggtgcagtatggcatactgggtaaaagcacgggtcagaaatcagaatgcttgagtttccaatcctgattttgccatttatgagctcattattaccactcacatagtgtcccttcctcagcccacctttgggcagtcattggaaagttcatttataatttgtctaaagtggaacttctatggtctttctggttccttctatagtctcctacaacatctggcctaccatgccacccagtcctctggtgaccactccaggctatagctgtatcagacaacaactttgtaacccactttaccctggcctgttgtttcaaacagcatcatgctactaacactcatcctgttttggtagtctcatcctacctaataaggcagaaccccagctactcctccaagccttaccaagttattttgttgtgtatccaagtatttctcacaaatgcttaggaataaaccttgcagagtgctttgtcagttggtgtccaacatcagttttattctcatccccttctctggctcatgcttactggacatggctggatcttctgtattagactcccagggcactgctggggctttctctgggtaccagtacccccatctccaaaggccactcatatctttgctgtgtttctaagacactcagtgagctgaatccaggggttccatgggatgtggagaaatgccccctcccccattatctggtcacctgcttatgcaaagtaactgttccaataacccagaaaccttgagtgaaaaaagctgggccttcaggttctgcctgaagatcagtagtttttctctatcagtgtcagttagggatttctggggccaggctgtagacagacatcactttgaccttctgatccccttttcccccagaagtccatgagcttctttctgtatcagtcagggttatatcacaaaatcaaaagcaaatctaggtatttctgagaagaaagaagattaatataggggactggaagattccacagacgttggaaggctagggaagcaaaagtcaggttggttactttcagaaaatccaggacatgacactgccaatgatcccagccatgtgcatcacaaagtgggtatttttcaggaggacaccccaaagtcacaggcagaaatcccatgtctaacatgactgatcctcacttatccacctgcagctgcctccagagcatagtggtttctcattgagttcggcctgccaccttgggccagaatgccctcatttgtggaatctgaatggaatcctgaggattgtagcttccagatatttgtccctctgttactgtggagaccagagaagggtgggaaaggcactgagaacaatatcagggacggtatcctttctccatatcaaatgcctgcaggaaagatatactgccccccaccatggggaagaatgccatctgaaggacaatttacaacaacatccccttctgaaagccatggaaatgaataaaacaagcacaacactttgagaaagtacttccaactagattgaaactaaggaattattcctaccacacactacaaactctaaatcttgcagacagatttaatacaatttggaagaaattgagagaggagccaagagctcataaaactcccatccttgaggcagggtgcagtgttataggaagaacaaagaggatgctgtggagcttcagcttgtgctcctcagcttggagtggcagtgtccagaagctgggcagaccacagaccccatgagcccctcaagggtctgcagtgctgggatgtgctgggtgaagcgtgcatgggtccacatcctgcagctttcccctcacgcttcactggcctttctgatctgcaatttagcatcaggggccagtgctacaaagcagaggaaaatatgagtaactgcagaaatcaacttggaaatttggaaggctttctctcaaattatacaatgttattgcagaattaaaatggtacagtagttagcttcccttgaattggtgaaagaattccctacctcctcctccccacccctgccaccagcccacccacatacaccaccacattatagctgggcctcaaaccagcatgggtggccctgtgcaggggtttcaaaatgtgagaacaaagtcacacacaactggcttttatggtccaaggctgtaggggtggactacaaggaacctacgtaaatatgtttgtgcaaaggaaagaataagataaggcatgtgttagataaaaaaagaaattgacaggtacacttatgaaagataacagttcattatatagctgtcacataatgagtgcatgccctgtgttagacactgttctaagcagtctttatgtattaattcattgaattctcacaacaatccttcaggaaaagtgctactagcatcatccccattttgtaggagcctgctcaggcacagagggatgaagtaacacatcttaatcatccaggcacaaagaggtagcagctggatttaaaccagctgttgttagcttttacatcacactgctgtgcttacgttattacggggaaattgaggaatattttcatcttcaatttcttaaagttctcaataatgacaataacaataataataaaatcatagagtgtaggaagtaaatcaacagaagaatatggaagaagtcccaatatagatgagaaaggaaactaaggaggaaaaaaatgtcactgcagagttaaaatggaattagtagcagcaaggagaagatagatttgagaaaaggaagaaaacaaagattgtgtaataaaaaatgaaaactagttaattaaacatccaattcactgagcctacaacttcaaagaaattacatagaaaaatgaaacagacaacttatagaaaataatgtgaactcaaatcatgaaaaaattggattaaaaatacatacaagagctggttctttgataaaaatgatgctactcaaggcaataaaacaatccactactcagattaatcaggcagagagattaaatacaagcaattatgagaaaataggagacagaagcattgaaaatgtataatatgctaattatagggaaagtacataagtaaatgattttctaggaattataatttataattataaaaactttaattacataatcataattaacttattaaaatttaatatttaaaatataattgaattataattttatagaaattattatttctaagaattatacatttttatgtttctaatttataaatatgaataaagaaaaaattatacatgtcaaaaaacaactaagaaatgaagaaaattgtcaaaaagttattccttttaaaacaaacacagaaacaaacaaatatattctagtagtttcactagaaaaattatatgagatttttaaggagaggaaaatgcctatttatcctgtgcagaagagttccaaatagttcatatagcactctaccttctgaagatggagcttagctccttgctccttaagtgtgactggtgcttgtgacttcttccagagtacatttgtacatattaattcatacaaaaaattaaaaggagaaaaagaaaaaagagagtaattttacagtggagcaacctgacaaacactacctcaagccagggcaccaagatcaactcaacagtaagaagtcttgttgacagtgtgtggccttaatatgatgtgatgagaatgagtttacctccatggccttcctctcaaaaacacataatcccagtctaatcatgagaaaaatatcagacaaatttcaattaagggatgccccacaaaacacctgactggtgcgtttcaaaactatcaaggtctttagacattttagactacaaagtatttagaatacattttagaaacaaggtaagtctgagaaagtgtcataccaaagaagagcccaaggagacatgacaactaagtgtaatgtggctccctatatgggattctggaacagaaaaaggacattagttaaaaactaagagatctgaataaactgtggactttagtagttaataatatatcactgcaggtttattaattgcaacaaatgcaccataagatgttaataacaggaaattttgtgtgagatatagaggaactcaacaattctatatatctaaaactgtcctaaaattaaaaatttattaagaaaaatggctatgtacctaaaacatttcagatcacagattgagatggaagcttataacttttaaaaaagaacaaagctagtatagcaaaaaatagcacatacatatgtacataaacaacattttaagctcaactatatatactaaataaaattccagctaaaatgctagcaaaatacatcatgtttttaaattttgtaatagcctattaagaataagaagagatcatcccaataatacgaaggtggtaggctattataattataataaacttacataaacttattcagttgttatcacagtgccttgaggtagactctgttattaatctcatttttcaggcaaaatttgggggccacagagagctcagtaccttgccccagaatacacagctataagtagaccacacaagctggaattggaatgcaggtgtctgattctaggattaaaatacattttataaaacttatgtatccccataaaaatatttaaaagtaggaacagagtagtttaatataattaaaggacatgtcacaccaacaactagcagcatacctagtggtgtaatgtgagaagcagtctcagtaaatgcaaatatagctgaggtgcccattcttaccattcctgctttgtccatttttttgaaaatgctggtgaattaaattacccaggagaatgaaatacgtgttgcaaacggtaaacataatcaactatatttttcattatttgtccataatttgtctttctttattgaatcaaaactcagtgggggaaaagctgatgaatatgataggaaaaagaacagttacacaacaataaaaagtaatttacaaaatttgtgaaggccttaactgaagataactataaaattccacctcggactgagtaaaagaccaatactggtacatgggtaggtatctcttcttgactagaagacaatcctacaaatgtggcaatccttcttaatttaatctgtcatatcaatatgactgatcaaaattccaatgtagattttcatgggtggtgcattggctgggttggggatggggaactaaatgctctcagagttgaaccaaaggtaagagctagaacttagcaagagcattactacacaaaatgaaaccatgctgtccattccaagagcatttgctccctttcaggaaccaagaaaatggcatcttcataccttgtgatcatacattacctctgggatttctctacagggatagtggatgaattcttcccgctgttgtcaaactaatgtatatggactcaaccacagggatatccccagagctcctatggaacactagcaaattttgtgtaagcatagattatagtattaagatgaagtttaaatacttctatgatctaaccatagcctatctttcaagtttcatctctccccagccccagacaagctaatcttccatgtttcctggttataaatggcacttccagctatcccagctgcccaagcagggaacttgggagtcatctccagcagtttcctctctctcactgtccatacccaatcggtcactgctcccagccaattctttctctaaatccacttcttcccattcctattctaatcttctcatcccagagccctgcctaaaaagctctcccctaatgcttgttctgaccaactccacacattcttcaagtctctgagaaatgcttctgagggagccacctcccccattacctcccaggggaacaaaattccactacacacctacagaggaatgtctgctctccctatatttctgcatctcagacagataccaatcttctccttcttccagacttagggagagtgggagaaaagcattctgattgtgatttttcatgcccttttcctctcaggtttttgttcagtccgacatgggctggccctcatcttgcagctctgtaatttttcaatttacacccaacaaatgaacttgagcattgccatcccagctatggtgaacaacacagccccacctagccagcccaatgcctccacagaacggccctccactgactcccagggctactggaatgaaactctaaaagaatttaaagcaatggtaagtttaatgagactctggactctttctttgactcaaataatttgacttaaagagttataaaagagtgagattcatttaaccactaagtatttactgaacatgtactatgtgccaggaatggcacaagtacctaagtatcaggccgagcatggtggctcacacctttagtcccagcactttgggagggtgaggcatctttactaaaaatatgaaaatcagccaggcatggtcataggcacctgtaatcccagctactctggaggctgagacagaagaatctcttgaactggggaggcagaagttgcagtgagcggagatcgtgccactgcactccggtctgggtgacagagtgagattctgtcttaaaaaaaaaaaaaagaaagaaagaaagaaaagaaaggaataaagaacataataagtatctaaggggattgcatccctacttagtgcatatgagtgtaaccagggactaagttagaataaatgaaacattttaccatttagtggacataaattcttcccctacaatgatgaaaatcactacaaaatatgtttcacagatttgtctgctttttcttccttccacgtattttttttttactaccttgcttatgatgctttcttctttatagtctttgtttctttacgaactctcttatattttaatttttggttagttgtgtcagggtgagcggaaagagtatattgggcatatatttagggtttttaaatacatgatactggtatattggaggaactggagaaatgtaaacagaaagataactgccaattaatttttgcctctcaagtcctcacaatgaaaactgtcaatccttcaactaaagacaaacagtaactctctttgtcatctaggcccctgcatatgactggagtcctgaaatccagggaatcatcctcagctccctcaactatggctcattcttggctccaatccccagtggctatgtggctggaatatttggagccaagtatgtggttggtgctggcttgtttatttcctcattcctgaccctcttcattccactggcagctaatgcgggagtggccttgctcattgtcctccggattgtacaaggcatagcccaggtaccaagatgttttccaggtataagtggaatataggttccagaatgacctcagatctccaagaatggaatttttccccccaggttatggtattaactggtcagtattcaatttgggtcaaatgggctcccccactggaaaggagtcaactcaccaccattgctggatcaggtaactggtaccctaaacctcactttacatgcactgtccaggagaactcagcaaagtcctgccaacagaaccaagatcttatatatcaatctctgtgtcttcatagtcctttccttaaagcactaccccatactgccttacttgattgtaactgaataaactgaatgcttactatgtgccaaacattcttgtgttttgcacatattttcatcttatcctcaaaataattttataagtcagctatatataattacttccatttcacacatatggaatttcagacacaaacagactaataacttctccaagatcacatagttaccaagtgaaggaacctagatagtttggcttgaaactcataccttcactcactgtgcaactcagcattgtagaaagcacatagagccccaagacgagtcctctcacccagaacatcctcgcctcttctgttcagggtcaatgctggggtccttcattgttctacttgctggtggtctcctctgccagaccataggatggccttacgtcttctatatctttggtgagtgtgcttttcaaatctccaatttttatgacagagacttctgtgatgcaatttatctatggttaaccaaatcctaatagatatggatatttacatagctaaagctggtagtgttcagagccaactacatttaacatttaagtttcagcagcccgagtgtgtagctagaataatcttatgacattagaggcatcataacattccttactgcttctaaatttgacctaaaggaattcagagcaaattatctcataaaatgttgaaaatactatcttaggctaggcgtggtagctcatgcctgtaatcccagcactttgggaggctgaggcaggtggatcacatgagtccaggagtttgaaaccagcctggccaacatggttaaaccccgtctctactaaaattataaaaattagccgagtgtgatggtgcatgcctgtaatcccagctactcgggaggctgaggtgggagaatcacttgaacccaggaggtggagggtgcagtgagccaagatcacactactgcactccagcctgtgtgacagagtgagaccctgtctcaagagaaaaaaaaaaagaaaatgttattttagtcagattacattttagtcatgctttttaatttaatatattctttaaaatttctccagttattattatggcaaaaaccacaattgcttttgcaccaatctaatatcatagctagaaaattgtgtgactgtgacctaatcataggtaaaatactaattagagtagagaatcaactagtggagactgcaggacagggcagattatgtgaggttcagaagtggacataatacacagagagatgctgcagaaaggttccaaagacacttggaaagttccagaggcagtattttactacgttacagttttaccttcatggagctgtggttggaatctgcctagctgctgttacctttagtttgtttaatatttgaaacattctccaaaatcgcacccctaaattgtttatggtaataccttatagtcccactagtgtgttcattagaggacaggcctgttagatcaagggtttctgtaaaatcaggtgaatatattcaccaaaaataaaatatgtaatgattccatagcatatcaacctttaaagtttttatcatgaaaactttgaaagggcaggttacaaaaattattcaaacaacaagaaaatcttactgtgcttatggtttcaagaaacagtaaggagcatatacacaatagaaactcactaaatatttgttgaataaatattaacatcctccaaccccaatgtgcaacattgctaattttcatatctatccctccgcacttgattatgttccttgatggcaaaattgtgtcttcgccattttatattctcaaaatttagcaaaaagcgtggtgtatagtggctgctgtatgatgtttgtgaaggaatttgtaaatgacatgctagccaaacaaagagagctcataagatttcttaagattctaaaaagggaatttgaagatgggccatatttccactcaatactgataatgttaaattcccaactctgtaataatgtatatattagaaaaaatgtctttgctgaggattcatttcatttcatatctacaaattgggtaattaatttcacataatgtactgctgctcactcttatgtgctttgaggaagataagagatagatatggaaaggtttaatgatgaaaggaactctgcaaagcatgactagcaggagggatgctgactggtacgtgaatggtgagggcattttcaagcacgtggggcaaacacgctactaacttgtaagggtgctatagctttaataatagttcatttcaaaacctcccaaaactcaatggtttaaaacaataatcatttattcccatggttctttgtgggacagctgggtggctccactctctgtgtctgtcatctgccttggtcaatggatgagctggagcatagtcttccaatagcagtgggcaagacccaagaggataagtttaaaaaaatcctttttaatgcctaggcttgaaactcctccatgccattggcaaaagcaagttgtatggccaaggccaaagtcaagtggtgaggaagtaccctcccccatgatagggccatgcaagggatagatgccaggaagagtggtgtactgaggccagtcactctgtcaaccacaggaatcatcttagagtcaaactgaaagaagtacttcaatccatccagtgctaactggatccccttttcctaggaggaattggctgtgcttgttgtcctctctggtttcctctcatttatgatgatcctgtgaatcatccctttatcagtgctggtgagaagagatacattgtgtgttcattggctcagcaggtacattgaggaactcctctgacatttctctatgtccctctagacgtctgagagatgaagaatgtgatagagagagctgccttctgacggaggggacattgatgtgtgctttcttccaggactgttcaccaggctggtctcttcccattagggctatgatcaaatccttaccactctgggccattttagtctcttatttctgtgaatactggcttttttataccattatggcgtacacaccaacgtacatcagctcggtacttcaagccaacctcagagatgtaagtacagagaaagctcattctgatcttctgtttaaatgcttaaataatgagagctcatatataatcctctgtctgtcccatagtcacaaaatcgggggattaggaccaggcaggacctccatataggaaatgcaatctagttaatttggattctgattgatctcaatgtggttcactacttactgcaggaggatgatacatatggttctagtttgattttcatacactatcatattttattatactattttcatatatactattcatatttatcatattttaagggccctgtgcaaaaattttatactcaatcccatcaaaatttgcaaacaagatgctctgctggcagcataaataataaagattaaccaaacaaattctgcctttgagaaaattgtgacagagaaacataaacaacatatgctgaaaataagacattaataggacataaagtcccaaataagacttacatagacatttgcggagtaatgtttgttttaaaaaatcatttttattcaagtataacatagagaaagaaaagtgtgtatatgtgtacagctctctgaattttcacaaaatagacagatactctgaatggctgacaggagcctttcaattcctgctggatggatgtcttaaaagtggctatcagatttcataacatgttagtgacagttcacaaagccagtgttattcttgtactctcactctgtactcaggaagaagccttctcgtattgattgggttcctctggtgaaaatgtgctaagtagccaacagagagctgaccttcttagcagtagtcagcatctgcatgcaagcaggctgcaggcactgagattagaaagccccaggaggcagtggctctgggtcttttcaaagaggaagagggccagaaattaaaccagaaccttaatccaggggattgggacaccacataagcaggagtccagtgctaagcaacagacttcctgaggctggctgttgggaatgatttgtctttggtgtgaggctgggtgggcttgaccctcagaggccaaggctgaggaagaggaaaatgggaaaatgaatggaaagacaagtagtgaccagaaagcagagctttccaggctaaaaagtcaagagacctggattctcattgccttcagggcattttctcacaaagtcacataaccttgacagcctcggcttacgcatctgtaaaatgaactacttgaaccaggtgagtgctgaatcctttccattgtttggattatatacaacagaggagtctccttttcattgcattatattcgatagaattttagtttagaagtttaattgataacaacaaggttcaacattttaaaaactatattgaaacatagagtgggtcaggtgtggtggctcatgcctataatcccaacactttgggaggatgaggcaggtggatcatctgaggtcaggtgtttgagaccagcctggccaacatggtgaaccccctgtctctactaaaactacaaaaaattagccaggtgttgtggcatctgcctgtagtcccagctacttaggaggctgaggcatgagaatcgcttgagctggtgaggtggaggtttcagtgagccgagattatgacattgcactccagcctgggcaacaagagctaaactctgtctaaaaaaaaaatagaaagactgaaaaatctttctttcattactgttcctaatctgccctgtcctcccagcccattccaatgataattctttctatgtcttttttctttttctttctttcttttgagacaacgtctcactgtgttgcccaggctggagtgcagtgtttcactcatggctcactaaagcttcgacctcccaggctcaagcaatcctcctacctcagcctcctgagtagctgggaccacaggcgtgtaccaccatgcctggctaattttttgtggagatgaggtcttgttatattggctaggctggtctcgaactcctgagctcaagtgatcctcccactacagcctcccaaagtgctgggattacaggtgtgagccaccatggctggcctaaatttcctatatatattctttctttgtttctttatgagaatgcaagcatacatgaatgtgtattcttattttcccaacttttaaaatacaaaacagtatacttagtaatatgccgctatgcttatatactaggtttttgccaattaatatgtcatggaaatcttcatatcagtacatgagaaccttgctgagcagtatttggattgtttcccatctttgagcaatgctgcagtgaaaaccttgttcatttctcatacctttgtgcaaccctctgtggagtaaatttctgcatatgagattattgagtcaaagggtaaatgcactataaacttttatatttgttgtcaaattgccctcaatagagcaccagtaatatttgtgagaacctgattctccacagtgttagcacagagcatgccaaaaaaaaatgggtgtttttgccaatttgatccatgaaaaataatatctcaccatagttttactttgtatttctttcattatgagtaaagttggataccttttaacatgtttaggagccacttatttttctttttttcttcttttcttttttaaattgtctgttattaccctttgcctatttttgtactgggttttggtcttttaaatatttatttccaggtgatttttatatataaagagagccttgttcttttttttttgcaagcagagctatgaacatatacatactaaaagtatattggctcattatagtaacatggaatttgtattaaaagtgatgcgtatataaagaaaagccacaaatgtggacagtctgtccaaggttgtctgtgtcgtggtgggggtggtaagggcacatgcacctgacctagtctctggtcctcagagtgggatcctgtctgccttgccgtttgttgttggatgtatctgcattatccttggaggtctactggcagactttcttctctccagaaaaatcctcagactcatcaccatcaggaaactcttcactgccattggtaagggagagactggacacaggggtgaacgtgggaagctcagagcagccttcagtttactctgtgtttgtcctcctaccccaggggttctcttcccatccgtgatcctcgtgtccctgccctgggtcagatccagccacagcatgaccatgaccttcttggtgctgtcttctgccatcagcagcttctgtgaatcaggagcccttgttaacttcttggatattgctcctcggtagggacctcttttgcctcatcctttcagacactcaattcaagtctagcagccctaaatctactctgatgtgaaagtaaaatgtggcaggtacaacaggttgcaggaaatgtcagcaccagctctacatcctacatctaaataattcctggaagagactcaaagctggtggaccattgtgaacttagtttttctgggcgtgaacaagaggagtcagtggccatgctcagagtcaactgagggagactcacacaaacctctctctgttgaggaatgcagcacttgcctaaggcggaatcactgaaagaattcttgagattctatagggtatgctcatgaaaatctttaatgaaggcaaaggacacaggactgcaggagaaatatctgtctctgatacagtaaaaacagttgactgagacttccaaacatagctcccagggtgctgtcccagtcaacaggacatccttcatcttcagataatgaaccaccaagaaatgtgagagatgcccttgtcacaggggagccgacgtctcatctggtgaggggtcttttatacccacggagggtataaaagttacaagatcagactcaacagcagaagccaaaacaacaacaacaacaacaacaacaacaacaacaaaaaccttacaaaccaggtgcagaccatcaatctgaccatcttgcataaacaatgttgacaagttaatagaggttacccccttgggagtaccagtccctagcacaggattatactaatcattggtcagtacatttcattcaggtttcaccaaggcttacacaattccagtcatctccagaggtaagcacagagttgcagcagaccagctgatattaaccttttgtttgcacaggaatatttgcctccctctcccgggtattgagactttcaaacgtaggtatacttggttataatagagtaccatctctctctctcaggtacactggctttctcaaaggactattgcaagtctttgcacacatagctggagccatctctcctactgctgctggatttttcatcagtcaggtgaggtcaaatgttctgatgaatattcataaaagaaacctatagaggcatggttttttcacatatgcacggccttgtatcctagaagatgcttttaaagtagtcaaaaataaactaatttacatgatgacttaagaattaaagaaacttaagattcttaagtttcctaagaatcttactggtataaactttacatgaataaagaagtatgtggcattcttattttctgccatatacttcatttactggaaaaaaacactgccatataccattcacttactggtgaaaaaccacaggaaagttaaagaatgactttcctgtggtttttcactggtaaatcagaaaaataaatgaagaataacaaagaaagagtattctttatgaaatcaagtcccttctcttttcttgaagcttcagttccctcccaggcactagcatactgtcaggaaatggttgtttaaaatggaaattctcaaactgctcttgtttctcctgtcattcaatgacttattcattcattcattcaataaatattaaacagtagtatgtgctacgtgctatttaagtgaatgaaacacaattccttcccttgtgaaacctatattgtagaaaagaaacagaaagaaatctatggaagtaaaatatatgacatattgaatggtaacaggagaatagcaaatgcttagcaaatgctaagaggagaataaagcacaaggggtggaatttctaactacaatgatcaaggaaggactcaccgtaatcacttgcttaaaaagaacacttaagcaaggactgaaagggagtgaagatgtgagacaaataggtatctggaggaggagcgttccagccaaggaaatgcccagtgctttggactcatggcagaaatgtacttgagtattctaggaccaactgggaagcccatggaagccagagtggaggtcggggagggagcaggaggacacagagccaaagcctttctgaaccaagagggacaggaattgggtgaccgttaataacttgtaattttctgcctccaggattcagagtttggttggagaaatgtcttcttgctttcagctgctgttaacatatcgggcctggttttctacctcatctttggccgagcagatgtgcaggactgggctaaagagcagacattcacccacctctgagcaaaccgagagatgtgctagatcctggtgcttagttcatcattgttttccctcacagacatttctctttcatgcctgcttgactgataagccattagctagaccctgactatgtaacgctaaagattttaccatgcctggaaattttacaggggaagaaaacacgctagttatttaactgcaagctactaaaagcataggtgtgttgagatttctgtgttctccactcttccactgttatcctagtaaaagcatcaggggctggggacaatttctttccaaagcaaaagaggaagccagaccttgggaccgagaactgagaatcacaagggagttgcgcccaacatgcagaacatgaatcctctgagctgtcctcaaaagaaagccccaaacaacagaaagcatagtgttttccattgttggtgaaaaatgtcaaggaggaaagaacaataatgattccatcatgataagaggaatgaacgtgtctgcaactaatgggagcaagatagtacactttaactctttcagacaacttgcattctgtggatgccagctttggaatcagagccgcctctggaatacctgtgcttccagagttagcttttggacagttaccttctttctggccatcttgacttctgccccacatctgctttttggctttgtgcagatctttaacatgttagtgaacagacattgcccagtgtctcttctagcccctccaacagttcttcatgtagcactgcttttggacagtgacccatgatatctgccttcgtttgcccctctgactgttggaatcccacgcaccattcagtaggattcaattcaatgtggaaccattcaacattcacctcattaacctaaaatgtctcccaaagatgtatgtaagacacacactgccctaacctcactccaaatgtctggagaaatgtgtgtagtgcttttgttaaagcccctatatgggcagcatggaggatcataagatagcaaaaccatttcaacactaaatgaatattaatgtacacacaccttgtgtggatggcagaaatcaaatcatacacagtattaaggagttcagtgtctcgggagggcagataactttaatcaaagtatcacacaagtgaatatgtaataacaactgtagaaataatgagtggttacatgggttatgagagtggatgataagtgcactaatctgagtgtaaggaagggccacccctgcaaagtttcagctgagctgggatctgaaggataatagttaactgttgtgggagactgagaggagaatattttaggaagaaagaacagcataagcaaaagtttcatggcaggagggagaaattagctatggccagagtatagagaataagggaagtatgatttgtgaggaggctgtagaagaattaaggtcaggagcacacaggatgatgtaggcccagtgaagtgcgttggtctttattttgaaatcagtaggaagtgtcctggttttcaaaggcactctgcatgagagattaggttggagtaggagcttacagtgtagtccaggagagaacaatggcccctggcatgaggcaatagacatggtgagaggtgaatggattatttgatttaggtggattatttgatttagggaataaacctgacgggtcctattactaagtgagagagtgaaagatgtccagagtaactcctgagttttggtttgctattatattaatggggatgcctctaacacagacagcaacacagatagcaattatatccaagtgtagacaacaagaaggaaaatggacacatgactctggatttctcttgtgagacctgggctccatttacaaacgtataaatcatcttgatataggtagtgattacaatttttgcatggatgagtcatccatgggtgaaagtggcataagaaaaggaagcttgggaataagccttaaagaattccagtatttaatggtcagctggaggatgattagcagaaagaaagaaagaaagaaagaaagaaaagaaagagagagagagagagagaaagaaagaaacaaagaaagaaagaaagagaggaaagaaaaacaaaagaaagaaagaaagaaaaagaaagggcctgaaagatagaaggaaaatcaagagaatatggtgctaagaaagggaagggaagagagaatgtttccaaaaaaagtgagtagttaccaatgccaaatttgcagtgatctgtccagatgagaagtgagcagaaagtacagaaaggagaccactgctgagaagtttgggtatgaaagggtggtgtctttgtcgcttttgtgttgctataaaggaatgcctgaggctgggtaacttatgaagaaaaagaggtttatttggattgtgattgtgatggctggaaagttcaagattgggcatctgcatctggcgagggcctcaggcaacttctgctcatagtggaaagtgaaggagtgtaggcctgtacagaaagcacatggtgagacaggaagctgggagggggagaggaggtgccaggtttttttaaaacaagcagctcttgtaggaatgatctcactcacccctgaggaagagctttaatgtcactagggattcacccttatgacacaaacacctcctgcaagtggacccaacattgggatcaaatttcaatattagatttggagggaacagacatctaaaccatagcagaaggaaagaggcaagaaagtagctgcaaaagcatatgggctcgaagaaggagttgaaaacaaacatgtttaagattgtgagaaggtgctagctgacagagaaaagtcgcatatgcaaaaaacacaaagcactaatggaaagttcctgagaaggttgtgacaagggaggaattttgtgacttgaagcccagttaggagaatgatgagagatggtgtgaggacagctcctgccttttcacctgacagcccaagatggtgtcttcatctgctagtgcaagatctagggagggtcttatttttatatctttcttcctacttggaagggagg

SEQ ID NO: 12488 - DNA, 38371 bp, Human; identical to SEQ ID NO: 12061
  misc_feature (1)...(38371): n = A,T,C or G

SEQ ID NO: 12489 - DNA, 22914 bp, Human
agttgtgatgtacaatgaaaagtggattttatatgataactggcaatgaccagctcagtggctggtctgagaagaagctccaaagcacttcccaaagccaaacttgcaccgaaaaaaggtcatggtcactgtttggtggtctctgctggtctgatccactacatctttctgaatcccggtgaaaccattatatctgagaagtatgctcagcaaatcaatgagttgcaccgaatagtacaacacctgcagctggcattaatcaacagaaaaagcccaattgtccatgacagcacctaaccacatgtcacacaaccaatgcttcaaaagttggaataaattgggctacgaacttttgcctcatctgccatattcacctgacctctcatcaaccgactaccacttcttcaatcatcttaacaactttttgcagggaaaatccttccacaaccagcaggatgcagaaaatgctttccaagagttcatcgaatcttgaagcatgaatgtgtatgctacaggaataaacaaacttatttttcattggcaaaaatgtcttcattgcaatggttcctattttgattaataaagatgtgtttgaggctgggcgcggtggctcatgcctgtaatcccagcactttgggaggctgaggcaggtggatcatgaggtcaggagatcgagaccatcctggccaacatggtgaaaccctgtctctactaaaaatacaaaaatttgccaggtgtggtggcgtgcacctgtagtcccagctactcaggaggctgaggcaggagaattgcttgaacctgggaggcagaggttgtagtgagctgagatcctgccactgcactccagcctgggcgacagagtgagactccatctcagaaaaaaaaaaatgtgtttgagcctagttataatgatttaaaattcatggtccgacaccgcaattacttttgcaccaacctaattgatgtctaagtaggtcatattctacctgcaaaaagaaaatttcatctatccctttcacatagatggaaacccactatctccagtggacagttaacaccaaaggcatcacagagaactcatggagctcagctgaggaggtttcagggatttttctatttccttttcttgattatgagagtctgggactagatgctctccagacctgtgcctaaagactcttcaaccctttgagatggagatgagggagggaatagggaacccagtttagtttggatttcagatccttttgtggttcataagcgtgatgattgggtttccatgttcacgtgtgagatatgcctccctcaaaccttgttacaatgacatgggcaccttacctatctgacatgagaaaaacaaacgtggatttcagataaacaaaaaataactcttttagtgtatatgtcccatagaatatgtggacatatttatcctaaaaatattgtatgggacatagttgtattaagaaactgttcattgtttatctgaagttcaaatttaactgggcatcctcctcagctgagctccatgagttctctgtgatgcctttggtgttaactgtccactggagatagtgggtttccatctatgtgaaagggatagatgaaattttctttttgcaggtagaatatgacctacttagacatcagttaggttggtgcaaaagtaattgtggtgtcggaccatgaattttaaatcattataactaggctcatgtcatattttatgtgacatggcaatcctatggaggagggaccaacatttaaaataaatggcttccctaggatagagcactgggactggggaaaacagaggccacagtcagctgtgactttttgaaggaaggaataaagttggtttctttcatgccaatttagcaattacagacgaccccgtcagaaatctaaacccgtgactatcatgggactcaaaaccaggaaaaaaaataagtcaaaacgattaagagccagagaagcagtcttcatacacgcggccagccagcagacagaggactctcattaaggaaggtaagagcgttgccttctcgccataatcatagtcctcttctcccagaataggatttgggaaattctggctaagtcctctgcctaccctcattgccccgctgatgtgtgacatcaacagaatttctccgcaacgtttgtcagtctccaacctcagagggctcacaaagcctcctcctgaatcctctctcagtcctccaacactaccaagaagaaaagcaattattcaggatggcatcttgctggggagaagcagcctccctgaggtagatgtgttctcctgtcacttaaagaaccacttctcctggtctgagtagtaagaggcgcatttgctgttgctgcaccatttgccaaggctctgagtttgaggtatgggatgtattaaaacaatttaatgaagaattaagattccattctgtcattttgaacacagggttcagtcctatattattcacttgagaggactggtgagtttgactttcatttcttttttacaactgggaagggcaaattacacataaaatgtcccagtggaaaggggtcatgtgtcgaaatccccactcttctgtctcacctctccctgttgttttaaactggggctcattaatataattctatggggatcacacctttgaaattcatgaggacagtaagagagcagaaaaatacacaataataaggaaaggagcttccattattggtttttaatgagcgtacttgaattacggccactgcagtttatggatattttttgttgttcatttgtatgtgttatagttagaaaaaaaaagaatcctagccaagggacttgaaccagagagaagcagaaattgacttaagtaggaagggaaacacattgttagataaagtcaggtcctgggcttcctcggcttgttttgggtggagtgcctggggacaggctgaagcccctgtgtggggtggtttcctttgctgaaaagctgggctggaagatgttgtgctcagtgctcaacctcatgcaccctcgcgaggcacaggcaacgggtgctctgggaaacacacgttatgtatcatagcctctgtttgtctgtgggattgatatccaataataactttggagaaaaataactcctcttattttgttagccacagccctgggccagggaaggtggagaatcagtgaaaatgcattttgtttgtttctctagaagtttatggtgcagagtcaaattgaaggcaaatgaggaatattttttcaccaaataataactcaacttgcaagtcttttttgcttttgtttgtagtttcttctttgaacttaattttcagttagtaggaggggttagaaacctgagctattgctaaagcccttgatatgaatgaaagaagcaggtgcaaatcccctcacagagagaaaccaaagggtcctggctatggatattggtcacctagtgaggatgctgttgtgggtctttatgagatgatgaatagggtggctttggatgcattaatgatgcccacatgctccttctgttaggtgtcctgtgccctgaccctacaagatgccaagagaagatgctcacttcatctatggttaccccaagaaggggcacggccactcttacaccacggctgaagagtaagttcaaaaccagacccagcagggcttccagtttgccgtttgctgacacagcctgctgacttccaccagtacatgcctgctcgtaaatctccctagtgtttatctccccagacagtaacatccctggcaacaaggggaggagattctgtgcttctataaggggctcagtcaagcttctctgaggccaaacaggcaggaagatgggaatggtataaggttggatcttgccatttttgggtgcacttttgactattgggtcttatctgtaggttcccaagtggaaaaacatctgttcaggatcacaatgcctctctcctcaatccttgttctgtctcctccactcaaattcctgaaggtggtttgcagacagaataaaagtgagttgccaaggagccagtaaggatgacgggcaggtgtgtgtgactcagcccacagccagactcgagaggaagatggaggtcacagcctttgcagtataactttatcctaaggaaagacattgggttttatgagtgaattaaaaataagtatttatatgattaagcatttctaaatgctaagcattgtatactggcgtgagacactgtttttatctttgaaaaaactcacaacttagtgggagagttaggcatgagattaatttcagcaaatgtaagtgcggtaatgaaaacccagaggctgcagggacatactctgtatgtgctgggagtgggaaagggacatactctgtacgtgctgggtggcaggggcaggggaggccccaccctctgcgtgggactctaacaggacaacaccctcttatgtggtctgtccagaactccctgtgaacctgctctttctttggaaagagctgttgaacaatctttgttaacagtcaaccgcagggaccagcaagatgtaaagcccaacaaaggcactgaggaagagttcaggcagacagcatttcctcagaagaccctggtataggatcctctaatatccctggccaattggagatgagggcggcggtatcctctcagaaaatgtcctgacagcaaaaacatactccttgagggaggggagcccattgcccgtgctattagttagggtatcgtttcagcttgtgtataatcactcaacagactctttaaaatatacttttatgtctcgtgtaaaaattcaagagtaaagagttcaaggcctgttcgttttcttcttgctggttactcccttgggatgtcacttttgtccccatggctgaagatgttgtgccatcacctccacatcttgccaacagaaagcaggaggtgaaggagaggctaggaccgttcctttcaaggggcacacgtcacttctgcttattgctccacccccgccccccgccccgtggcacccaccctggtgggtatcattcttgctgtgttgtaaatgaagaaaggtttagagaaattaggaaatgtgtggccagacatggtggcgctgggatttaaatccaggtctgtttgcctccagagtccatgctcttaagtgttatgctgcaggccagcagaggcaaatatttgcacaatcccatccgacgagaggctagggcagaggtcagtatctctcagtgtgaagctggaggctgatgctagtcagctcagtaggccgaaagtggagttgtcctttgccatgtagggccatcatgcccagctggggaacctcatagccaggtgtacccacaacctgaacaaggtaactttcagggtctagtcaggaagaaaccaactagatggttcaacatagagactttaatataagaagctggttaaacaggcatgggactgagactgaggaggcaaagaaggcatcggggcaaccaaggctgtacccacagaatgctgcttctacccccgtgtctggggtaacaaacggaagggtgaggccatcaggacctagagttgggaggagggacgccacagaaatgggacccagatctctaaggagagatttttgtttggctggttctggtgtctcaagagcttagaagtgaggggcatgaatcaaatactcaggcctctgaggtcagccagtgctctgctggggaggggcataatgaagctggctctgacaatgccggaaaacgagctggtgcttggcatatacagacaatgtgagcattgctggggtgatcctgacaggagccagaagcacactggaaggagctgctccttcttgatgccccaggtttgtaggcaccctctagagtactctaatgggagccagtgggcaaaggagaagtggcatttgcagagtccagtcccagcatcacagagcagagcatagaaaggtaggtttggagttgagggacaatggcttaataaagggcaaagggggttatgaccactatcatgtgaaggaaccccttgactgaaggcacaagctttctgtgtcttgcaacctgaatgacgtgcataagcagggtcaggtgggttatctgacattttccttgagaacaagagggagcctctggattccagcacaaaagaaaaatacccactcaacccgtatgcgtgggagctatcctttaaagagaaagtaattccttttgacattttgctgtctgtagaagggtcagatggccaaagcttccagcacaatgaaacacttaacttcagtctgtgagtgtaggaacccctgaatacatggaacatcatcatcttgtgcaggtactgaaggagatcggtccagaaaataagtaactgcacatggccaccaatgtcaaaagtcattcctctcatgaaaagtccctgcccccattgctgtttgtttaaataggtgggatggaggtaggggaatggggccatcttctttttttttttttaatttttttgcataaaatccagatcctgcacaatggggcaatcttcattaaaacaatgcatccctaagatctgagaatatttatccttctcacaattgtgccagcaggtggaatgaagaagaatgatgcaaaataagttcccacatccagccaagaaggactacatacctgctttgggtattatgtatccctttgaaacctcagtggagagcagttctcacagttgggtggacacaagtcatccatggaacttgttaaaatgcagatttctaggtgctgccacctaagaggctgattgggtaggccaggggtggagtcctatgatctgcaccttaacgtgcatctcaggtgattctgctgcaggtggtatttggaagacactctgaggcgccctgccaagctgggcagtgggttcttccaatgtgtcaggcataccctggtgcttttcgctctcagtcacttgggcatgttgtgagtaccacgtgaccatgcataaagtgctgtaacagagctctgtctgtgtcaagatattcaagtggacgccacagggtaaaatgagagcacaggcatgttgggagttgaatcagctgccttcagtcacgagaacacactgaacactccttgtgacagcttcagttcaggaaagagtgactctgcaggaaaagcactggcctgggagacctggatctggcccaaattctggtgctcacttgcttggtctcccgttccagttgctgtgaatgttggttctgccacttgctggttgtgcagccctgggcacttgaccagcataatgtcagctgtaaaatgaacatcattcctaactccgaggactgtggttaggatgaaataaaagcatatatgtgggggtgcctagcccagtgcctggcacaaattggtgctcaatgaatggtagtcactatggttatggtaatgttgatgaatcttcataggtctcagcttcctgatctataaagcgggtggactgacctacataagtcagagtttccatctagcactgtcatcccatggttcgctctatcctgtttggagacggacaggataagcttgatgtctcctcagccttgagacagaagttgtccagtagatggtactgagcaaaagtctctccagcagaagccttagttaaaccttgcttctcctgtagctgctcagtctcttgtaagtcactcagctctgcagaaactttcttagcgagttgacaaccacagataacagagtcagttctgtcgattttgatcatgctgtgatcaggcagatgttagctaattgatgatgcttgcccggagtgaacagctccaggccctgtttccagggtctttgtggtaactttgtggtaactgtaatgcttcccaggggtcactgaacacagggcccaagaggctggtgtagacccccagattggcaccctgctgcttagacaagatccttctcaataagtaatgccacagctttgctgtaggttcagcccagacacttctccctagggctgcaaggagcaaagcggggagtttagggaagggagggcacgaacataattgagacggattcaggttcaaatccagcctctgttttgtgctagctctgtatgatcaccagcgagtcatgtatcctctgccttttatttcctcttctgtgaaaataggggatgataaattgtgtctaccctccagtgttgatgtgagaattgaataagctaatgaatgtttagcacagcacctggcttttagtagatgagtcagtgttaatttctattttctctttgtgggctgagttggagaaaatgttttaaaacagcctgatgagaagaaaagataatttagccccaataaatacattgtccacataaagaccagttactatggcacttctcatacctggaacttgggtgcctgggccatgccaattagcagagttcctgtgggcacacacttgagaggctcctaaagacctgggttagatccaggtgctggaggcctggtggggtgcccagtgtgggaggtgggaaactacttggacactgggagatgctgctctgggtcgtcaaagtccatatgaagaggaagactgatttatgcttcatcataatgtagaacaatgtttcaatgacaaagtggatttgtctatctcttgggccagggccgctgggatcggcatcctgacagtgatcctgggagtcttactgctcatcggctgttggtattgtagaagacgaaatggatacagagccttgatggttggtaaagttcccactgctgaaatccctccaagtccagggccctctttccagttctttcctctgaatctctggagagtcagataattgcctcattataaccttcagctctgattccggcttctgatgcctcttttgctacattgtactttggcaactctacctttgcctctgctcaggcatgaacctcaaccaggaacttgccctgtgtcttagtctgtgattataacataatacgagagactgtaatttataaataaatgaaattcatttggtttacagttgggaggctgggaactccaagatctaggggccacacctggtgaggacttcttgctgtgtcatatcatagtggaaggcatcacatgggcaagggagtgagagagcaagagggagctgaactcattttttttttttcttgaaacaggaaatcctgggatggagcgcagtggtgatcatgagtcactgtagccttgacctcctgggctcaagccatcctcctgtctcagcctccagagtagctgggaccacaggcacgtgccaccacaccggctaattaaaaaaaaacttttttttgtagagacgaggtcccactatgttgcccaggctggtctcaaactcctgggctaaagtgatcctgcctcggcctcccaaagtgttgggactacaagtgtgaaacactccacatatggcccaaactcacttttataaccaacctacttttgcaataacaaacacactcctgcaataacaacattaatccattcatgaggacagagcccttgtaacttaatcacctcttaaaagtcctacctcttaccattgttgcattggggattaggtttccaatacacgaattttgggggacacattcaaactatagcacctgtctctttggttctactcatagcagacttgggtacctggatgttgtgtgtagctaagcactgacggtttatagggcacaggggaaggggtttgaggttcccttatagcaaacaggagtatattagacacctcaggttttaccacttctgggaattcttgctggttctgttactccactttgtgacctgctcttcctacttttcttcttcacccctttcctcactggttacctgtgaattccaagttcttctgactctacactaagcatcccaggatatcatcagtgcgatgaggaaaccatccttcctgcatcagcacaaagggtcacttgtgtgttttttaacaggctgcatccttcttagatggccaaaggttttaatagtatttttttcttctttacccaaatatgcaggaagctaacacaattacacaatccaatcttctggtaccagtatcctccatgaatgggaaacatcaactgagtttataagctataaaaattacaggtttcagcaatcttgcttaaagccaggtagcacttcagcacttcagcacccgaaggcattctccatagatctcgctgtctctctttcttgttattacagatctgaaagcttttcaggttgatgcataatggaaaaaaagtatctttccaaaagatgttggaaagtcccattcctcattcagcaagcacttcatttagaggaaaaggtcctgtgaaagagaggagggttggtgtggggtggggattgaagcttggcaagctgataaggagaaggtgagagatacaactctggattctttccctctttgccaagaaacttgggcagtctcatgtctcatgtctcctgttccccaatgtctttccagagcataaatacaaatacaaaccatcaaaggcaagtcaagtctgggggctgacacacccaccgagcatagccctctagtgtgctgacatctagtgggaaggaggaggagttgatgaatctgaacaagactccaatattggaggaaatacttgaggaaagccttgggttagaaagttagggatagaattcctgctcatacggctgtccacaacaggttagtaggggaggactttaatctctgccatagaactccatttgtaactctagcatggggttatgacattgccttgtaattggctatttactttttgcctcttcgacccctccgctttcccctacgtatgaaccacaacagagaatatttctaactcatcttcatatctccagtgcctagcacagtgcctggcacatggtagtcactcaattgtgttgcattaggacttggtcccattgtctgccattgagttgcttggagactagaattcaacttctccaagattcactagctctattttacacccagacatgttggaaatctgtgatgtaacacaatgtatatccatttttatttaatacatattttcttctatattttgatttcattatatatttgtatatcaaaaacaaaatgtttagtctttcaagaagtaaagctatacaaactcaatatgttggtactcatttcctaactataattattagtttgatcctattgaacacaaatgcagtaatttttcttttctgcttcaatgctctcatcttaaattcatttaattgaaaaataacagagagtcttaatgtcatgtgctcagacactgtgaacattttgcttggtaagtttcaaattcaaactctatgcctccattcctctaggattagatcagtggtttgtagtttctgagactttttattgagagggaatcgtgtttaaatttcctggtttatttaatttccatatttattttttaaattaatattaaaatcttattttgagattttcatatatctagaaaagtcagtttggagatcagcagtctaataagtttaggcaaaattatgtaaaatagtgcattaagtattgcatttaattacataattacctccctttctgtcttcagtgattctattttcattttaaagcaaagggatgtaaatgacattaaatatgagctttgggcatgtgaattactccacctttaacaatcttcattaagcttgaaatgtctacttttcaacttccatttgtccacagagaggctggttggaatttagatctcttaaaatttctcccttggttaacaattcccctgagccctggaaaacatcttttgaaaggaaaggctgctttttgtagcaacaggaagtgggaaatgatttgtaataaactgaacagtggtttttatattaaccagttttacatcttcacttggaagttcaaggacaaaatacttttgattcttggagaatttcatggcccttgctctcagctcagtttacactcatgtgtcagggcactgtgtttttcaatgcatggtcagtggtcacctgcactggaatactttggggttcttgctaaaaggcagattctgggatcatctctggtggtgggattcaggaatctatattttaaaatgtacacccagttttaatgtaaatacagagaactggcagtgaaccggtagagtggatcatactcttaacctatggtgagtgagaggcttaaaaaaaaaagaaaaagaaaaaaatggtaattgacaagggcagttttatttttttttcccaatcagtacaccttttatatccttttccagtttattgcattagttatttgcaacttccagtatgatgctgaaaaggagtggtgagacaggacatccttgccttgttcctgatcttagcagaaaagcttcaagtatgatgttaactgttgattttttgtacctagatattcttcagcaaacttgagtaagtttccctttatccctcgtttattgagagttttaaattatgaatgggtgtttgattttgtcaaatgctttttctacatctattgatacaatcttgcaaatttcttctttagtctattgatgtatcagaataattcatttctctttttctttttttttgagatggggtctcattctgtcacccaggctggagtgcagtggctcaatctcagcttactgtaaccttcacctcccaggctcaggtgatcctcccaccccagccttccaagtagctgggaccacaggtgtaagccaccacgcctggctaaatttttttgtattttcggtagagatggggtttcaccatgttgcccaggctggtctcaaactcctgagcacaagcaatccacctgcctcagcctcccaaagtgctgggattacaggcgtgagccaccacgcctggcctgatttctcaatattgaaccaggtttgcatacctgggataaatcctattttgtcatggtatgtaattccttttatacattgttagtttgacttgctaatattttgttgagattttttgcatctgtattcatgagtgatattgagctgtagttttctctttttgcaatatctgtctggtattagggtaatgctggcctcatagcaatgagttacaaagtattccctttgcttctatcttctgaaagaggttatagagaattggtataatatctttcttaaatgtttggtagaactcaccactgaactcatctgggtctggtgctttctgttttggaaagttattattgattcaatttttataatagatataaatctcttcagatggtctagttcttcttgcgtggattttgacagattgtgtctttcaaagaattgttacattcacctaggttttcaaatttgtgagcatagttcatagtattccttgcttatccttttcatgtccattattatttctgataatagtagtttgtgcctttttatttcttagcctagctaaaggcttatcaattttattgatcttttcccagaatcagcatttggtttcattgatttactctactgacttttttttctttctttctttccttttttttttctagagacagggtctcattctgtcatccagactggagtgcagtggcacaatcatagctcactgttaccttgaactcctgggctcaagcactccaatcctcctggctcagcctcctgagtagctaggactacagctagctaccatagtagctaggattatagcatgtgcctccaggtctgattaattttcttttttttttttttaatttgtagagacagagtctcactatgttgctctggttggtctcaaactcctggcttcaagcagtcctcctgccttgccctcccaaagtactggcattataggcatgagccattgtgctctgctgatttcttgttttcaatttcattgatttctgctctaatttttatttttccgcttactttggatttaatttgctgttctctttattttcctaaggtgaaagcttagatgactgattttagatctttcttcttctctaatatacacattcaatgtcatacatttccctctaaatactgcttgcactgctaagcagtatcccacaaattctgatatcatattttaatttcatttaattcaaaatatatttaaatttctcctgagatttctcctttgactcatgtgttatgtagaagtgtgttgtttaatctccaagtgttgggaatttttcagttatctttctgtattgatttctgctttaattctattatagtctaagtgcaaacatggtataatttctattcttttaaatttgttaagatgtgttttgtggcccagaatgtggtttatcctggttaatgttctgagcttgagaagaaagtgtattctgttgtcgttggatgaagtagcctacagatgtctattatatctagttaatcgaagattttgttgagttccactctgtcacagtatataattccttttatatattgttaggtttgatttgctaatatgttgttgagtttttttgcatctatatttatgagagataacgaattgtcattttcttttcttgtaatatctttgtttttgatattagggtaatgttggcctcatacaatgagttagtccttactgattttttacctgctggctttgtgttatttctgatagagagatgttgaagcctccaactgtaactccaacttcatagtggatgcaactatttttccttgcagttctatcagtttttatctcatgtattttgatgctgtgttcttaggtacatgcaatgttaggtgttcttatgtcttcttggagaatgaacacctttatcgttatgtaatatccctctttatccctgataactttccttgaaatctccttctgaaactaatataggaactcctactttcttttcattagtgttagcatggtatatctttttctatgcacttacttttttttttttgagacagagtctcgctgtgtcacctagactggagtgcagtggtgtgatctcagctcactgcaacctccacttcctgggttcaagtgattctcctgcctcagcctcccaagtagctggtattacaggtgtgcgccaccaagcctggctaagttttgtatttttagcagagatggggtttcaccatgttgcccaggctggtcttgaactcctgagctcaggcaatccgcctgccttggtctcccaaagtgcttgggattacaggtgtgagccaccatgcctggcctctatccacttacttttaatgtacatgtatgtgtctttatatttaaagagggtttcttgtagagaacacatagttgggtcttgtttgttgatccactctgacaatctgtcttttaattggtgcatttagaccattgatattcaaagtagttattgatatagttggattgatatctaccatattgttactgttttctacctgttgcctctgttctttgtttctatttttgtctttactctttttctgccttttgtgattttcactggacattttatatgattccattttctctcctttcttggcatatcagttatacttttttctttttgagacagaatctcactcactctgtcgcccaggctggagtgcagtggcacgatctcagctcactgccacctctgcctcccaggttcaagtgattctcctgtctcagcctcctgagtagctgagattaaaggtgcatactactatgctcatctaatttttgtatttttagtagagacggggtttcatcatgttggccaggctggaactcgacctcaagtgatccacccacttggcctcccaaagtgctaggattacaggcgtgagccaccgcgcccagtccagttacacttctttttttttttttttgagacggagtctcactccgttgcccaggctggagtgcagtggtatgatctgggctcactgcaagctctgcctcctgggttcatgccattctcctgactcagcctcccaagtagctgggactacaggtgcccgctaccatgcctggctaattttttgtatttatagtagagatgtcatttcactgtgttagccaggatggtctcaatctcctgacctcgtgatccacacgccttgacctcccaaagtgctgcgattacaggtgtgagccaccgtgcccggccttatacttcttttttactttttttcagtggtttccctagagtttgcaacatacatttacaactaattcaaatccactttcaaataacactataccatttcataggcattatgagtatcttaaaataatcctaattccttcctcctgtaaactaaaaacaaaatcctaaatcctccaaacaactgaatggaccccctcttcaccaaggggaccccagggaaacctgaaaaactgagtgttggccatgacgggaagggaggtgagagatgcctcattatactccctcccttttagagttttaggtacaactgaccagcattaattttaaaatagagattacaggactgacagaatgaactctttgtggcaatatcaaattaggaacaagacaatgcaaggaaagggttaaatcatgcccttcaaaccataaaaaaatttttttttaattaaccccatataatgtggtatactttccaaactgactctggtatagcatcacatgacagattgcagactcccttaccttaagcattcctttatactgacttcaagtcttaagacagagctgaactctttcaaccagctgctaactaaagaatacctaaaacccacctgtgacttgtaagtctctgctttgccatgtcctgccttttcaggctgacccaatgtataccttccgtgtattgatttatgatttttacctacaattcctgtcttcctgaaacatataaaaccaaatcataacccaaccacctcaggcacactttctcaggacctcttgagactattctcccggccatggtcattcatatcggcacagaataaacctctttaaaatattttgcagtttttttctttctgttaacattcctttcccttgtatcattgctgttattaatttcaagtatatataagcatacctaattaaatacattgttgctattattcatttttgaacaaactattatctgttaaatcaactaagaataagacaaatatgttgggtgcagtggtgcatgcctatagtctcagctactcagaggctgaggcaggaggattgcttgagctcaggagtttaagaccagcctaggcaacttagcaagatcatgtctcttaaaaaaaaaaaaagaaagaaagaaaaacaaagttttaggaggctgaggcaggagtatcacttgaacccaggacgcagaggttgcagtgagccgagatcgtgccattatactccagcctgggcaacagagtgagactctgtctcaaaaaaaaaaaaagaaaagaaaagaaaagaaaaaaaaagtttttattttaccttcacttattccttcttggatgttcttcctttatgtaggtacaaggttctgacctatgttattttctttttctctaaagaacttcaaaagtttcctgcaaggcaggtctactggcaatgaattccctcaatttttgcttgacaaagtctttatttctgcttcactattgatggataatttcacaagagtgttccttttgtagattcactcttcttatccttcccttcagaaatattctttgaccaactattgggtcccaggtactgcactagagctttacttctagttaattcccacagcaattctgagaggtaggtaggtattatattcctagatgcaaactcagaattcagaaggtaaagtgatgagactgaaggcacacagcaagtaagtggcagaacctagattaaaactcattcttaaaactttggcttccttctcttttctttaatggattcagttacttcttctcacccactcacctttatcaatttacatttcaggataaaagtcttcatgttggcactcaatgtgccttaacaagaagatgcccacaagaagggtttgatcatcgggacagcaaagtgtctcttcaagagaaaaactgtgaacctgtggtaggttaagatccttcataagggtattttcatgaatggctgtttttaactcaagtgaatacaattatttccatttaaaaagcaaggacaatgtgaatgtactcattgccactgaactatatacacctaaaaatggttaaaatggcaacttttatgtgtattttatgagaataaaaaataaataataataaaaaacaagggaagtacagatattttcttaattgtgttgtcacatacccagtgtttccagggtcaataatgagagccctacatgtaagattcaaaggaagaatttagtcctggatacaatattcttttatgtttttagttatatttgcctttttaatggatgcagatatatacagagggaagggataaagtacctattatttattgtatagagctgtgctgtctgatggcttagccactagtcacatggtgctattgaacacttaaaacacaggagtttgaaataagatgtattataatacatatcatatttcaaaaatattagtatgtagaaaagaagataaatggttcattaatgatttttatattgattcaccttgaaataaatattctgaaaatattaggttaaacaaaatattttaagattaattttacatgtttcttcttttaaatgtagctactagaaattttaaaattacatatggctgggcatggtggctcacacctgtaatcccagcacttcgggaggccgaggtgggtggatcacctgatctcaggagctcgagaccagcctggcaaacatggtgaaatcctatctttactaaaaatacaaaaattagccaagcgtggtggtgcatgcctgtaatcccagctacttgggacgctgaggcaggagaatcacttgaacccgggaggtggaggttgcagtgagccgagatagtgccactgcactccagcctgggagacaagagcaaaactccatctcaaaaataaataaataaaataaaattacataagtggcttgtaccatatttctattggacagcactagtacatatacaacacagcataatggttgagagcactgactctggagccaaattactgtgtttgattcttagctccacaacttactagttgtgtgaccatgggcaagcgagttaacctctctgtgccccagtttcccattctgtaacatgaaaataataaaaacactcccagaattgttgtgagcattaaatgaagccctgacacatttgttctggatacaatatcctcttgttttatatttggtagtatcaatgtgcctttagacacaattacaacgatctctgtggtaaagatgcaatgtatatggtgtctataaatagcattcaatgattcgttagttagggcttgagacttttactgtcatggaaaatctaggtatagctaagcttttgagattttgggaactccttaaccctatttttctctactcttgcccccaacaatcagcctatatacttgtgaaatttaacaattacttcactgggcagaaattatatgggaacacttagaaatttcagtccacagggaaagtataaatatgttaactattttaacttaatcccttcctagaaacacatacactgttgccaagcccatattctccctttcttgttctcacaggttcccaatgctccacctgcttatgagaaactctctgcagaacagtcaccaccaccttattcaccttaagagccagcgagacacctgagacatgctgaaattatttctctcacacttttgcttgaatttaatacagacatctaatgttctcctttggaatggtgtaggaaaaatgcaagccatctctaataataagtcagtgttaaaattttagtaggtccgctagcagtactaatcatgtgaggaaatgatgagaaatattaaattgggaaaactccatcaataaatgttgcaatgcatgatactatctgtgccagaggtaatgttagtaaatccatggtgttattttctgagagacagaattcaagtgggtattctggggccatccaatttctctttacttgaaatttggctaataacaaactagtcaggttttcgaaccttgaccgacatgaactgtacacagaattgttccagtactatggagtgctcacaaaggatacttttacaggttaagacaaagggttgactggcctatttatctgatcaagaacatgtcagcaatgtctctttgtgctctaaaattctattatactacaataatatattgtaaagatcctatagctctttttttttgagatggagtttcgcttttgttgcccaggctggagtgcaatggcgcgatcttggctcaccataacctccgcctcccaggttcaagcaattctcctgccttagcctcctgagtagctgggattacaggcgtgcgccactatgcctgactaattttgtagttttagtagagacggggtttctccatgttggtcaggctggtctcaaactcctgacctcaggtgatctgcccgcctcagcctcccaaagtgctggaattacaggcgtgagccaccacgcctggctggatcctatatcttaggtaagacatataacgcagtctaattacatttcacttcaaggctcaatgctattctaactaatgacaagtattttctactaaaccagaaattggtagaaggatttaaataagtaaaagctactatgtactgccttagtgctgatgcctgtgtactgccttaaatgtacctatggcaatttagctctcttgggttcccaaatccctctcacaagaatgtgcagaagaaatcataaaggatcagagattctggaatggtgtcattatttgcatagcaacattgcaatttgttttcctttggctacatcaacgtatcacctacactattatttatctaatatttctctttcaggcagctcatttaaactttttttggctttaattcctattgccatcctgagtggaaaaccagtatcattttccatagtagaggataactataacaacgaagataatgaaagtaatttttttaacctaagaaaatactaatggtcacagaaggctatgaacctgagacctgctctctttgtcaaacagagattaacaaggatcagagaaaagttaaaggctgtctttgacataactggaaggcttacaagagttttaaagaaattactttctcactatatgattcattgctatttaacggtgagtcagtaaaccacctaaaaatcatcttgtctcatcagaaacactagtgtaacataactgcatcattttctactaaagacaaaatttcaccaaaggggaaaaagaaaacacaggataaagagatgtattacacacatcgaaaaaaacaacatttaacaaaatattaaaatatttccccactcttctgatactgtcaagtcttactacttaaaataaggcttccacctctcccacttcaaacaaataaatgaattctaaaccaaagaaacttcatcaggcatttgggtacctcctcccctcaccacgaggtctctgctgaacctcaatcctgtacactgaggaacctgtggcttgaaccctacatccctccagaacccccagactgtcactcactgagggtgctctcatttctctgtggaaaaggctctcctcacagagttcctcagacagtgtcccaggtgatggacatggagacttgggctgagtctgccagaaagaaattagaaaagtgagatatttttgaaaggaatagaaagtgccagattcagaagacttactccccacttcacagaggcacccacacctctgaagatgactccttggattggaaaccaattgcagggcaaccctgggagccatgtgttaaggatggaaggtcacatgatgcaaggagcctgggtcattacatcaccactgagagctccttatatattctggttattaatcccttgtcagatgggtagtttgctattttctcccattcatgggttgtctctttactttgttgattgtttcctttgctgtgcagaagcttcttaacttgatgtgatcctatttgtccattttggctttggatgcctgtgctatgtagggtattactcaagaaatctttgctcactccaatgtcctggagagtttctccaacgctttcttttagcagtttcataatttgaggtcttagatttaagtctttaatccatttttacttgatttttgtatatggcaaaagatacgggtcttgtttcattcttctgcatacaggtatctagtttttccagcaccattttttgaagagactgtccttttcccaatgtatgttcttggcacctttgttgaaaatgagctcactgtaatatatggatttgtttctgagttctctattgtgtttcattggtctatgtgtgtttttttttttttttttaatgccagtaccatgatgttttggttactataggctttgtagtgtaatttgaagtcacataatgtgatccttccagttttgttctttttgcttaggtcctttttcttttcttttcttttctttttttttttttgagacggtctctctctgttgcccaggcggagtgcagtggcacattctcagctcactgcaacctccacctcccaggttcaagctattcttgtgcctcagcctcccgagtaactgggattacaggtgtgtgcccccatgcccagctaatttttgtatttttagtagagacggggtttcactatgtcggccaggctggtcttgaactcctgacctcaagtgatctgcctacctcagcctcccaaagtgctgggattacaggcacgagcca

SEQ ID NO: 12490 - DNA, 16321 bp, Human
  misc_feature (1)...(16321): n = A,T,C or G
gaaacactgtggaagaggccccttctacacttggaaccaggacctggaggacagccagggcccctctcttctagggacccgcatactagagtccacaggcagcaaggcagggtacctgtgatttggtagggtcaaggcatctagaagagaggtggctttgggaaagatctgcttcaacctccaatctaaatgacaataccgccaccccatatttgcacagtactttaaaaattcgggcaagataatgcccaaactgaatcagacttagctttatgaacagattgggctcaaatcactgattcttattagctgtgttgactttggacacgccatttaaccttttctgagcctcaggttccccagctataaatagggaccttactagtctcagacaattggttttcatgtgtacacactgcccccacccctagcctcagcttctccatccgaaaacaggactttgatggtgccgtttcacaggctgttgaagggtcccgcagatgatggaggagtacgggtccagacactagagcacaatccggagaggaaaagtgacctgccaggacccaccagagtggacggcttggtgcggggaaccccctccgcggccgccccagggccagcgaagggtcatttccttccgcattcagccccgccgtcacctcgcctgtttgcccccgcgttaagtgcggcggcgccagcagctgggaaatcggggccaggccggatttcctctgtggacctgcggctcctagagccaccgcgcccccctccggaccccgcggggccgcgaactgcacgtgcggcggccgctgggatgggcctcgctcccacggcgcttcctctgcaacccctctccctcccgccctctcatccccccacactgggcccccgccccttcccggccgaggtcccagggtggtgaagatgcttcgccgccccaccccactccgcccccgccggctccggataaaccgaggcacggggccaggcgctaggaccccacggcctcgccagaggggggcgtggcggggcgggccggcgggagaggtatttaaattgcagccggagcgcgggggctccggtggggcagctgagcggcctgctcctcctcgggccgtgaccccggggtctggcgcggggtgggacccgggggcgggtttgcgcaaaatgtgccgagactgcccgggagaggagctgcggccgcgctgagccaggtaggagccgccgggcaggcgaggctggccggccctcggggggcgcactgtcgcgcgcctctagcgagcgcaaggcgggggnnnnnnnnnnnnnnnnnnnngctggtcccaatggacgccccccaaacactcccctcccgccatccccactgcgcgcgtggagccggggctgaccctccctcggtccctgggagttccccagcgctcctgtcttggcggatctttcccgcaaaggggtgaggccggccttcccatttgacagctgggaaaacaatggcctgaagaccgtgacttgcccaggaacacacagctaggcaagggcaaaccggaatttgaattcaggtttcctgcaacgctccgatcccagccaggcgtggggctgcccatcccacagcactagatggcctgcccatttctcgtagtggggtagggggcacccaccgctctccaaggggctctgaacccagccttcttcatgggtggtaagatgtgaggggcccccacccccacgccgagctgcctgaaattccgccatcacagccacattcctttgggttaaggtctaattcccccgtgggatgcacatgtctccagaacgaggcttgcccttagtgattcactgcttgacaggaacgtccgcagcagctctcccaggaccccactctgccagtaagtcagctgaggccgagaggagggagagaggacctcagaggccagactgtgagctagtctgccctgctcctgcgtgtgaggggtcgttggcagggcttagggaaggagaccttgatttggtatagtgggaacatttgctttggagacagatgaactggattctgatcgtgaccctgctattttctccttgtgtgactttgggtaagtcacttctctgagcctccttttcttcatgggcaaaaaaaagacagttctattgggggcagtcggctcagcatgtgctggagaaaacacagtattcaggtcatgtagaactggataaatcccagctccaaagcccttatgagctgggtaactctgggggtaagtcacttcactttccggaaactgttttctcatccgtaaaatgggaattacagtaatttcctcaataggtgattgtgagaattaaatgagatgatataggtcaagtgcttagaagactaacatccttaaatgtaggggtgggcttattgtggtagtagtcattgccccccgtacccctgctctttctctctcactctctctctctctctcacacacacacacacacacacacacacacacacacacacacattctttggcacttttctgagttggactcctgagagtccgactctcctgcctcctcttgcccaggccacttgtctgcaggcttggggcctccccactgagcacacctcacctgggatgctcagccctgcgagggtcactgtgtcagctgggaaggacagtgaggatgcagggcaccttcgccaccattctttgcctgatcatcacaatagttggggttggccagtggcagaactggaacccagctgcctaccctgcagacaggacactggggcaccaagaaaggaagggacttaccttagggagcagagctggtgagtggtgggctttggatgcaagcctgggtctaagtgacaccgtcctcctttttgagagagagtagtctttaaatgctacaccctgtacttgggcaccactgaggagggcccacagctgaggggcccttcccgtcagatgccaggacagagtgcccatgtgctgcagggacgatcccttctggatgtgcacagggccaccttggggatagagtggggtttggcagaggaaggggaaataagggcctaggacccttccttgtcctcacctggcactcaccactcagtccactgcagctgagcttctgccctgattttgccacttgttcactagtctttagtgagtacctacttagtaggcccctgttcccacatgataagaaataaatgatgaggaaatgataaatgtgggaaaacaatgacatgtgtgaggagctgaggaagagcattcagggagaggaaactgcaggagcaaaggccctgtggcaggaatgaatttgctgtgttgaaggaacagcaggaaagctggaatgtggtgagggaagggaaaatgggcaagagtcagagaggagactgtggatagcctggattttcttggagattttcaaacagaagaggtttaggatctgacagatgattttatattatcactctggctgctaggtacaggacagattataagaggtcagggtgctgtggtcaaggccaggattggggtggcgtctcggtctgtggcagtgataagagggaagtaggaagatccggggtctctttcagggagagcagtcagagcccactgacggcatggatgggtgaagggaacgttgcagagaggtgaagggagagccaaggagaactgctctcagtaacgaccccatgtcaccgagactcctagtgtcggttttctgtccgctgctgacctgttgtgtgctgtgagatgcatcttaaaggatggtgagcccctctctaggggcacttcccatgggagggggtggggcccagtagccacggagggcttggtgctgtgctcactggaagctcaggggctctgggaggactggaggacatagtccagacttggggaaccaaagaaggcctcttggcccatctaagctgggaccccaaggatgaggaggtctttagcagaagaggagaggggagaaagtgaaggtttggggcagtgaaaatctgctcagggaactgaaggaaatatgaggtgtccagaacccagaatgtgagaggggacaccggggaagcaggctggagagcagagctggccaggcagggcatgctccccagtggcctggaaggccctgccggaggggttttcactcagttctgaatatgctaactttctaacgggcggtggcgttctgctttttaaacagcagaacaaagtttcctgtgaaagcacaacctgtaatgcaggtgagagcagagcagctgcaggggcagcgcctgtggccctgaggggagccagggaatagggtttaccgggtccggctgtggtctgtgcgccttcaagagagatgggattcagagcagccatcttcgtccatagctcatcactagcgggttccaacagtcaaagacactgccctcaaatgccctgtgaatgccttttctcctgcagcatccttcagaatcgcggttcagcactcactgagggagcacccactgtgggaggcctgggagtgtggatttgaagggcacagacccaggagccagactcacctgggccggtggcttgttcaccgtgtgacctcgggcatagtacctaagctctctgagacttctttttcccttctgtaaaatgatgatggaaccaagtcattgaatttttgtgaggatggaatgagttcatgcctagaaagtgctgaggagagggcctactgcataatggaggctctgtaggtggcatctcgtttgattctcaacaaaaacttggcatggctgccattaacctcaaatgaggagactgaggctcagagaggtgaagcgacttgtaagatcacacagcagaaaggtagaggagacaagagggagcagtcagatgtgggtgactgtgcgcctggtgctcttggaaggctttctgtgtccctctttaagactctctgtctgtatcaccgtcactgtcacttctttttcgtgttcatttgttttttgagttcccagttcccagcacagagccagacatgaggaggtattcagtaaaggtgtgaatgaatgaatgaaattcatgggtggatttgtacatccctagcacttggctgatgtccttagtgagggagtgagtgagcctccagcagcactgggatttaaccctgctaagggcctgtgcggtccccttagccccacccctggctgctcttagagggaagggctggcccaggaggccggagtgtggcttcagtgaaagtacagggcctgccaggctgctcctggggaagtccgcagagcagtgccggggcagccaggcctcctgtgggacttcctgccaaggcccgggcccagcccttgaacaatggcaagggctcgagaatcagagaatcaaaaggaaaagggcaaaataaaggtgggggagtgggcagaaaacgaggaattgcatgtggggactgaagagctggtacggaggacttgtgtggcctgggtggaaatgtagtcagaggcccaccctccaaaccccctctacatctccatgcccccagtccctggccctgagcatggcctagggtaacccttagggtctgtcagccttctgtgcatcccctccaggctgtcttccgccaggtggggtctcttgaaaacccccgtctgaccaagtcacctgccgcttaaaactcttgcttcccctgggtaatgggcggctccttggcctgggtgagaggcctactatgatgggctgcaggcccatttcccacctggctctctgccctgctcaaagcatctttattccagctccagccgtgctctggggttccctgagggcaggcacagaatgggtgggagtgggggctggcagtgggaaggagccagtgggcttacagtgttcccctttcctctccgccttacacagagccatgagaccccagatcctgctgctcctggccctgctgaccctaggcctggctgcacaacaccaagacaaagtgccctgtaagatggtaagatgctctgcccagacagggtgaggaccacccccacctccctgccctagggtgtgctagtgccccagccccagaagccagaagttagaagagtcaggagaggaaagggaatgtaccttgcatttaatgagcacctactagaatgtttaaacaccttatttacccacagtcctgccaggtaagcaccattattctcattttgcaaaggaggagactgaggcttggagagattgggccttgtccaaggtcattcagctgggaacagtgaggctgatattacactgtattcccccaagctgtccccacagagcagtaggcccagctaggggatctagaatatatatatatgtgtggggaatttggggtaggccagctgggaggggctcctctgtgctcatccctcttggagacaaatccccttccaagctgggctccttgacttgggactgcccgctggagtgcctctcacttcttagtgcccagatcaaatgctgccatctccaggaagcctccccagcccctcccaggctggcctagtctgatcacaccttcctctgggttcctgcggtccccaggcttccccctatctcaatactgagaagactgaacatgtggggtggttggtgaaagggtccaagcctgtctcacctgccagaccatgaacttccctagggcaaggaccaagtttgatttgcttctattcctttttcctgtcccaagccagggaaactagccctaaagttcttgtgactctatgagatacagggcaaagagaacacctagatccacttgtaaggccgggcagtcactgaggccagagcctggctggggaaagggcagggcctccggaagcccctcttggacctgagactcgaagaagcttatgacacagaaccggcagctgcttcaggaggcaggaagtgcaggcagctgcctgcccgcagcccttccctgggggtgcaatgtctcctgttgccaccacctttcttgctcttcagagcccttctaagattcccggagcccagaattgcgggcagagaaggcctcagatgtcaccaaatacaaacgcacattctacctcagggagacgaggctcagaggggaaagtccttgactacccaacaggcagaggggaagcgggtgaattttggagtctggggaaatgagataagagataggaaagcactttctgaaccagcatgggaataatacacacgggaagtaaggagaagatgtgtgacccaccagggacctacaggattcgaacccagctgcctttgccactgttcactgcctggtgcctctccctactctgctttcctcccatgatcaggtggtgaaatggagttggatggcaagtctttgcttctgaaaaggaagctgggcagtgggtgtcctgatagcccaggacagtgggtgggagctctaaactctggtcaagggccaattcctccaattccctccgacggtaagtcaggcaatgctgggagctcagagctgaaggaggcatgaagaccctggaagtggagctctgagcaccgccctggacttcaagcttcttcctggactggactggagatctgggcatcccagtgcagccctgcccaccatcaggcccccaggcttctagagcaggggtcttgggcccctgaatggaaagccagtcttgggctgtgggcttggcaaactttgtgtcctggatcaagtctcaggggctggtgccccagggagcctttgcctatccagaggcagtatgcctctgcacttgcccgggggtaacacgcggggcacagcacggtgccccccacactgtaacagtcagtaagtgggtccatgatgctctttgctgtgctgaccagctgagggcccagtggtcagaacttggctggcaccaataggaaaaggaatttgcaaatgggagttttgagcccctgactgtctgatcttgggcagcccactccccttagcctcagtttcgttaggggtacaataggaacagggtgaacaatgcctgggaagatttaatggggtagggggtctctgcactcagcacgcagcctgacacagctggggctccatcacaggtcattttgttgtttctgctttaagtaaggaatgccccagggggtaagggctgtgaggaggaggctatgtttagtggcccctgcagacagagaggttgtgagggaggaagggcaaggatgggcaaggcagctgggcaggtttcaggttcacacaggtgcccaactgacggggcatccctgggcctcctgaggcccctgtgaagctgcctcccttggaggctacatggagtcactgtgctgcatggagtaagaagagccacacggaggcctgaggctgggcaggtctcttcctccccctactcaccttggggctctcaggaggaagcgcagagctggaccaggggaggaacacaccggcttgtgttccctccctaccagctcagccactggctcactgtgaattcacgcaagtcactgccatcttcaggcctcagtgttcacatctgggaagtgggtcagctgaactcttcttgctctacccgtctttgactatattttgaaaatatcaattatgcattttctttcctcctagagaagtgattgattcagtgcctcagacctttactaaactgatgatgtctgggactcattcattaggaaaaattgacttgctagtcaggtccaaggcatgcacatccaccaaaccagtccctgtttgctctgagctcgctgtctagcaggtcctcacacacacagccacaattcagcggggcaaagctctgagaggaagcacagtcagggagggctccctggtggaggaggccctgaagctcagtgtgaagagttcatgtgtggatctggttggggatggcataaccagctcagggagcaggccccagcagtgggtgtgggagcgcatgatgggcagtggtcagctgtggtcactgcatgtgggctggggtgggaggtgggggacaggttggcaggggctacaaacagcctcgaaggccctgctggggatcctggacttcaccgtggagaagtttaagccaagctgcctcattgtcagagtagagcttttgagcagttgtcaggcatttagcagtgagtgggtcagaacgggttggcggagacagaagctgggggcggtgagcctgagcccggtgattgtggaagtcagacctttttctgggaaaggctggggttcctggaggcctggaagagaagagggagacctgcatttgcacaggaagaattttggtcccagaaggcacatctgtggaagaacaagagttcggccttttgttgttaaaaaacctgggttcaaatcccagctctgctcctcaccagctgggcaatcctggcacctcccttcccctccctgagcctagatttctgtaaataggggtgatcgtatcagatgggcaggctgtggtaaagaccaatgggaccatgggcctgaaagtattaaccaagatgtcaaatgctgagtggctgctggggaagaacgtaagaaaacagagtggttatgtgacttcctggaggtcgcacagcacaaacacagtctcatcaccaaagactgtggatttggctctggccatcttttccctggcccttcccacctccaggggcccggtcccctgacccagcctgggaagaaagccacctcctaggaggtaacagcaacagagaggaagccacatctcggaagcatccacaaggaaggcaggccccaggacccaggctctgcccatgacacgagagcctgaatgaggtctgaggcagggaggccaagataaaaactgatgacagagcacaaattacagttttcccttttggaaacatttctcccaaagtggagaaattcccatctaccaccagaaatttaactatctgtgcccatagaagggacctaggacatagaatcaggagccctgggtcccagctctgccctgctgctcactggcttggggtcactctgtgggatatatggctgtttcctgtaagaggggtaataataagtacagggtttctctttgttagtttatttgtccttctatctgtctatcatctctccatctgtccacccatggaaccttcatcgagttccttccttaatgcccattactgcgctgggtgcccgagatggggcagggagccggatgggtcatccaggcatggggtgatcaggctgcggtgggggaaagttgagcattctgggagtccatgggagaagggttccccagccaggcagggttcctggataaacatgtctggtttcatcccctaccgtgcccacttatgccagctgtctccccaccctacccctccccaggtggacaagaaggtctcgtgccaggttctgggcctgctccaggtcccctcggtgctcccgccagacactgagacccttgatctatctgggaaccagctgcggagtatcctggcctcacccctgggcttctacacggcacttcgtcacctggacctgagcaccaatgagatcagcttcctccagccaggagccttccaggccctgacccacctggagcacctcagcctggctcacaaccggctggcgatggccactgcgctgagtgctggtggcctgggccccctgccacgcgtgacctccctggacctgtctgggaacagcctgtacagcggcctgctggagcggctgctgggggaggcacccagcctgcataccctctcactggcggagaacagtctgactcgcctcacccgccacaccttccgggacatgcctgcgctggagcagcttgacctgcatagcaacgtgctgatggacatcgaggatggcgccttcgagggtctgccccgcctgacccatctcaacctctccaggaattccctcacctgcatctccgacttcagcctccagcagctgcgggtgctagacctgagctgcaacagcatcgaggcctttcagacggcctcccagccccaggctgagttccagctcacctggcttgacctgcgggagaacaaactgctccatttccccgacctggccgcgctcccgagactcatctacctgaacttgtccaacaacctcatccggctccccacagggccaccccaggacagcaagggcatccacgcaccttccgagggctggtcagccctgcccctctcagcccccagcgggaatgccagcggccgccccctttcccagctcttgaatctggatttgagctacaatgagattgagctcatccccgacagctttcttgagcacctgacctccctgtgcttcctgaacctcagcagaaactgcttgcggacctttgaggcccggcgcttaggctccctgccctgcctgatgctccttgacttaagccacaatgccctggagacactggaactgggcgccagagccctggggtctctgcggacgctgctcctacagggcaatgccctgcgggacctgcccccatacacctttgccaatctggccagcctgcagcggctcaacctgcaggggaaccgagtcagcccctgtggggggccagatgagcctggcccctccggctgtgtggccttctccggcatcacctccctccgcagcctgagcctggtggataatgagatagagctgctcagggcaggggccttcctccacaccccactgactgagctggacctttcttccaatcctgggctggaggtggccacgggggccttgggaggcctggaggcctccttggaggtcctggcactgcagggcaacgggctgatggtcctgcaggtggacctgccctgcttcatctgcctcaagcggctcaatcttgccgagaaccgcctgagccaccttcccgcctggacacaggctgtgtcactggaggtgctggacctgcgaaacaacagcttcagcctcctgccaggcagtgccatgggtggcctggagaccagcctccggcgcctctacctgcaggggaatccactcagctgctgcggcaatggctggctggcagcccagctgcaccagggccgtgtggacgtggacgccacccaggacctgatctgccgcttcagctcccaggaggaggtgtccctgagccacgtgcgtcccgaggactgtgagaaggggggactgaagaacatcaacctcatcatcatcctcaccttcatactggtctctgccatcctcctcaccacgctggccgcctgctgctgcgtccgccggcagaagtttaaccaacagtataaagcctaaagaagccgggagacactctaggtcagtgggggagcctgaggtacagagaagagtgaggactgactcaaggtcacacagtgatccgggatcccagaactctggtctccaaattacagcccaggacacctttctctgccgcctgctgcatcagtgggtgacccccttcccgggctgcactttgggtccagctgtggaagccagaagttgggcggtttcagggacagccgagaataatgttgacctgtcagatcaacaaatcttcactgagcatgtattttgtgccacaccctgctctgggcactgggaatgctgggaaatgagatacattcccgccctcaagaatctcccagtctggtaggagagagtgctgcagagccacgtggccgccacgcagtgtgcttagggcctgaggtgtgaaagcccagggctccagagctcggcaggccccgctggtttggtgcggtgagtcctgccccggctgtgccagggtgagggagggccaagcccaggaggatttgtctgagacatttccaagcagactgtttgtcacgtcttctgagaatgactttcagtctctctgaaaatgaaaagcttaggaccggaagagagaattggagctgtacgagtgtgtctcggatctggtgttgttaggtgggccacggcggctccagcagggtctggttaaggggtccagcccagcactggaccattccgtctcctgctctggacttgccctctcccttcctggcactctcatgttgcataccctgaccccagtgctgctctaagcaccgtccctgcccagccccacttctccatcgcagccccaccttggctgctgagccaggagctaaaaccttagatatctggttctgttttgcacccagcttggcagatgtggatttgaatccaagccttgtgtctgcccctatgtgacagctctatattttatccccgttttataaaagaggaaactgaagttctgaaaatctccttccagggccccagctaactaatgccataggtgagattcaaaccttcatccttctgtctccagggcctgatctttaccactgcaggggctgcaggccgttaagtggacaggaagtggccccacatagcccgagcagggtctggaagcatcctgtgctgtgcacacctgctctctcctctctcccaggcaggcagctgcaggcgctctcctccttctctgcctgtttccctcctctcttcctttccaccctggtgtgggttctcctgttctctctgtgctcttgcattctctcattcccttttcctctattgagcagagcctggagtttgagactatggaatccaacctccccattgcacagatggggaaactgaggcttaggaagagaatgaaacttgtggagagcttatacagagcctctgggggaaaaaagagcccttatttgtggggtgagattgggggttggaccagagtgatgtcctctctcagctatcacatcacaagataatgctggctccaaacttcctttctgtgcctcatcatgcaaggatcttttttccctcttacaaaaacaggtaaaaggcctcacccagatgacccccatccctcataccatggagtcatgagctgtctgggaagaatggacgtgctgggaccaactcaagaccttgttttgctgtcttcatcatcttacctgtgcttggcccacagtctggctcatgatgtgggctcagtaatgtgcgagaaagtgaaaatgccactctctccaccccattttacagaggagaacaccaaggcccagaggaagttaagggagagtcaatgggcagagccagggctaggccctggtggtgtgtggagcacccaggcagacccagtcctggttgggatcacacccacgggtgctactgcacgtaacactcctccttaggcctggaggccaaggtgtgggtccccacgcctgatctttgaaaacactacacagggctgctgtcacttcccagggcccaggcctcagcccaggcctcgggaccaactctttgtataacctacctgaatgtattaaaaactaattttggagaagcagtgtggctgccagcttcctctttgcaatccgcttcattgcgtccactagaaccctgccgctcaatcccattacggtcgttcaatcatcatggcaaatccctggggacactgagactctgggccagcaccaccctggaccttgaagccgcagccactagcatggcccctgctacacctcttgccccacactcaacaggcgactgtgctccccaccccagggctgagaggctgagggcttccgtttgtttccttcctgctacagctacaggccccctccccttctctgtgctcagccctctgtgccctatctcagaggctgcactgcccctcctccttggggtccccagccccgtcctctctcccttaccccgtcatgctctcttctgcctccagcctctccctgtttacgtcttcctctcagacttcagctggactcaagtcttgtccgtcttaaaaatagtgagaagcccctcagccactttccccttcgtcctcccactcttcacaggccagcttcttggtaaagtcacttcccttcccgcccctcccgttctcaacccgcctggagctgccttcagcccctcccagctccatgctgcccttgctaacagcgtcaagggtatcctttgccaaactcagcacgcttttcagacctcctctccctaggccctgtgcagcaggccccccacccatacccctgctgggcatgctctccccacagctgtgatcccacacaggaagccatctcctccctcccaggccactccttttcaggccactctttgctcatcttccttgagccagctttaagtggtgatggccagggctccatcctaagcccttttcccttgggaacactatggcctcattgctgtaaacaccccattgctctgatggcccacatctctgtctccagccccacctctcctgaaagtccaattctgctacccagaggccttcccaggtagagggctaaaggtccccagggactggagaattcagtgatcagccaggctgcagatcaaggttgaacttggaagaaaaccacacctggttcctggcttggagttggagggtgagtgtcgggtgtgggacagaagcagcctcacctgggtaggggagcactgagaggcgtgacaggccagggcagagcatgcagagcagggggtgcttattcctctggccctcacaccttccatttcgccctgtcagcagcctggcactgcgcctttgcccttcccttccctgactgcctctcccccaagctcctgctcagtgatgcttctcctgcccaccccgagtcagcctggacccctccccttggccctgcagcccctgggcccagcgttggcagctctgcctcctggagattcttccgtttctctggtccgtgccctctcacctccccattcctgctcctggctcccagtctgcaaagggaaattctaaacacctatttcatggggtagggctgggggagaaaggagagagccccaccccctggcacacgataggtgctccgtgaaggcctaaggggaaagcaggagcttgggctgagctcgcctagggtctgcgggcctctgctccagcagggagcccagcaggcccctgaccccttttcctgacaaacagggagtttgctcacctggccaagacccccggtgaggcagaaattcctgttttcagccaaacgtggacacagcagccaactaggtcatcagaacatccagcttcccgagctcttagcttgcagggagaggggaggccctgccactcccaggtcacagtcagcctgaggtgcagggcccaactcctggggttccatgcgctggcgtggcactccaccaggaacgggtcccgggacgcgccagcaactcaccctctcagacccacaggctggccacatcctccaggatctgggacccaccgtctgtgttctgtgcccctgtccttcaggcagttcactgagcccatgaggcccatctctctcccg

SEQ ID NO: 12491 - DNA, 7803 bp, Human
tttctccatattgataaggctggtctcgaactcccgactgggattacaggcgtgagccaccgcgcctggccaccccctgtatctaaaataaaagttaaaaatttaaaaataagtacataagagaatgtatgctatgagccaagaatgatgcttgcaaaattttgcaagaacaacacttatgaaaatgaaaaataatcactcttcttgttaccaaaaatcttggtagctgcagaaggtgggatctttcctcactgggagtcgcagagccaatacatgaaaccaaaagtgagccttaagcagagcaagctttatttcctgcacaggacttgtaaagaggagagcagctctgccaagtcaacttctccactagtgaggcggctagtgaggggtgagggggctaaaatgtaggattgctctaatgaaggggttgggcattaaaagtgagggggaggaatattcatatgttttatgggaacaggcagtgaacttctccaaactggtaataccgctttccttttggtccttttaggacttcttctactcatcgtcatggagatcgtcaactgtcatggcatggatgggagcgcaatttagcctggaaacgggattacaatgaagcatgaggtctttttgaagtcatttggccggctctcttggttgtaacgagtctcagctggtttgactacaaaggcaacttcttgaagcagatcctgtttttttgtttttgtttttgttttttgtttcttgttttttccccctagacatctcactctgtcgcccaggctggagtgcagtggtgtgatctcggctcactgcaaccaccacctctcgggttcaagcaattctcctatctcagcctccagagttgctggaattacaggcgcgcaccaccacacccggctaatttttgtattgttagtagagacagggtttcatcatgttggccaggttagtcttgaactcctgacctcgtgatctgcctgcctcggcctaccaaaatgctgcgattacaggcgtgagccaccgttcccggcctatacgttgtttattttggaaaaattaaaaattaagttttttttcattaaagatatgttatttccgatcaagagatcaagaccatcctggccaacatggtgaaaccccgtctctactaaaaacacaaaaattagctgggtgtggtggcacacgcctgtagttccagttactggggaggctgaggcaggagaatcgcttgaacccgggagaaggaggttgcagtgagccgagatcatgccactgcactccagcctggggacagagcaagactctgactcaaaaaaaaaaaaaagttgtttctattaacatgtaatgggttattaatattctcttaaatgaattaatatttttaatattttgttttaatatcttttaatttatatatgataaaaattgatacaatccacagaaacaaaatttatttgggtcctcactaatttcttttttcttgttgcccaggctggagggcaatggcacgatcttggctcaccgcaacctcctcctcctgggttcaagtgattctcctgcctcagcctcccaagtagccaggattacagccatgcgccaccacgccggctaattttttggacttttagtagagacagggtttctccatattggtcgggctggtctcgaactcccaacctcaggtgatcagcccgccttggcctcccaaagtgctgagattacaggcgtgagccaccgcgcccagccaggactaatttctaagagtgtgcagagataccgaaacctaaaagtttaagaactgctgattgctgggaaactctgcagtttcccgttcctctcgtaacctggtcatgtgtccttcttcctggatactcatgacgcagactcagttctcattcccaatgggtgtcgggtttctagagaagccaatcagcgtcgccacgactcccgactataaagtccccatccggactcaagaagttctcaggactcagaggctgggatcatggtagatggaaccctccttttactcctctcggaggccctggcccttacccagacctgggcgggtgagtgcggggtcgggatggaaacggcctctaccgggagtagagaggggccggcccggcgggggcgaaggactcggggagccgcgccgggaggagggtcgggccgatctcagcccctcctcgcccccaggctcccactccttgaagtatttccacacttccgtgtcccggcccggccgcggggagccccgcttcatctctgtgggctacgtggacgacacccagttcgtgcgcttcgacaacgacgccgcgagtccgaggatggtgccgcgggcgccgtggatggagcaggaggggtcagagtattgggaccgggagacacggagcgccagggacaccgcacagattttccgagtgaacctgcggacgctgcgcggctactacaatcagagcgaggccggtgagtgaccccggccaggggagcaggtcacgacccctccccatcccccacggacggcgcgggtcccctcgaatcttcgggtcccagattcaccccaaggctgcggaacccgcccagaccctagaccggggagagtctcaggcgcctttacccggttctttttcagtttaggccaaaatgcccacagggtggtggcgacgggggcggggcttggtgggcgggactgactaaggggcggggccagggtctcacaccctgcagtggatgcatggctgcgagctggggcccgacaggcgcttcctccgcgggtatgaacagttcgcctacgacggcaaggattatctcaccctgaatgaggacctgcgctcctggaccgcggtggacacggcggctcagatctccgagcaaaagtcaaatgatgcctctgaggcggagcaccagagagcctacctggaagacacatgcgtggagtggctccacaaatacctggagaaggggaaggagacgctgcttcacctgggtaagagggtccacagggctactctcccatctccttcttgggctaggactgtgcccacagctgacagacctcaaacagtagaagaaacagggatggaggccagaataccactcctcccttggatcaggagagggagctgtcacctgaggtacaggagatcctataccacagagtgactctcttaaagggccagacctctctcaggggcaattaaggaatctagtctcgctggagattccatccttcagatgaactgatgagcagttctctttgactcccagtattaggaatcacgggggagtttctctcgtgcctgattctcagccccacaccaagagtttttggaggtctgactccagcttttctcagtcactcagcatccacacaggccaggaccagaaatcccttttcaccttctaccctgggctagctcatcccgattctagaactttccaaggaataagaggctatcccagatccctaagtccaggctggtgtcaaggttttgtcctcttctcctactataattgtcctcttccttctcaggatggtcacatgggtgctgctggagtgtcccatgagagatacaaagtgcctgaattttctgactcttcccctcagagcccccaaagacacacgtgactcaccaccccatctctgaccatgaggccaccctgaggtgctgggccctgggcttctaccctgcggagatcacactgacctggcagcaggatggggagggccatacccaggacacggagctcgtggagaccaggcctgcaggggatggaaccttccagaagtgggcagctgtggtggtgccttctggagaggagcagagatacacgtgccatgtgcagcatgaggggctacccgagcccgtcaccctgagatggagtaaggagggggatgggaggtcatgtctcttctcagggaaagcgggagcccttctggagcccttccgcagggtcagggctgaggcctgggggtcagggccccttacgttcccctcttttcccagagccggcttcccagcccaccatccccatcgtgggcatcattgctggcctggttctccttggatctgtggtctctggagctgtggttgctgctgtgatatggaggaagaagagctcaggtggggaagggagaagggtggggtctgagttttcttgtcccactgggtgtttcaagccctaggtaaaagtgtgtcctgcctcgttactgggaagcaccatccacacacacgagcctacccagcctggggccctgtgtgccagcacctactctttttttttgagacggagtcttggctctgtcacccaggctggagtgcaatggcgtggtttcagctcactgcaacctccgcctcccaggttcaagcaattctcctgcctcagcctccctagtagctgggactacacatgcgtgccaccacacctggctaatttttttttttgtatttttagtggagatggggtttcactatgttggccaggctggtctcgaactcctgactttgtgatctgcctgcctcggcctcccaaagtgctgggattacagtcgtgagccaccgcacccagccgcacctactcttttgtaaagcacctgtgacaatgaaggacagatttatcaccttgacgattgtggtgatggggacctgatcccagcagtcacaggtcacaggggaaggtccctgctgaagacagacctcagaagggcagttgatccaggacccacacctgctttcttcacgtttcctgatcctgccctgggtctgcagtcacagttcaggaaacttctctgggatccaaaactaggaggttcctctaggaccttatggccctgcctcctccctggcccctcacaggacattttcttccaacaggtggaaaaggagggagctactctaaggctgagtgtaagtgcggggcgggagcgtggaggagctcgcccaccctataattcctcctgcaccacatctcctgtgggctctgaccaggtcttgtttttgttctaccccagggagcgacagtgcccaggggtctgagtctcacagcttgtaaaggtgagattctgggggtctgaagtgggtggagggtggggcagaggggacaggactgggttgtggggattttttgattcagaatttttgagtgtgtggtgggctgttcagagtgtcatcacttaccgtgactgacctgaatttgttcatgactattttcttctgtagcctgagacagctgccttgtgtgcgactgagatgcacagctgccttgtgtgcgactgagatgcaggatttcctcacgcctcccctatgtgtcttaggggactctggcttctctttttgcaagggcctctgaatctgtctgtgtccctgttagcacaatgtgaggaggtagagaaacagtccacctctgtgtctaccatgacccccttcctcacactgacctgtgttccttccctgttctcttttctattaaaaataagaacctgggcagagtgcggcagctcatgcctgtaatcccagcacttagggaggccgaggagggcagatcacgaggtcaggagatcgaaaccatcctggctaacacggtgaaaccccgtctctactaaaaaatacaaaaaattagctgggcgcagaggcacgggcctgtagtcccagctactcaggaggcggaggcaggagaatggcgtcaacccgggaggcggaggttgcagtgagccaggattgtgcgactgcactccagcctgggtgacagggtgaaacgccatctcaaaaaataaaaattaaaaaataaaaaaagaacctggatctcaatttaatttttcatattcttgcaatgaaatggacttgaggaagctaagatcatagctagaaatacagataattccacagcacatctctagcaaatttagcctattcctattctctagcctattccttaccacctgtaatcttgaccatataccttggagttgaatattgttttcatactgctgtggtttgaatgttccctccaacactcatgttgagacttaatccctaatgtggcaatactgaaaggtggggcctttgagatgtgattggatcgtaaggctgtgccttcattcatgggttaatggattaatgggttatcacaggaatgggactggtggctttataagaagaggaaaagagaactgagctagcatgcccagcccacagagagcctccactagagtgatgctaagtggaaatgtgaggtgcagctgccacagagggcccccaccagggaaatgtctagtgtctagtggatccaggccacaggagagagtgccttgtggagcgctgggagcaggacctgaccaccaccaggaccccagaactgtggagtcagtggcagcatgcagcgcccccttgggaaagctttaggcaccagcctgcaacccattcgagcagccacgtaggctgcacccagcaaagccacaggcacggggctacctgaggccttgggggcccaatccctgctccagtgtgtccgtgaggcagcacacgaagtcaaaagagattattctcttcccacagataccttttctctcccatgaccctttaacagcatctgcttcattcccctcaccttcccaggctgatctgaggtaaactttgaagtaaaataaaagctgtgtttgagcatcatttgtatttcatttgtgcgttttgtgccttgttgttttaattttttaaccacattcaagctatcctttggcttccaatgccatggtccacccagaactgcattcactggcccgtgttctagttctggtcatgccgactttcccgttttcctggtgaatccctgtaatcacctgagtctcattctgtcaggtgatatccagtaagaaggcaacatgtgcggtgagaaagcccagggagtcctgggtgtgaatttttactttgccatttcttcctgtgtgacacgcggtggggcttcacctgtctgagctccagttcctcatcttgtacgtggcactgttttcttgggagagtcattataaagctaatataaagtacctgtactgtggtttgaatgtgtcctccaaaaagcgtgtgttggaaactgaatccacaatgcaaccatatcgggaagtgaatcctaatggctggctggccatggaggttccaactttatgaatggattaatactgattataaaagggcttgaggttgaggcaagttcaacctcttgccctcactcacccacttgcctttaccaagagatgatacagcaaaaagactcaccaaatgccgggatcttgatattagacttcttatcctccagaaccatgaaataggctgctttgctttataaattactcagtctgcgtattatattacagcaacacaagatgggcaacctgatacttaggtttcagttagtggtagatatttttatttcaagcattcctactggagtattagtttcttcataagcccagaatctttgcattttagcaacaacaaataagtcttttttttttttttttttttgagactgagtttcactcttgtcacccaggctagagtgcaatggcatgaccttggctcactgcaaacttggcctcccaggtttaagtgattctcctgcttcagcctcccaagtagctgggattacaggcgcctgctaccacgcccagctaatttttgtatttttagtagagacagagtttcatcatgttggccagctggtctcgaactcctgatctcaggtgatccacccaccttggcctcccaaagtgctgggattataggcatgagccaccacgttcca

SEQ ID NO: 12492 - DNA, 10236 bp, Human
cgtaggtttccaggctaacccacaaaagcaagttgagtctagctcctccatattgatccacaccaatcatagctattctgaaatgtactttcctcacatctgtaaaatagggagaatactcatctcgaaggattggtgtagagtttatattgttctccataatactaacatctgtcttgttgtatttgcttctttgcttattgtctgaccccctctatagaatgtaagcttcatgaggtcaggacctttgttttgttcactgctatgtcccccatgcctagaacagtgcctgacacatagtgagtacagtactcaataaatattattgaataaagagatacattctttgttattcacccaagatgaccatattttgttgtttggggctgtattcttcaggagagaacagaaatgaataagccactctctgcctccaagaagatctcttcaagtggaggtgacagacatgcccaaagcaaatagattgcaataagacttgatgggagagaatgtgagtcttcacatcctagcatctttccagatagagacagggcctacccaaaagtctaatctgaaactgaactgaaatagaacagaaatagatcccaagtgatggaacctgtgcctttcccaaagcttggcttctaaaaggtagcaaacattttctactggagaggggaaagacaggaagaagaaaaagggagtttcctccttttctcttgggctctcagccagacagccactggcaaaacgttggaaaggcctaaatttgtcctggatgcacttccctgatcctagtcccaccaagcccagcccccacggccttaagcccctatggctccctcccaagattccaaacgtaagaaaagaacacacaccacagtccaaaggcttcttgtctggaatagccaaccctggggtaattgttaggtggaatgcaatctggttgaattcattcaaacactgtaggaattgcctctttcgaaccctgtaggattttacttcttgacgcatctgtttatttaaaaccaaaggggtatgttgaggcatgggcaccctggcagcagaccccaaaccaaccctcttgacttgtgcctgcctttcaggatatgttcccttcctgaatttgtctaagaaggctgagttggggggtggttgctgatttttataacatatagccagttgttcataggcctgtgttttaaagaagggcaagcctgaactcaccgtcctgcctcagggcctgggctccatacctggggagtagacagtcttctactttctaaaaagctggacttgaaatttggagtaaatctcctggttgagtgacaggtgtttcgcagctgagcccttgaggagattctccagttgggcagagacatcccttcctcagacgccttgtgggctggactcctttggcccagttcaaagtgaggggagggctcccaacaggccgggaagacagttgacttcaccctccttgggtttgtctgtctgtccgtctctgggaatggtcgcttcctgttttcccttttccttttaagcctcgccttgttcccctcttctctctcttcatgaactactccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgcgaagctctcttgcaccgggctttttcgcctggtgattgatgtcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtgagtccggcccgcgcgctccccgcctggccgcggcccgggctccgtgctacccctgccccgccgggtggctccccaaagccggttctgcgctccaggtcgcccagctcttcttggtgcttcccccaagttgagccgcccgcccgattctataacgcagactcgccatgcttgaagagttctctcagcctggacccctctctgtctcccgaaggacccctgctcggaggagctctccctggtcccctctccggatccactagccgggtcaggcagagagaaggaggccatagattcaggaccaccttctgcagctactcttggcctgggaatcttagagaaaggggtgcaacgtgaacagtttcttccgtcctggctgctgttctaggacccaggaagcgagccccaggatcagacacaagaaaagaacaggttcccccacctccagtcccctacacacatgcacttcgcgcccctagctccggtgcccgtggtgctgcggggccagtgggggctctgagccccggtaaatcagcagaaccagtggcctttttttttttttccggagagcaggcttcatctgggaggatggcagcggggcttagccgcccaggacagctagcttttcattttcgttctctcccggctgggtgtcctaccccgggcccagccctgttatcttgggcacgaacaatgcaccggtaggctggtgatcggtggcgggaagactactcccgggacattgggtactaagtggtggccgctgccgccttctctgctgcccgctcccgccttcctctgctggccctggctccctctgctcccgtttccactctgggcactcaactctccctctggcgtggatcccttcccccgttctcactttctgctccccttagggttccctggatcctagaccacgatccttccgtccgggctgggaagcagccacaaattgagcccaggttagccagccgatcttagagagaggaggcaggaggcactggctgctgctggcagagatggggcctcctgggggtcccccggttcaagggcccaacagtggaaggggggtttacataactacttgggagaagctgctgagagctagatactgggccaggagattccaaagcacccctggcttcctgcttctgttccaggcagcagcacagccagggaaactgcttctgcagcttcttaccagactctggggccacggcagaagtggtgtggaggctggtgtccagaggaagaacagttgcttgggtctaggcctcaggaagggccctccctagaggggtcccagtgcccccaacctaagttttctctggcctggggcagcagggcctggtgcccatcccattccccacccaggccaggccagtcttgaagggccctgctggaaacccagccgggagtccactaatcctgggcctctggtgaaaggtactcggtttagggcctaccgcggggccctaatactgtgtcaggcatgaaggcggtttcagcgagtgtatggctgtggccttgttttgctctgtgtcctgtgtgcttgtcccgtgcctgtgcttgtctggtcctgtttgggtgtatagatctgtgagtttgcccccgttgtacgttgtgttggtgtgtgctgctgtggatggaggctcaggtcgggttccagagtcaggctcggcctcttactctgagcctgaaggcctggggctgactgaggggaggggagcgtgaccattagctcgccttagactgcccctggaggagaggcggcagggaggtggttgggctcgcgggagcccggggccagggaggcctccgtggtagcggcgacggcggcgtcggactggcgggcaggaggaggccgtttcccgccgtgggcttgtcgctgagggctaacgggaggatctcggccctgctcgtgggggttcagctgctgcgctcgctgactcgcggggtgttgggcctgggacgcttcctgacgctctgctgcttgcctctgccgtctgtctgtctcccgctccagtggccctctcacccttcactgtaacacgccgtataggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggaggtgagcaagcggggcgggccggccgcccgcgagcggcgcggtctcaggcagctctcggttcattggcctctcgtggggcgcacatactttttccgctcgcggtttctgatcctttcggaggagcgagctcccgctaggcttgcggggagctggaagcaaccgaggccgatagctgggatggggctgaagagccctggctctgttttaccggaggcttcagggctttctggttggcacactctctgccggtgtagacgcggcaggtctattccgccgcttgggcaaacaggcgggttagtgcactccacgcagtccaggctccagggatctgtgagtcctggggagctttttgtttgcgcaaactcttgcttatggaatcctgctctgtcctggagactggatgcagaacagcccgcaccttgttgcagcgctccagccgggctcccggcagagggtctgtggccccagaccgcggccctgctgacggtctcctcccccagacacccggcctttgcgcagccggtccctaccctggaaggagaaaatcaatccgcgccggctgcggcggggtttcgcgggtcccactggaaggggaatcaattaggagcagatgggtgtgtgtgagaaagagaattttccttctcccatagccacaactctagttactacgcaatgggctttttgttttgttttgttttttcacatttacgctcacggacgtgaagcgtccccaacactctcgagcagcctccctctccgcgcgcactgacgctttctccggctgcaccctctggcacgctgcaccctcccgcacatctggcccttgcccgccggagtttctcccctagctcaggccccatggggtagcgcgggagagtctgggcgaagtcggcggcgccgagacgggcgggccttggggcaggaggaaggaattggagtttcctctttttctgaacgaaggcgaggaatctgcctgggattccgcctacggggccacaaaggaagccatggccccacgattctaccacaacatttctgacgctgggaaaggagtgggggatgcggcctcagaccttggaacgctaaagagggagccagggctagctcgggggttggggggactccggtttccaaggcctactgagggctgctggcctaggggaggagaggcagcctggcaggcctcccagagagaggggcacagagaaagaaagaggcaggcaaagagagaaactgaaacacaaccagtttcagaggtggagagggatagggaccccgctcaaggaaaaaaaaggagaaaaacaggcagcctgcagaagtcttatttatgtataataaagaaaaagcaatggatgactgaaaccaccattttcttttcaaacaaattcctttaattcagagagaaccaagtgggtggggaggagagaaaacgagagataagacacaaagcctaaaagagaaatattcaggccgtttgaaatgcaggggataagggaaagacgaaagacggaaagatacacagagtcaagaaaaggcggcccagagcaggtcagcagccgctgctggaagaggcccttgcaggcttcgcatggcttcatcgatcgcctacaaattgcttctgaaggccccagggactcccattaggtctgtccaccttagagacagacgtttgatctcagttgacagggtggaggggcggcagtaaatggaataagtgagtcatcgcctccctgaactgcctcagaggaagccagtgggtccagcaggagccccggtagggcacagggctccacacagaaggcccaagtcctagaagacattcgcagagagagggaggaaagagacgtcccgcagagcagatcgtacccgctggtccttgcctctctgccctggacttgtgggtagggtgagggccctctggcttggaatggcacctggtctccctcagggccggggagggggaggcgagatgccatcctaccccggctgccccttgtgaggcctccggggtgtgggcgctgcgcgtggatgcgagtcccagctgtttgggcctcgcagactttcccatcgctcctcctctgggataccttggctccatccgctttggggtttccagtctttgttggagtcaggactctcaaaagaagggaacgcgttataggggcccaaactggatttggggactgcaaaggcgagcagcgctcgttcagtttatctcctgggaacgcaccaggagttgggcacacgcgggagctgggtcggtgctcctggcaggtaacggcttgttcccggtgcagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccggagtcagggctgcctgctccttgcggaccctagcgtccttcagctacttgggtttggtgtgtgagctgatgcttcaggggcagcccttggtacctgaacttgagagacatgttgcggggcaggaccctaaggctctggagagaggaaaggaagaggacagatggagagaaggcagagttgaggagagcagggagagccaggctctcctgggattaccagtgcctgagaggatgtggatttctttggatgtgagagtcgtgtgtgtgtgtgtgtgtgtgtgtgtgtgtgtgtggtgtgtttgtgataatgtgagcaatcagcaatgcgagcaaatagtgaatatttataatggtatttaagtgtataattgtgtttgcaattcttgcgtgtaaatgcttgtttctgcttaagttgcaaatcgaaactatcattgtatgcacgggcttgtagtggtgtgtgtgtaaccgtatgtgaatgtgactgtttctttttgggtaattgtgtaatcaaccattgtttgtgattatgtatgaatcgtgttgatgtttgggagaatatgtattagtttctctttgtaaatctatttttctgtgaaatgtgtgactgcttctgaagtggatcatcttgaattttatgggtgtaattgtgtgtgagatgtaattatgtgtgagctgtgcattttccctgtatttacttgtgtgtgacagaatgtaattgggggagtaaaggtagtggggagtgtggatcactgtgggagaccatcactgcaagtgggtgggtatggttctgtatgagtgtgtgtaattgtgtgctgatggtgtatgtgttggtgggagtctgttgtgcgatacgcagatacattgtggcgggaccaacatctgctgaagttctggggctctagacgcttacccagcaagctgcagagactggggcacattgaatcagaaattaaggccagaatcctctctggtgctgtaagtgggacctaccagttcccagcactagcctggcctaggagagatctaaagaattgactttctgggaacctccaggagccctccagaccacccttgccagacctgcagccacagtacacatgcacacaggcataacagccagtccccagcctattcgaattatcctagacaagactgacttgggtctgcttttctggaagaagctgtgtggtggagggtctacagaactcatcaccctaggggtgagttgaaatggaggggtaagaggctttttctctgggatgggagagtgagagaacttttcagctgaaagtggaagttcgtggtgtgggggtcactggaagctctgcagaagtgtttgcgggatactgagggtggggagccaccctaactgtcagaaccactgtcccccaaccctgcccctgcccggcagccatgagggctgtgacacaggtcgtgagcacagcaacttcccaccccagcaagcccatggggaagttcggctgagtggagggtgggcttggtcatccaccccctcatctggggtcccctgggatatccgcataagagggggcttctgtcactcactttgtgtagacatgaagaaaagagaaaaagaggggagggttcagggtccgaagacagcagccagcctttccgccccatccccgcaggcccgcggagtgctcaggttgggccctgacgagctgtgtggagcgtagtgagcaggttctggcggcagcgccgggtctgctgcaggtctcccgcattcaccggctgtggcacccagcgccaggccgcgcaaaatccagaaatagcctccagcacctcagaagtcgtctccctctacctgggcaggtctgctgtcccctctgctcccgcaggactggagccaccgagctcgcgccttcttctcggggtgcgatttctctcctcttttggactcaagatcaatgcttcccggccggcgcagatcacacagcaggaccccaggggagactgtggccttcttcccgcc

SEQ ID NO: 12493 - DNA, 5430 bp, Human
  misc_feature (1)...(5430): n = A,T,C or G
gggcctgcagaggcctggcaatgcatatcttgtaggggaggtgttggctgggtcacaattccctccagagtcacaagatttgccctcagtgcaagggaaaggtccagggacatgttcagccccttaacatgcctccctaaggacagtgcagaggtctctgaggctcaggaattctgggcacagccctggcaggagaagtggcaagcttgaatgcctgggtctcgttgtctccccacagaacgtgcggagattgcccgagacggagatgtgggctgaactctgcccctcggccaaaggcgccatcatcctctacaaccgggttcagggaagtcccactggagcggccctagggtccccagccctactcccgccgctctgaaaataataaacgactttattcttggattccgttggcatctgctatttctgtaacagagaggagcaatgggccctgagtgtgtaaggcaggacaagtgacttgggaaaaaaaaaaaaaaaaacccgcccagcctgtgtccccctctgcaagcaggggataagaactgtgcctccctttctttgctggctccagagaggctccggggcggaagcagctccgtaagatatacctcgctgcagaggggagcaacagcggaacggagacacggtggccgggccgaaaacgtcacaaagccgcagagagcgggctctgtcccgcccgctccccaggtgggcgcccgcgcctgtccagcgagtccgcaggctgggggaccggaggcaccaaaggccaatagacatgtaggggcggggtctccaccgattttttttttttcctgacaggtggacgtggtcttggcatccacgccaatgagaatgtgagggcggggcctgaatagacgcaggaaatggcgacggccgcgggtctgtgagcagcgggggcggggcctggttgtggcccctccttctcccgtccccaagttccctgggtgggaacggggtcttggggtccctggctgggtggccagaccccgaagccagcgctgggaagggctgcggatgcccgggtcagaggaaggggcaggtccaaggacacgcgggtctggtcctgggcaagaaccgccccctctccgggcctgcttcagtcttcctttgcagaacaacgggccaggccccttccctctgcccccgggtgcttgaagtctagccccatcctggtccaatgcgctcttggtagcctcctttcccagctgcccgcccgccgccatgccgcccttactgcccctgcgcctgtgccggctgtggccccgcaaccctccctcccggctcctcggagcggccgccgggcagcggtgagttgggcgcggggggccggcccggttgttcaatgggtttctgtttgccctacgtgctgagttagttgtggtctctactccgtgtcaggaggctcccaggtttgtctcaggtaaccctcgccttccctgctgaggatcagagatagagaagacccccaaggtcatacaccgatttaagcggcagaggaggaagtttgagtccaggtcaaacccaacgctcttaccacagctctagtggtttccaagcatcgctgtatcactgtgcataaccctctgtggggggtgggagatggggaggtgtcgggtacaaaatccagattcctgggctctgctctggagattctgaactggaggaatcaattgggtgggggtcaggaatcagtttctttctctttttccttttttttttttttttttgagatggagtttcgctcgttgcccaggctggagtgcaatggagcaatctcggctcaccacaacctccgcctcccgggttcaagcgattctcctgcctcagcctcccgagtagctgggattacgggcatgcaccaccacgcccggctaattttgtatttttaggagagacagggtttctccatgttagtcaggctggtcttgaactcccgacctcaggtgatccgccctcctcggcctcccaaaatgctggattacaggcgtgagccaccgcgcctgtccaggaatcagttttttccaacaagtttttggactccactttgagaaatcctgacctgcactatgcctgaaacactccaaagggggtgctgatctggagacagatctgtcctgggacctgtttcagccctgtcagctcctggtggctgagttgaagggtgtggcccagaaggcagggcagagctagcttctgggttccttcagcccctgcaaggtttgggactctgtccacaggtccagacccagtacttattatgaactgttgggggtgcatcctggtgccagcactgaggaagttaaacgagctttcttctccaagtccaaagaggtacccgtacccctgaggtggggagggggagcaggaactttgagccagtgggggtgtgcttcaaattcccaggagtagaccagcatctctggcgggtgccacattttttcagccctcatagggagtggcaggtgctcaatggtaggggaaaggctgtgggcaggagccaggggtcctgtctgatgggctgggcttggttttcttgacctgcctgcctgctcttgagaaacctggaccagggcatatggtgaatgcagggggctggcaggtggggagggcttgaacacaggaggaagcaggagtccatgctctctggccttctgaggagtgggcaggcctgagtgagggtcactgaccaggcagggcctctgggtatgactggagccctggtgggtggatgtcatcagcatgggtcctggggagggacaggcaaagggagataaggggagtcctgccccaccccagctgcacccagaccgggaccctgggaacccaagcctgcacagccgctttgtggagctgagcgaggcataccgtgtgctcagccgtgagcagagccgccgcagctatgatgaccagctccgctcaggtagtcccccaaagtctccacgaaccacagtccatgacaagtctgcccaccaaacacacaggtacagtaatcctgccctcagcttgccccacccccaggtctcttgggtagtctcatttccacaatgtcccttcctctgcctcccagcagctcctggacaccccccaacgcacagtactggtcccagtttcacagcgtgaggccacaggggccccagttgaggcagcagcaacacaaacaaaacaaacaagtgctggggtactgcctcctcctcatgctggcgggcatgggcctgcactacattgccttcaggtgatgcctgttctccccggggtgatgggcagagggcaggagggtgggtgaattccagtgtggtcagccagtcctccacagcacctcgtggcccgtactcttgtgtctctcaagctaagagctgcttgaagttggtctctggagcctctccttacttattaaaggcagcgctgcaccaagagctaacgttgtcatttacagtttttcatatttcgaatgtaaatctttcatgctggctgccaggaagggattgagccaaacaaaatcaagcacaagcagcaaatgcagcacagctcattcatttggcagtaggcatctccctgccactctcacgcgtgccacggagctgattctctttattctctttttttcttttttttttctttgagatggagtctcactctgtcgcccaggctgcagtgcagtggcgcaatctcggctcactgcaaccccacctctgcctcccaggttcaagcaattcttctgtctcagcctcccgagtagctgggactacaggcgtccaccaccacacccggctagttgttttgtatttttagtagagatggggtttcaccatattggccaggctggtctcaaactcctgacctcaggtgatccacccgcctcagcctcccaaagtactgggattacaggtgagagctaccgcgcctggccacaaagccgattttctatagcagatacctaaaggccagtgcccactgctagcagcctgcctagttcagtgatggagttagacgcataccctttctagtcttctgggaggagcacccccatgtccacagctgctgtcacacctcaaagtgaccagggacttcggatgccattggaccctagacaagccagggccactctgagccctccctatctatcacaggaagggttagactgaggttcctaaccctgtgtaagggtaaaaagctgtgaggcccctagagtggggtggaagggggcaggacttcagggacagcaggaattggattcccagggttaattgtgacccattgcaggaaggtgaagcagatgcaccttaacttcatggatgaaaaggatcggatcatcacagccttctacaacgaagcccgggcacgggccaggtctgtccctgctctattctgctccctgctccctgtccaggaaccacacttcgggatccctatcccaaccacccaggtgccctctcctccagggccaacagaggcatccttcagcaggagcgacaacggctagggcagcggcagccgccaccatccgagccaacccaaggccccgagatcgtgccccggggcgccggcccctgaggggctcacctggatggggcctgcagtgcgttcccgctttgcttccttccctggacggcccgctccccgaaacgcgcgcaataaagtgattcgcagagctcgtgtccggctccctccttaaggcccgacgcccccggccccggcctcgccaaggggcagcgccccgccctccgggtagttttcaccacgggggccgaagcagccgcgcaagcgaatagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn
